United States Patent 10,457,954 (ISOLATED POLYNUCLEOTIDES AND POLYPEPTIDES, AND METHODS OF USING SAME FOR INCREASING NITROGEN USE EFFICIENCY, YIELD, GROWTH RATE, VIGOR, BIOMASS, OIL CONTENT, AND/OR ABIOTIC STRESS TOLERANCE) - sequence listing, part 2

SEQ ID NO: 1553 - DNA, 1178 bp, Zea mays
ttccccactgttttataggcagctggtgctcctccgaaagcgaagtccagcgccccccgctcctccattcgcgcaaagacgccaagcccacccagcgaaatctctccccaaactacccctcgccagcgcccggcgatgtgcccaacgaagcccgatcgccctggccaggccgccgccggctccggcgagaagagctggcgggaggaggccgtggccgcctgctcgctgcggctggtcgacctggaccgtggcaccaacggctgggcctcgccgccgggggacctcttccacctgcgcgcgcgcggctacttctccagcggcggcgggaagcgcggcaaggcgccgtccgccgcggactggctgctccgccccgccggcgtcgactggctacgctcccacgcgcgcctcgaccacgtgctcgcccgcgacgacaaccgcgtcgccgccgccttccgccgcgcgcgcctcaggaaggaccccagcgcgcacttcctcctcgccgtcaatctccaggtgccgggccggccggacgcgtacagcgccgtgttctacttcgcggcggaggcacccatcccgccggactcgctgctcggccgcttcatccacggcgacgacgcgtaccgcaacgcgcgtttcaagatagccaaccgcatcgtcaagggtccctggatcgtccgcgccaccgtcggcaactacgcggcctgcctgctcggccgcgcgctcacgtgccgctaccacaagggcgacgactacctcgagatcgacgtcgacatcggcagctcagcgatcgccagcgccatcctgcatctcgcgctcggcgccgtcacgtcggtgaccatcgacatggggttcctcgtcgagtcccagtccgaggaggagctgcccgagaggctattcggcgccgtgcgcatcgcgcagatggagatgagcgcggccaagtacgtggagctgccccctgatgaggccatgcctgagacggccggcagggccggggccgggttcagggtaagctcggcgaaggtggtcaatcatagccgccaacaagaccacgccggcggcaaggtcggcaggtcgatgagttgcccggagcgagagagcggagagaaataggtgcaaagtacgcgggtgcagtgcagaaagaaaccatccaccggtgggagcgagagcggtggcgagaa

SEQ ID NO: 1554 - DNA, 1249 bp, Hordeum vulgare
cccccgacgacgccccagcgccggaagcaggacgaatcgggcgaaaactggcgcgaggaggccgtgtccgccggctcgctgcggcaggtggacctcgacaggggcaccaacggctgggccgcgccgccgggcgacctgttccagctgcgcgcgcggggctacttctccggcggcggcgggaagcgcggcaaggcggcggcgtcggcggactggctcctccgccccgccggcgtcgactggctccgctcccacgcgcgcctcgaccacctgctcgcccgcgacgacgtccccgtcgccgccgccttccgccgcgcgcgcctccgcaaggaccccgacgcccacttcctcctcgccgtcaatctccaggtccccggccggccggacgcctacagctcggtcttctacttcgccgcggaggcgcccatcccgccggactcgctgctcggccgcttcgtctacggcgacgacgcgtaccgcaacgcccgcttcaagatcgtcaaccgcatcgtcaagggcccctggctcgtccgcgccaccgtgggcaactacggcgcgtgcctcctgggccgcgcgctcacgtgccgctaccacaagggcgatgattacctcgagatcgacgtggacatcggcagctcggcgatcgccaccgccatcctgcatctggcgctgggcgccgtcacgtcggtgaccatcgacatgggcttccttgttgagtcccagtccgaggaggagctgcccgaaaagctcttcggcgctgtgcgcatcgcgcagatggagatgggctcggccaagtatgtggagacggcgactgaggagcctgagacggccggcaaggcggcgccggggttcagggttggttcggcgagggtggccaacgatagccgccaccaggaacgggccagcggcaaggccagcaggtcgatgagctgccaggaacgcctgggcggaggaaaataggcacggattaagcgaggatgatgtataaaccgtgagctggagactggcgccgagagagagagagagagagaggaagaaggatgggatatatatataattatttgtttaaagataagggcaatttagttagggcacagaatgcaatgcatgctccttcatcatcatcttcatcatcaccataatgtcatcaagagcagatgcctggtcgatggcaaatattggtagattagtagtgctacttcgtaaatgagtcccgtataatgagatgaggtgagatgcctcggcttggctt

SEQ ID NO: 1555 - DNA, 1249 bp, Hordeum vulgare
cccccgacgacgccccagcgccggaagcaggacgaatcgggcgaaaactggcgcgaggaggccgtgtccgccggctcgctgcggcaggtggacctcgacaggggcaccaacggctgggccgcgccgccgggcgacctgttccagctgcgcgcgcggggctacttctccggcggcggcgggaagcgcggcaaggcggcggcgtcggcggactggctcctccgccccgccggcgtcgactggctccgctcccacgcgcgcctcgaccacctgctcgcccgcgacgacgtccccgtcgccgccgccttccgccgcgcgcgcctccgcaaggaccccgacgcccacttcctcctcgccgtcaatctccaggtccccggccggccggacgcctacagctcggtcttctacttcgccgcggaggcgcccatcccgccggactcgctgctcggccgcttcgtctacggcgacgacgcgtaccgcaacgcccgcttcaagatcgtcaaccgcatcgtcaagggcccctggctcgtccgcgccaccgtgggcaactacggcgcgtgcctcctgggccgcgcgctcacgtgccgctaccacaagggcgatgattacctcgagatcgacgtggacatcggcagctcggcgatcgccaccgccatcctgcatctggcgctgggcgccgtcacgtcggtgaccatcgacatgggcttccttgttgagtcccagtccgaggaggagctgcccgaaaagctcttcggcgctgtgcgcatcgcgcagatggagatgggctcggccaagtatgtggagacggcgactgaggagcctgagacggccggcaaggcggcgccggggttcagggttggttcggcgagggtggccaacgatagccgccaccaggaacgggccagcggcaaggccagcaggtcgatgagctgccaggaacgcctgggcggaggaaaataggcacggattaagcgaggatgatgtataaaccgtgagctggagactggcgccgagagagagagagagagagaggaagaaggatgggatatatatataattatttgtttaaagataagggcaatttagttaggccacagaatgcaatgcatgctccttcatcatcatcttcatcatcaccataatgtcatcaagagcagatgcctggtcgatggcaaatattggtagattagtagtgctacttcgtaaatgagtcccgtataatgagatgaggtgagatgcctcggcttggctt

SEQ ID NO: 1556 - DNA, 1158 bp, Solanum phureja
gtaaaggtgaggtgtgccgatcaaatccagcacatgcaaacaaagagtatatagtcagcaatcaacaactagctagctatagccaccacacaatcaaatcaatatcatgaatttcaacaaattcttctcctaacttcacacatcacacacttatctcttttcccttctttcatactattaatatcacaccttttttttcctccttcattctctctttccttctcaaataatcacaaggaattcatttctagtttcaattcttagccatgggtggtgatcacaaagaaaagaccactataatggtgctaaaggtggatcttcagtgtccctgctgctacaagaaggccaagaaaattctctgcaaaatgcctcaggttcgagatcagatgtatgatgagaaggccaatactatcaccatccttgtagtctgttgtagtcctgaaaggattcgcgataaattatgttgtaaaggaggaaaagcaatcaagagcattgagatcaaagagcccgcaaagcccaaggagcccgaaaaacccaaagggggtgataagcccaaagagcccgagaagtccaaagaaccagagaagaaacctaaggttgtcacttttgaaacgcccaaggaaaaagcaaaggagcccgaaaagcccaaagacaaagcgaaagattctgataagcccaaaggacaagaaaagcccactgtaattgataagcccaaggacaaaccaaaagatcccgaaaagcccaaggacggtcctacatctgcagcaatggtggcaaccccatggatatccgaaccaatgatgatgatgccaccagttcacggatacccccaggcaatgcctggttgtggctggggggaatgcccttataccggtggcccgtgttaccagtattacggaacacctgtacccccacagcccgctccataccacggtaactactcgtatggatatgggcccgggccgggcccatctagctatggaaagggttattatgggaacaatgattactataatgaagaaaatggtcaaggatgcacaattatgtaatgtgacccaaatcatttgtgggtcacttaaatgggcctacttagtacttctttattgggcttctaaaagagcccagaacaaagttttgggctccatatggatgtttatt

SEQ ID NO: 1557 - DNA, 1304 bp, Solanum tuberosum
caaatcactatcgtgaatttctacaaattcttctccttacttcacacatcacacacttatctcttttcccttccttcatactattaatatcacaccttttttcccctccttcattctctctttccttctcaaataatcacaaggaattcatttctagtttcaattcttagccatgggtggtgatcacaaagagaagaccactataatggtgctaaaggtggatcttcagtgtccctgctgctacaagaaggccaagaaaattctctgcaaaatgcctcaggttcgagatcagatgtatgatgagaaggccaatactatcaccatccttgtagtctgttgtagtcctgaaaggattcgcgacaaattatgttgtaaaggaggaaaagcaatcaagagcattgagatcaaagagcccgcaaagcccggaaaatccgaaggggatgataagcccgggaagcaggaagaaccacagaagaaaactaaggttgtcacttttgcaacgcccaatgacaaagcgaaagattctgataagcccaaaggacaagaaaagcccactgtaattgataagcccaaaggacaagaaaagcccactgtaattgataagcctaaggacaaaccaaaagatcccgaaaagcccaaggacggtcctacatctgcagcaatggtggcaaccccatggatatccgaaccaatgatgatgatgccaccagttcacggatacccccaggcaatgcctggttgtggctgtgggcaatgccattataccggtggcccgtgttaccagtattacggaacacctgtacccccacagcccgctccataccacggtaactactcgtatggatatgggcccgggccgggcccatctagctatggaaagggttattatgggaacaatgattactataatgaagaaaatggtcaaggatgcacaattatgtaatgtgacccaaatcattgtgggatacttaaatgggcctacttagtacttctttattgggcttctaaaagagcccagaacaaagttttgggctccatatggatgtctattttctatattattactctgtattcattaataatagtaccaaattcgatgtatacaaggtatatagttttattttaatgataaaaagtgcataaagaataataagtaggtgaccagatggatggtgaactgtcttattatatatagtagtaattgattatacaatttgattaaagaaaagcacttcattatataatcattgccctttttaaaataatactttgtggtataatattatatctttgattatttattt

SEQ ID NO: 1558 - DNA, 1331 bp, Solanum tuberosum
gtaaaggtgaggtgtgccaatcaaatccagcacatgcaaacaaagagtatatagtcagcaatcaacaactagctagctatagccaccaaacaaatcaaatcaatatcatgaatttcaacaaattcttctgctaacttcacacatcacacacttactcttctttcatactattaatatcacaccttttttttcctccttcattctctctttccttctcaaataatcacaaggaattcatttgtagtttcaattcttagccatgggtggtgatcacaaagaaaagaccactataatggtgctaaaggttgatcttcagtgtccctgctgcttcaagaaggccaagaaaattctctgcaaaatgcctcaggttcgagatcagaagtatgatgagaaggccaatactatcaccatccttgtagtctgttgtagtcctgaaaggattcgcgacaaattatgttgtaaaggaggaaaagcaatcaagagcattgagatcaaagagcccgcaaagccccccgaaaaatccaaaggggatgataagcccgtgaagcaggaagaaccaccgaagaaaactaaggttgtcacttttgaaacgcccaatgacaaagcgaaagattctgataagtccaaaggacaagaaaaacccactgtaattgataagcccaaaggacaagaaaagcccactgtaattgataagcccaagggcaaaccaaaagatcccgaaaagcccaaggacggtcccacatctgcagcaatggtggcaacgccatggatatccgaaccaatgatgatgatgccaccagttcacggatacccgcaggcaatgcctggttgtggctgtgggcaatgccattataccggtggcccgtgttaccagtattatggaacacctgtacccccacagcccgctccatactacggtaaccactcgtatggatatgggctcgggccgggcccatctagctatggaaagggtttttatgggaacaatgattactataatgaagaaaatggtcaaggatgcacaattatgtaatgtgactcaaatcattgtgggatacttaaatgggcctacttagtacttctttattgggcttataaaacagcccagaacaaagttttgggctccatatggatgtctattttctgtattattactgtattcattaataatagtaccaaattcgatgtatacaaggtatatagttttattttaatgataaaaagtgcataaagaataataagtaggtgaccagatggatggtgaactgtcttattatataatatacttagtaattgattatacaaatttattaaagaaaagcacttcattt

SEQ ID NO: 1559 - DNA, 1519 bp, Solanum tuberosum
gcagaggtcgggtcccaaatagtaagtcgggccctagtttcttcacccccacaatctccgtcgaactggcgatggtcgataacttcgatgatatcatcaactgggacgatgtagatcacatcttccacaacgttctagacaatccccacgatgatgatcaattcactcttcatgattcctccccacagacattccagcagatcgagcagcttcttatgaacgatgacgatgtcggtcttgtctcttttgaagacgctgatcctcaatttgctgccgactttctctccgacgtcctcgtcgattcccctcttcactccgatcattctcactctcctgctgaacaagccattggattcaccgattccaaggtttctagtggatccgacgccgatcaggacaaacacaagtcgccttctgacggggacgacgaattaaacaaccatgaccctgtcgataagaagcgcaagaggcaattgaggaacagagatgcagctgtgaggtcacgagagaggaagaagttgtacgttagggatcttgagttgaagagtagatactttgaatcagaatgcaaaaggctggggtttgttctccagtgttgtcttgctgaaaatcaagctttacgcttctctttgcagaatagcagtgctaatggtgtttctatgaccaagcaggagtctgccgtgctcttgttggaatccctgctgttgggttccctgctttggttcctgggcatcacatgcctgctcattctacccagccaaacctggtcagttccagaagaaaatcagggaagcagaaaccacgggcttctccttccaataaaggaaggaaaaaagactagtcggattttgttgttcctgtccttcatgatgggcaaaagatgcaaagcttcaagatcgaggatgaagttcaacccccattccttgggagttgtgatgtgactcgttgtgatcaaatccattcccttaggtggatcatggttccttttgagttctttagttttgtgtcagagattctctgtatgtgtcttgctttgacatctgaaggatgtagttcactgttattagttaatgacttatgagctatatatattatctatgcaactttttaacagttccaagccggtaacaaccaacaaacagatagaacagataaacatatgaacagacagcaactaaacaagaaacagaataaatataaaaaatctctaagggggggcccgttcaccaatttcgcccttatattgaagtcgtaattaacgcgcgtctcaattggcgcgtcgttttggacaccgtcttaattgggaaaaagcctgctcgttcaccccaattttattcgtctttgcgaggcactatcccccctttgtgccaactgggttgtatttaagcaaaaagaagggccccgcaccgaatggccccttttccaaatacctgttcttgcatgccctgagattggcgaattgggaccccgccccttgttaacgggcccataaccaccgctggtttgtttggttacccca

SEQ ID NO: 1560 - DNA, 1214 bp, Solanum phureja
aaacttgtaatttcgttgaaagtgtttggagccttaacctctaagacacctaacgtgattattaaattggggacatccagaggtcgggtcccaaatagtaagtcgggccctagtttcttcacccccaacaatctccgtcgaactggcgatggtcgataacttcgatgatatcatcaactgggacgatgtagatcacatcttccacaacgttctagacaatccccacaatgatgatcaattcactcttcatgattcctccccacagacattccagcagatcgagcagcttcttatgaacgatgacgatgtcggtcttgtctcttttgaagacgctgatcctcaatttgctgccgactttctctccgacgtcctcgtcgattcccctcttcactccgatcattctcactctccagctgaacaagccattggattcaccgattccaaggtttctagtggatccgacgccgatcaggacaaacacaagtcgccttctgacggggacgacgaactaaacaaccatgaccctgtcgataagaagcgcaagaggcaattgaggaacagggatgcagctgtgaggtcacgagagaggaagaagttgtatgttagggatcttgagttgaagagtagatactttgaatcagaatgcaaaaggctggggtttgttctccagtgctgtcttgctgaaaatcaagctttacgcttctctttgcagaatagcagtgctaatggtgtttctatgaccaagcaggagtctgccgtgctcttgttggaatccctgctgttgggttccctgctttggttcctgggcatcacatgcctgctcattctacccagccaaacctggtcagttccagaagaaaatcagggaagcagaaaccacgggcttctccttccaataaaggaaggaaaaaagattagttggattttgttgttcctgtccttcatgatgggcaaaagatgcaaagcttcaagatcgaggatgaagttcaacccccattccttgggagttgtgatgtgactcgttgtgatcaaatccattcccttaggtggatcatggttccttttgagttctttagttttgtatcagagattctctgtatgtgtcttgctttgacatctgaaggatgtagttcactgttattagttaatgacttatgagctatatattatctatgcaactttttaacagttccagccgaaatttggttgtcttt

SEQ ID NO: 1561 - DNA, 1276 bp, Zea mays
ggagcagctcacgcgcgtgcggcacaccacctctcgcctcagcgccgccccacccccactataaataacgggaccatcctccccttcccctgcctccacctccgctccagtcccgtgtcctcctcccgccgtctctctcgtcccggacgcctccgccgcgccaatgcgccacgcctcgccaccgcaggagctccccgccgccgggcgcgagatccaggcggcgctggcccccgccaacggcaacgccgcgggcgcccgcgggggcggaggctccttcacggcgctgctgggactccccactccgcaggccatggagctgctcctcccccgcacgacgccgcccgccctagccctagccccagccgcagcgcccgcgcccacgcccaccttcccctccgacccgcacctcgtggaccgcgccgggcgcttctccacgttcgcgcccccgtcgccgccctccccatccccaacgcagcagcctccaccgccccctcccgccgccgtcgccggcaagcgcaaggccgaccccgtcgaccgcgcctccaaggggaaggcggcgaagaaggggaagacggcggaggagaagcccgcggccgccggcggcgaggacgagaagccggcgtacgtgcacgtgcgggccaggcggggccaggccacggacagccacagcctcgccgagcgggcgagacgcgagaagatcaatgcgaggatggagctgctcaaggagctggtccccggctgcagtaaggtatcaggaacagcgttggtgctagatgagatcatcaatcatgttcagtctctccaaaggcaagttgagtacttgtcaatgaggcttgcaactgtaaacccgaggggcgattttggtgggctagatagctttctgaccacggagtgtggaaggatagcaagcttcaactgcaagaacggaatcgacttggagcaggtaacctggccagaaatgggtgttcatggagcaaggcagctgatgcaactccaacagcagttctggcatggtgatttggcgcatccacaccaagtggcttcacagtgggaaaagcggggggatggccatcctcccgtcttcagcaactccagtccctctctcttcggctatgatctaacaagctctggtaaaccttgcacgcagtcctatatcaccttcctgaatgaatttagttgtttgtcgcttacttcacatatcacagcctggcttgccccacaacttttgtctcttagtttgtcccgccagtgctctcttgagaacaaagtgtactga

SEQ ID NO: 1562 - DNA, 1350 bp, Panicum virgatum
tcgccagcagctggagcaagctccgttagtgccaacatgaagggtttctccttcttcaccacttctgcacttgccatccttgcgctcctccccgaggtcgccataggtgccggcctcaaggtcgggttctacaacaagagttgcccgtcggcggaggccctcgtgcagcaggcggttgctgccgccttcaagaacaacagcggcatcgccgctggcctcatccgcctgcatttccatgactgttttgtcaggggctgcgacggctcggtgctgatcgacacgacggcgaacaacacggcggagaaggacgcggccccgaacaaccccagcctgcggggcttcgaggtcatcgacgccgccaagaaggccatcgaggcgcggtgccccaggacggtctcctgcgccgacatcgtcgccttcgcggcgcgcgacagcgtcgccctggcgggcaacaacctcacctacaaggtccccgccgggcggcgcgacgggagggtctccaacgccaccgacgccctcaacaacctcccctccccgctctccaacgccgccgagctcgtcggcaacttctcgcgcaagggcctcaccgccgaggacatggtggtgctctccggcgcgcacaccgtcggccgctcccactgctcctccttcaccaaccgcctctacggcttcagcaacgccagcgacgtcgaccccgccatcagctccgcctacgccttcctgctcaggagcatctgcccctccaacagcacccagttcgtccccaacacgaccacggacatggacctcatcacgccggcggtgctcgacaacaagtactacctcgggctcgccaacaacctggggctcttcacgtcggaccaggcgctgctcaccaacgctacgctcaagaaatccgtcgacgagttcgtcaagagcgagagcaggtggaagagcaagttcgccaaggccatggtcaagatgggcagcatcgaggtgctcacggggacgcagggggagatcaggctcaactgcagggtcgtcaacagcggcagcagcgcgggaggaatcgagcttcagatgacgaccagcagctcccggcgacgacgacgacgactctgctgaagaattcaacgagattgcaacgaactagcagcttgcgtgctgctatatagagggatcgatgtgtggacagctcgagtgtgtcatgtatctgatgttcttcagtggcgtgtgatgacttctactacgtcagcttgtttctcttgaggcgaatgaaataaaccgagtgtatcaaaaaattcggaaaaagatgttaatttgttttattttctgttttggctgatgtttgaatagctgtttgtagtaatg

SEQ ID NO: 1563 - DNA, 1379 bp, Zea mays
gcctgcactgcacatacgcacgcacagctccagacacagctacgactcgaccacaagccagccatgccggccttcgcggggggcgcagcggagccgccgctggcagacagctactacgcgctcctccgccgcggcaatgacgatgaaggcgcctacacgacgtcgacagcgccatgggacgacgtctcactgcccgtggcggagtgcgagctcccgatgatcgacgtcgggtgcctgacgaccgccgacgacggcagctccccggaggcggaggcggagcgggcggcgtgcgcggccgccatcgcgcgcgccgccgaggagtggggcttcttccaggtgcgcaaccacggcgtgccgcaggagctcctggaggagatgcgccgggagcaggcgcgcctgttccgcctgccgttcgagaccaaggccacggccggcctgctcaacgactcctaccgctggggcaccccgaccgcgacgtctccgcgccagctgtcctggtccgaggccttccacgtcccgctcgccggcgtctccggctccggcaccacctgcgacttcggcgacctcaccaccctcagggatgtgactcgggaggtggcgggcgcgatgtcaaagctggccggcacgctggcgcgcgtcctggcggaggccctcctgggtcggcggcccgccggcgagcgcttcccggaggggtgcgacgagacgacgtgcttcctgcggctgaaccggtacccggcgtgccccatctccccaggcgccttgggcctggtcccgcacacggacagcgacttcctcaccgtgctctgccaggaccagcaggtcggcggcctgcagctcatgaagggggacagttgggtggccgtcaagccaatccccggcaccctcgtcgtcaacatcggggacctcttccaggcgtggagcaacaacagatacaagagcgtggagcacaaggtgatgacgaacgccaggacggagcgctactccgtcgcctactttctctgcccgtcctacgactcgccgatcggcacgtgcgaggagccttctctctacaggacgttcaccttcggggagtacaggagaaaggtgcaggaagacgtcaagaggaccgggaagaaggtcggcctccctaattttctcgcgcaaacataattatgatatccagtttttggaccgtgcatgccaacgcgcatgtgtacgttcctagctttaatttctctgtatacacaatggagaggagagtgcagtgtgatgttggtatagacgttattaataaatactaatttgtagcttaatttgatgtagctaccaccatacaagaatgtagcaggatcgagcggttgtgtgtgtgcgtgtgatcgttgccgatgataaggagctga

SEQ ID NO: 1564 - DNA, 1316 bp, Zea mays
atgccggccttcgcggggggcgcagcggagccgccgctggcagacagctactacgcgctcctccgccgcggcaatgacgatgaaggcgcctacacgacgtcgacagcgccatgggacgacgtctcactgcccgtggcggagtgcgagctcccgatgatcgacgtcgggtgcctgacgaccgccgacgacggcagctccccggaggcggaggcggagcgggcggcgtgcgcggccgccatcgcgcgcgccgccgaggagtggggcttcttccaggtgcgcaaccacggcgtgccgcaggagctcctggaggagatgcgccgggagcaggcgcgcctgttccgcctgccgttcgagaccaaggccacggccggcctgctcaacgactcctaccgctggggcaccccgaccgcgacgtctccgcgccagctgtcctggtccgaggccttccacgtcccgctcgccggcgtctccggctccggcaccacctgcgacttcggcgacctcaccaccctcagggatgtgactcgggaggtggcgggcgcgatgtcaaagctggccggcacgctggcgcgcgtcctggcggaggccctcctgggtcggcggcccgccggcgagcgcttcccggaggggtgcgacgagacgacgtgcttcctgcggctgaaccggtacccggcgtgccccatctccccaggcgccttgggcctggtcccgcacacggacagcgacttcctcaccgtgctctgccaggaccagcaggtcggcggcctgcagctcatgaagggggacagttgggtggccgtcaagccaatccccggcaccctcgtcgtcaacatcggggacctcttccaggcgtggagcaacaacagatacaagagcgtggagcacaaggtgatgacgaacgccaggacggagcgctactccgtcgcctactttctctgcccgtcctacgactcgccgatcggcacgtgcgaggagccttctctctacaggacgttcaccttcggggagtacaggagaaaggtgcaggaagacgtcaagaggaccgggaagaaggtcggcctccctaattttctcgcgcaaacataattatgatatccagtttttggaccgtgcatgccaacacgcatgtgtacgttcctagctttaatttctctgtatacacaatggagaggagagtgcagtgtgatgtaggtatagacgttattaataaatactaatttgtagcttaatttgatgtagctaccaccatacaagaatgtagcaggatcgaccggttgtgtgtgtgcgtgtgatcgttgccgatgataaggagctga

SEQ ID NO: 1565 - DNA, 2808 bp, Zea mays
cctccccgcttccaccccctcgcccgtcgcttcctcgtcacgagtcgtcgtctccccttcgccgaccgggacgcggaaacgctcgacgcaagcaaaccctagccaccgagctagcggggagcctggagggatgaagagcctgttcaagagtaagatcaggtggcagcaccggtccaacgaccccgcgtccccggcggcgccgccgccgcagacgtcggggccgccgcccgcgagctccccgtcggggacggcgccggcgccggcgctctccgtctctacgccggtctcgccctcgccctcctccgcggcggcgacgcccacgggcgctgctgctgctgcggcggcggctggagcgggaggggaggactacatatcgtcggaagaggagttccagatgcagcttgccatggcgctgtcggcgtcttccaacagcgactgcgcggggggcctggacggggagcagatcaggaaggccaagctcatgagcctcgatcgcttcgccgcccaccgggacgagacccacaccgcggagttcctctcccgccgatattgggattataactttcttgattaccatgagaaagttattgatggcttctatgacatctttggctcctctattgaatcctctaggcaggggaagatgccatcattagcagatctccaaacaggcataggggacctaggctttgaagtcattgtagtaaaccgagccattgatagtaccttgcaggagatggagcaagtggcacagtgcatcctgttggacttccctgttgccaatattgcactcttagtgcaaagaatagctgagcttgttacagataatatgggtggacctgtcaaagatgctaacgacatgctcacaaggtggctggagaagagtactgagctgagaacatcgctacaaacaagtttgttgcctattggttgcatcaagatagggttatcacgtcaccgtgccctacttttcaagatccttgccgatagtgttgggattccatgcaaacttgtcaaagggagcaattatactggtggtgatgatgacgatgctataaacataattaagatggacaatgaaagggagtttttggttgatctgatggctgctcctggtgctcttattccagcagatatcttaagttggaaaggcaattcgttaaattctaatcgaaaactcggcctgaatcgaacagctggatcatcaagtactgttgatgctaatgtggatcctactgtattgccacttgaacctaaaggtggccaactgcctttgttcagcagtggtgattggatgtcagacattgattctggatatgaggcagcagaaattgcagcttctactcaaacctcttcgggtgtcacaccatctgtttctgctggaagtgtttttggcagttcatggatgctggttaatcatgaccaatcagatggaccatcaacttctgctggtacatcatcgcagcagaaagttgtacctcaaagcgagcatcagcggaatttaaaccgccttccagatctgcaggaaattccagagtcaaaatacctttttgctgatcttgttccttctggggataataagtctaagaaaacttcagtaccattcaaaggaccagatcataggaacaatgagttgcaaaagcgcagagagaacattgtccctaatgctggaagaccacagcagcggttagttatgaagaattggtctccttacaatgatgtttccaacaacaaacagtacaattatgtcgaggattcgtttgctcgtagaaatgttggtaataatgctgcatcatcatcatcccagatgccacgaccagccgtaagatctaaccttaattctggattgcataatgatgcatcatatcataattatgatagcattatggctggtacctctgccatgaagattacatctacagctgagaccgggaaggttcctgaaagggttctgcgtggtgatttggacaagggtcaaacaaattatagattggaggatcaacatgtcatagttcaaccaccacagggaagacttccatggggtaatcctgcagaaggaagagttccaatgaatagagttcagagtcaagcaaaacaacacttggaaaacatggatgcaaagcaagaccataagaaattgctccctgatccaaaaaaatctccccttgacagattcatggacacatcattgccttcaagaaacatggacatgaggtcacagaggcttgacttcgatgatgtctctgagtgcgaaattccttgggaagatcttgtgattggtgaaaggattggcttaggttcatatggagaggtttaccgtgctgactggaatggaaccgaagtagctgtaaaaaaattcttggatcaagatttttatggcgatgctctggatgagtttaggagtgaagttcgaattatgcgtcggctgcgccatccaaatattgttctctttatgggtgctgttacacgccctccgaacttatctattgtatctgaatatcttccaaggggaagcttgtataagatccttcaccgccctaattgcctaattgatgaaaagcggaggatcaagatggcccttgatgtggccaaaggtatgaattgcctgcacactagcatgcctacaattgttcatcgagatctgaaatctccaaacttgctggttgacaataattggaatgttaaggtttgtgactttggactttcgcggttgaagcacagtacatttttgtcatccaaatctacagctggaacacctgagtggatggcacctgaggttctgcggaatgaacaatcgaatgaaaagtg

SEQ ID NO: 1566 - DNA, 1568 bp, Triticum aestivum
  misc_feature (19)..(19): n is a, c, g, or t
gggctgcaggaattcggtnacgaggctcttctttctttctcccctcgccgtcgcctcctcctcctctcacccaaaccctaatcccctctcccccccgcgagccgaggccgcgggcgcgcaggcaggcgcgggtgggcaatggcgggcaaggaggacagccggatcttcgtgggcggcctctcgttccacaccgacgagcgcaagctcgaggacgccttccgccgcttcggcaaggtcgtcgacacccagatcatgctggagaggcacacaaaccggcaccgtggctttggcttcgtgacgttttcagatcccagggcagttgagactgctatcaacgacatgcacaacaaagagttagatggtcgtaccatttcagtgaacagggctgagccaaagatgcaaacagatgacacacggtacagcagtggtggtggcggtggtgaccgtggggattatcgtggtggtaagggtgatggtccaccccctggcaattgctttgagtgtggccgtgctggtcactgggctcgtgactgccctaaccctggtggcggccgttctgggcgatttccttccaagttcagtggtggcggtggcaggggagaccgcttttctggatcagacaggtttggcgaccgttacgtggatgatcgctatgatggtggccgttatggtgggtaccgtgagcctattgacagcagagacagatatgacgggggccgtgatcgttatgccagtgaccggtacccctctggtggtgaccgctttggtgcagacaggtatggtgcagctccagaccgttatgcaccaagtggtggtggaggtggctatggcagggagcgggagagaagctacgagagagatggaattcgtggtggtggcgcctatgacaggagtggcccaaggggcggtgcaagctatgacagggacggcccaaggggcggcatcggtggtggctatgacagggacggtccacgtggaggcggcgccgactatggcagcggagggcctgctcgctacgagggaggaggttacagggagaggcctgcgccgtatgaccgccccaggggaggaggacgcttcgacgaccgctattagtgacctgttgctgcagtcgagctatgtatttgcgttttaactctttccagtttggcatggccgaatgcttgatgagtactctgtcggcacggttatctcttttctgtactgcaaatgttactccccgtgggcactggtagtttacccagcagactgtttccgtgctgagggtgaatctgtcatgccctggctgctgcctacctttgctgaatgatggtttatgtacttctgcatgatattatcgatctgaacttatgaaatcctgctggtctgctgtggttggtaagaaatcctgctgctctgctatggatgaatctgatggcacggtaatatctattctgtaccagaaatggtaccacaactggagtttgtccagcagactgagcctgctatgacctggttgttttggctgtcggctactgaatgtggtttctgaacttgtgcatgatttcattgatctgaatttatgaaat

SEQ ID NO: 1567 - DNA, 1748 bp, Triticum aestivum
cctcctcctctacccaaaccctaatctcctctcccccccgcgaaccgaggccgcgggcgcgcaggcaggcgcggggcaaatggcgggcaaggaggacagccggatcttcgtgggcggcctctcgttccacaccgacgagcgcaagctcgaggacgccttccgccgcttcggcaaggtcgtcgacacccagatcatgctggagaggcacacaaaccggcaccgtggctttggcttcgtgacgttttcagatcccagggcagttgagactgctatcaatgatatgcacaacaaagagttagatggtcgtaccatttcagtgaacagggctgagccgaagttgcaaacggatgacacacggtacagcagtggtggtggcggtggtgaccgtggggattatcgtggtggtaagggtgatggcccaccccctggcaattgctttgagtgtggccgtgctggtcactgggctcgtgactgccctaaccctggtggcggccgttctgggcgattcccttccaagttcagtggcggcggtggcaggggagaccgcttttctggatcagacaggtttggcgaccgttacgtggatgatcgctacgatggtggccgttatggtgggtaccgtgagcctattgacagcagagacagatatgatgggggccgtgatcgttatgccagtgaccggtacccttctggtggtgaccgctttggtgcagacaggtatggagctgctccggaccgttatgcaccaagtggtggtggaggcggctatggcagggagcgggagagaagctacgagagagatggacttcgtggtggtggcggcgcctatgacaggagtggcccaaggggcggtgcaagctacgacagggacggcccaaggggcggcatcggcggtggctatgacagggacggtccacgtggaggcggcgccgactatggcagcggagggcctgctcgctacgagggaggaggttacagggagaggcctgcgccgtacgaccgccccaggggaggaggacgcttcgacgaccgctactagtgaccgacctgttgctgcagtcgagctatgtacttgcgtttttaattctttccagtttggcatggccgaatgcttgatgagtactctgtcggcacggttatctcttttctgtactgcgaatgttactccttgggcagtggttgagtttacccagcagactgtttgcgtgctgcgttgaatcttccgtgccgtggcagttggctgttgtcacctttgctggatgatggtttatgtactgctgcatgatattatcaatccgaacttatgaaatcctgctgctctgctgtggttgatgtgaattcctgctgctctgcggtggatgaatctgatggctcggtaatctctattctgtaccagaaatggtaccacaactggagtttatccagcagaccgagcctgctatgacctggttgttttggctgttggctactgaatgtggttgctgaacttgtgcaggatttcattgatctgaatttatgaaatccttccggatgacttggagaagagtgaccaaaaaatgttgctttgagacagagcatcatgttttggcgaatgggcttgtcttccatcacgtgttatttacaaatgtagaaaaagttttttgtttttgtttagtccagtgtttctgtaaaattgctgtgaaaaatgtactcgagtgtcgacccttcgtgctatggatgcaaacttactttttgattcaaaaaaaaaa

SEQ ID NO: 1568 - DNA, 1785 bp, Triticum aestivum
ttctttctttctcccctctcgccgtcgtcgcctcctcctcctcctctcacccaaaccctaatctcctctcccccccgcgaaccgaggccgcgggcgcgcaggcaggcgcggggcaaatggcgggcaaggaggacagccggatcttcgtgggcggcctctcgttccacaccgacgagcgcaagctcgaggacgccttccgccgcttcggcaaggtcgtcgacacccagatcatgctggagaggcacacaaaccggcaccgtggctttggcttcgtgacgttttcagatcccagggcagttgagactgctatcaatgatatgcacaacaaagagttagatggtcgtaccatttcagtgaacagggctgagccgaagttgcaaacggatgacacacggtacagcagtggtggtggcggtggtgaccgtggggattatcgtggtggtaagggtgatggcccaccccctggcaattgctttgagtgtggccgtgctggtcactgggctcgtgactgccctaaccctggtggcggccgttctgggcgattcccttccaagttcagtggcggcggtggcaggggagaccgcttttctggatcagacaggtttggcgaccgttacgtggatgatcgctacgatggtggccgttatggtgggtaccgtgagcctattgacagcagagacagatatgatgggggccgtgatcgttatgccagtgaccggtacccttctggtggtgaccgctttggtgcagacaggtatggagctgctccggaccgttatgcaccaagtggtggtggaggcggctatggcagggagcgggagagaagctacgagagagatggacttcgtggtggtggcggcgcctatgacaggagtggcccaaggggcggtgcaagctacgacagggacggcccaaggggcggcatcggcggtggctatgacagggacggtccacgtggaggcggcgccgactatggcagcggagggcctgctcgctacgagggaggaggttacagggagaggcctgcgccgtacgaccgccccaggggaggaggacgcttcgacgaccgctactagtgaccgacctgttgctgcagtcgagctatgtacttgcgtttttaattctttccagtttggcatggccgaatgcttgatgagtactctgtcggcacggttatctcttttctgtactgcgaatgttactccttgggcagtggttgagtttacccagcagactgtttgcgtgctgcgttgaatcttccgtgccgtggcagttggctgttgtcacctttgctggatgatggtttatgtactgctgcatgatattatcaatccgaacttatgaaatcctgctgctctgctgtggttgatgtgaattcctgctgctctgcggtggatgaatctgatggctcggtaatctctattctgtaccagaaatggtaccacaactggagtttatccagcagaccgagcctgctatgacctggttgttttggctgttggctactgaatgtggttgctgaacttgtgcaggatttcattgatctgaatttatgaaatccttccggatgacttggagaagagtgaccaaaaaatgttgctttgagacagagcatcatgttttggcgaatgggcttgtcttccatcacgtgttatttacaaatgtagaaaaagttttttgtttttgtttagtccagtgtttctgtaaaattgctgtgaaaaatgtactcgagtgtcgacccttcgtgctatggatgcaaacttactttttgattcaaaaaaaaaa

SEQ ID NO: 1569 - DNA, 1459 bp, Triticum aestivum
gcctcctcctcctcgcacccaaaccctaatcccctctccccccccgcgaaccgaggccgcgggcgcgcaggcgggcaggcgcggggcaaaatggcgggcaaggaggacagccggatcttcgtgggcggcctctcgttccacaccgacgagcgcaagctcgaggacgccttccgccgcttcggcaaggtcgtcgacacccagatcatgctggagaggcacacaaaccggcaccgtggctttggcttcgtgacgttttcagatcccagggcagttgagactgctatcaacgatatgcacaacaaagagttagatggtcgtaccatttcagtgaacagggctgagccaaagatgcaaacagatgacactcggtacagcagtggtggtggtggtgaccgtggggattatcgtggtggcaagggtgatggtccaccccctggcaattgctttgagtgtggccgtgctggtcactgggctcgtgactgccctaaccctggcggcggccgttctgggcgattcccttccaagttcagtggtggcggtggcaggggagatcgcttttctggatcagacaggtttggcgaccgttacgtggatgatcgctatgatggtggccgttatggtgggtaccgtgagcctattgacagcagagacagatatgatgggggccgtgatcgttatgccagtgaccggtacccctctggtggtgaccgctttggtgcagacaggtatggagcagccccagaccgttatgcaccaagtggtggtggaggcggctatggcagggagcgagagagaagctacgagagagatggaattcgtggtggtggtgcctatgacaggagtggcccaaggggcggtgcaagctatgacagggacggcccaaggggcggcataggtggtggctatgacagggatggtccacgtggaggcggcgccgactatggcagcggtgggcctagtcgctacgagggaggaggttacagggagaggcctgcaccgtatgaccgccccaggggaggagggcgcttcgacgaccgctactagtgacctgttgctgcagtcgagctatgtatttgcgttttaactttcagtttggcatggccgaatgcttgatgagtactctgtcggcacggttatctcttttctgtactgcaaatgttactcccggtgggcactggtagtttacccagcagactgtttccgtgctgagttgaatctgtcatgccctggctgctggctacctttgctgaatgatggtttatgtacttctgcatgatattaatcaatctgaacttatgaaatcctgctgctctgctgtggttggtatgagatcctgctgctctgctgtggatgaatcttatggcacggtaatatctattctgtaccagaaatggtaccacaactggagtttatccagcagactgagcctgctatgacctggttgttttggctgtcggct

SEQ ID NO: 1570 - DNA, 1510 bp, Triticum aestivum
cctcctcctcgcacccaaaccctaatcccctctccccccccgcgaaccgaggccgcgggcgcgcaggcgggcaggcgcggggcaaaatggcgggcaaggaggacagccggatcttcgtgggcggcctctcgttccacaccgacgagcgcaagctcgaggacgccttccgccgcttcggcaaggtcgtcgacacccagatcatgctggagaggcacacaaaccggcaccgtggctttggcttcgtgacgttttcagatcccagggcagttgagactgctatcaacgatatgcacaacaaagagttagatggtcgtaccatttcagtgaacagggctgagccaaagatgcaaacagatgacactcggtacagcagtggtggtggtggtgaccgtggggattatcgtggtggcaagggtgatggtccaccccctggcaattgctttgagtgtggccgtgctggtcactgggctcgtgactgccctaaccctggcggcggccgttctgggcgattcccttccaagttcagtggtggcggtggcaggggagatcgcttttctggatcagacaggtttggcgaccgttacgtggatgatcgctatgatggtggccgttatggtgggtaccgtgagcctattgacagcagagacagatatgatgggggccgtgatcgttatgccagtgaccggtacccctctggtggtgaccgctttggtgcagacaggtatggagcagccccagaccgttatgcaccaagtggtggtggaggcggctatggcagggagcgagagagaagctacgagagagatggaattcgtggtggtggtgcctatgacaggagtggcccaaggggcggtgcaagctatgacagggacggcccaaggggcggcataggtggtggctatgacagggatggtccacgtggaggcggcgccgactatggcagcggtgggcctagtcgctacgagggaggaggttacagggagaggcctgcaccgtatgaccgccccaggggaggaggacgcttcgacgaccgctactagtgacctgttgctgcagtcgagctatgtatttgcgttttaactttcagtttggcatggccgaatgcttgatgagtactctgtcggcacggttatctcttttctgtactgcaaatgttactcccggtgggcactggtagtttacccagcagactgtttccgtgctgagggtgaatctgtcatgccctggctgctgcctacctttgctgaatgatggtttatgtacttctgcatgatattatcgatctgaacttatgaaatcctgctggtctgctgtggttggtaagaaatcctgctgctctgctatggatgaatctgatggcacggtaatatctattctgtaccagaaatggtaccacaactggagtttgtccagcagactgagcctgctatgacctggttgttttggctgtcggctactgaatgtggtttctgaacttgtgcatgatttcattgatctgaatttatgaaat

SEQ ID NO: 1571 - DNA, 1275 bp, Brachypodium distachyon
ggacggaagccaaaccctagcgctcgcttcttctttctttctcccctcgttcttgccgcttccgattccgtcgtaacctcttcgtcgccgttgtcgtctcctcctcttctcaccaaaaccctaatctcagccgaggtcggaggtaccggcaatggcagggaaggaggagagccggatcttcgtgggcggtctgtcgttccacaccgacgaacgcaagctcgaggaggccttccgccgcttcggcaaggtggtcgacgcgcagatcatgctggagaggcacacaaaccgccaccgtgggtttggctttgtgacgttctcagatccacgggcagtcgagagtgctattagtgagatgcacaccaaagagttagatggacggaccatttcagtgaacagggcggagcctaagatgaatacagatgacacaaggtacagcagtggcggcgaccgtggtgctgaccgtggggattatcgtggtggtaagggtgatggcccaccccctggcaattgctatcagtgtggtcgtgctggtcattgggctcgtgactgccctaatcctgctggaggtcgttctgggcaattatcttccaagttcagtggcggtggtggcaggggagaccgtttttctggatcagataggtttagtgaccgttacatggatgatcgttatgatggtggccgttatggataccgtgaccctattgataacagagataggtatgatgggggccgtgatcgttatgccagtgaccgttacccatctggtggtgatcgctttggtgcagacaggtatggaggtccagaccgttatcagccaagtggttatggtagggagcgagagagaagctacgagagagatgcagtgcgtggcggtgctgcttttgacaggagtggcccaagaggtggtgcaagttatgacagggatggcccaaggggcggcattggtggtggctatgacagggatggtccacgtggaggcggtgctgacaactatgttagtggaggacctgctcgctatgatggaggaagttacagggacagacctgggccatatgaccgtcccagcaggggaggacgctatgaggatcgcttctaacgatcttttacagtcaagttatgtatttgtgttttagtgttttcagtttggcatggcgtgaatgcttaatgactggcacagttattatctattatgtattacaactggcacttgaactggtgtaacacccactggctaaatttttccagcatacacttttcatgatgagtttaattgtc

SEQ ID NO: 1572 - DNA, 1406 bp, Hordeum vulgare
ctaacagcaagcaaccatggcttcttacgaccaacaattcaagattctcgaggtacctccaatcgtgcaagagcttgtgggcgccggcgtgaaggagccaccgagccagtacgtgcttcccgagcaataccgtcccgctgcggcggcggtctccgagatgcccgagcccatccccatcatcgacctcagccggctctctgccggcagcgccgaggagttcgacaagctgcggtccgcgttggagaactggaacctcttcctggctgttggacatggaatggagcctagctttcttgccgaggcgatgaaggccaccagagagttcttcaacctctcaatagaagagaaacaaaagtactcaaacattgtcggcggcgagaagatgggcatggatggatatggtaacgacatggtcgtaaaagagaatcaggtccttgactggaacgaccggctcaatctcctagtggaacccgagtccctaagaacctacagactctggccaacacaacccccttctttcagagacgtcctgtgtgagtacacggtcaggtgcaaagcggcgaccaacattgtccttcgaaacatggccaagatgctcaatttacaagaggaacacctcgtaaacatgatcggcgacaactccatcacccaagctatattcaactactaccctcagtgtccaaggcctgaccacgtcttgggacttaaggcccatacagatggctcgataatcacagtcaacttcgccgatgccgaggggctccagcttgagagaaacggcgtgtggtacaacgtgcccattgttccaaatgcattggttatgaacataggagatataatggagattttgagcaatgggtttttcaagagcctggtgcatagggttgtcaccaacgcggagaaagagcgcttgtcgttggtgctggtctatacgttggagctagagacacaacttgagccggtgtcagagctggtggatgacaagagacctgcccgatacatgaagatcaagctcaacgactacatggaaaaataccatgacacttatgccactgggacactagccatagacggcgtgaagatctgaatatgattccgatgtatgcaagctcgctgagtaagatctatggtgaagtatcttccgttgaccagtttgtaacgagtttacgtttttacctatttcccagatttttgtgtgtgtactcctcatgtaaaatgttgggcagcttgtgtggtcgcattaaaccctaatataaaacttatccgatgtgggcaacatacggatgtaaaggatggaataaaacttatcgattgtgtgcaacatggggatgcaaggatagtttttcctgttggtatgtatcattgataagtaccattgtgcctccttttcaagaaattaagagacc

SEQ ID NO: 1573 - DNA, 1409 bp, Hordeum vulgare
ctaacagcaagcaaccatggcttcttacgaccaacaattcaagattctcgaggtacctccaatcgtgcaagagcttgtgggcgccggcgtgaaggagccaccgagccagtacgtgcttcccgagcaataccgtcccgctgcggcggcggtctccgagatgcccgagcccatccccatcatcgacctcagccggctctctgccggcagcgccgaggagttcgacaagctgcggtccgcgttggagaactggaacctcttcctggctgttggacatggaatggagcctagctttcttgccgaggcgatgaaggccaccagagagttcttcaacctctcaatagaagagaaacaaaagtactcaaacattgtcggcggcgagaagatgggcatggatggatatggtaacgacatggtcgtaaaagagaatcaggtccttgactggaacgaccggctcaatctcctagtggaacccgagtccctaagaacctacagactctggccaacacaacccccttctttcagagacgtcctgtgtgagtacacggtcaggtgcaaagcggcgaccaacattgtccttcgaaacatggccaagatgctcaatttacaagaggaacacctcgtaaacatgatcggcgacaactccatcacccaagctatattcaactactaccctcagtgtccaaggcctgaccacgtcttgggacttaaggcccatacagatggctcgataatcacagtcaacttcgccgatgccgaggggctccagcttgagagaaacggcgtgtggtacaacgtgcccattgttccaaatgcattggttatgaacataggagatataatggagattttgagcaatgggtttttcaagagcctggtgcatagggttgtcaccaacgcggagaaagagcgcttgtcgttggtgctggtctatacgttggagctagagacacaacttgagccggtgtcagagctggtggatgacaagagacctgcccgatacatgaagatcaagctcaacgactacatggaaaaataccatgacacttatgccactgggacactagccatagacggcgtgaagatctgaatatgattccgatgtatgcaagctcgctgagtaagatctatggtgaagtatcttccgttgaccagtttgtaacgagtttacgtttttacctatttcccagatttttgtgtgtgtactcctcatgtaaaatgttgggcagcttgtgtggtcgcattaaaccctaatataaaacttatccgatgtgggcaacatacggatgtaaaggatggaataaaacttatcgattgtgtgcaacatggggatgcaaggatagtttttcctgttggtatgtatcattgataagtaccattgtgcctccttttcaagaaattaagagaccgtt

SEQ ID NO: 1574 - DNA, 1398 bp, Triticum aestivum
ccacgcgtccgcccacgcgtccggcaagcaaccatggcttcttatgacaaacaattcaaggttctcgaggtacctccgatcgtgcaagagctggtgggcgccggcgtgcaggagccaccgagccagtacgtgcttcctgagcaagaccgtcccgccgcggcggtctccgagatgcccgagcccatccccatcatcgacctcagccggctgtctgccggcagcgccgaagagttcgacaagctgcggtccgccttggagaactgggacctcttcctggctgttggacatggaatggagcctagctttcttgccgaggcgatgaaggccacgagagagttcttcaacctcccactggaagagaaacagaagtactcaaacattgtcgacggcgagaagctgggcatggatggatacggtaacgacatggtcgtgaaagagaatcaggtccttgactggaacgaccggctcaatctcctagtggaacccgaggccctaagaacctacagactgtggccaacacaacccccttctttcagagacatcctgtctgagtacacggtcaggtgcaaagcggcggctaaccttgtctttcgaaacatggccaagatactcaatttacaagaggaacacctggtaaacatgatcggggagaactccatcacccaagctatattcaactattaccctcagtgtccaaggccggaccacgtcttgggcctcaaggcccataccgatggctccataatcacagtcaacttcgccgatgctgaggggctccagcttcagagaaacggcgtctggtacaacgtgcccatcgttccaaatgcattgattatgaacgtaggggatataatggagattttgagcaatgggttcttcaagagcctggtgcatagggttgtgaccaacgcggagaaagagcgcttgtcgttggtgctggtctatacattggagctagagacagagcttgagccggtgtcagacctggtggatgacaagagacctgcacgatacatgaagatcaagctccacgactacatggaaaaatatcatgacacttatgccacagggacactagccatcgacggcgtgaagatctgaatatgattctgatgtgtacaagtccgctaatgaagaactatgcatggtgaagtatcttccgtcgaccagtttgtaacgagtttatatttttcatgtacccttttccccaatttttgtgtgtgtactccttcatgtaaaatgttcggcagcttgtgtggctgcatgaaacattaaaataaaatgtatctgctgtgtgcaacatgcagatgcaaaggatggaataaaacttatcggtcgtgtgcaaaaaaaaaaaaaaaaaacacctcggccgcgaccacgctaatcactagtgaattc

SEQ ID NO: 1575 - DNA, 1375 bp, Triticum aestivum
aagcaaccatggcttcttatgacaaacaattcaaggttctcgaggtacctccgatcgtgcaagagctggtgggcgccggcgtgcaggagccaccgagccagtacgtgcttcctgagcaagaccgtcccgccgcggcggtctccgagatgcccgagcccatccccatcatcgacctcagccggctgtctgccggcagcgccgaagagttcgacaagctgcggtccgccttggagaactgggacctcttcctggctgttggacatggaatggagcctagctttcttgccgaggcgatgaaggccacgagagagttcttcaacctcccactggaagagaaacagaagtactcaaacattgtcgacggcgagaagctgggcatggatggatacggtaacgacatggtcgtgaaagagaatcaggtccttgactggaacgaccggctcaatctcctagtggaacccgaggccctaagaacctacagactgtggccaacacaacccccttctttcagagacatcctgtctgagtacacggtcaggtgcaaagcggcggctaaccttgtctttcgaaacatggccaagatactcaatttacaagaggaacacctggtaaacatgatcggggagaactccatcacccaagctatattcaactattaccctcagtgtccaaggccggaccacgtcttgggcctcaaggcccataccgatggctccataatcacagtcaacttcgccgatgctgaggggctccagcttcagagaaacggcgtctggtacaacgtgcccatcgttccaaatgcattgattatgaacgtaggggatataatggagattttgagcaatgggttcttcaagagcctggtgcatagggttgtgaccaacgcggagaaagagcgcttgtcgttggtgctggtctatacattggagctagagacagagcttgagccggtgtcagacctggtggatgacaagagacctgcacgatacatgaagatcaagctccacgactacatggaaaaatatcatgacacttatgccacagggacactagccatcgacggcgtgaagatctgaatatgattctgatgtgtacaagtccgctaatgaagaactatgcatggtgaagtatcttccgtcgaccagtttgtaacgagtttatatttttcatgtacccttttccccaatttttgtgtgtgtactccttcatgtaaaatgttcggcagcttgtgtggctgcatgaaacattaaaataaaatgtatctgctgtgtgcaacatgcagatgcaaaggatggaataaaacttatcggtcgtgtgcaacatgcggatgcaaaggatggaaggattgtttcttgctcgtatatatcacctaaaa

SEQ ID NO: 1576 - DNA, 2114 bp, Triticum aestivum
gatgaagccacaaatcgagcaactcagacacaaatcaccctgcctttccagcctcttgcactatctttcaaccatgtaaactattacgtggacatgcctgcagaaatgagagagcaaggattcgccgaaagtcgtctccagttgctctctgatatcagtggtgcttttaggccaggtgttctgacagcattagttggtgtgagtggagctgggaaaaccactctaatggatgtcctcgcaggaaggaaaaccagtgggtcgattgaaggaagcatcaccctctctggttaccctaaaaagcaagaaacttttgcccgcatcagtggctactgcgaacagaccgatatccattcaccaaatgttactgtatatgaatccattctctactctgcctggctgcgtctttcctcagatgttgacgaaaaaacgagaaagttgtttgtggaggaagtcatgactcttgtggagcttgatgtgttgcgtaatgctatggttggcctccctggagtggacgggttatcgaccgaacaaagaaagagactgacaattgccgtggagctggtagcaaatccttcaatcatattcatggatgagccaacttctggacttgatgctagagccgcagcaattgtaatgcgggcagtgagaaatacagtcaacactgggcgaactgtggtttgcactatccatcaacccagcattgatatattcgagtcttttgacgagcttctgcttatgaaaagaggaggacaagttatttatgctggtgaacttggtcgccactcttataaactagttgaatattttgaggcaattccaggtgttgaaaagatcacacaaggatataatcccgcaacatggatgctggaagttagctcccctttagccgaggctcgcctgaacgtaaactttgctgaaatttatgctaattctgaactttatagggaaaaccaacaacttattaaggaattaagcgttcctccgccaggctacgaggatctctcattccctaccaagtattctcagaatttctacaaccaatgcattgcaaacttctggaagcaatacaaatcatattggaagaatccgccccacaacgccatgcgctttctcatgaccatgattaatggccttgtatttggcacggtgttttggcagaaagggacgaaaataggctcgcaacaagatctcttcaatctacttggagccacttatgctgctgtcttcttccttggagccgccaactgcatcacggttcagcctgttgtgtcaatcgagcgaacagttttctaccgtgaaaaggcggcagggatgtactctccgttatcctatgcattcgctcagacatgcgtggaggtgatgtacaacatcgtgcaggggattgaatacacggcgatcatctatgcgatgattggatatgagtggaaagcggcaaagttcttctatttcctcttcttcatagtttcaagcttcaactacttcacattgtttggcatgatgctggtgtcactgactccctcttccatgctcgcaaacatactgatatcctttgtactccctctctggaacctgtttgctgggttcctcgtcgtcagaccgttgataccgatctggtggaggtggtactactgggccaaccctgtgtcgtggaccatctacggcgtggtggcgtcgcagtttggcgacaacaagagtcctctcaaggtccccggcgggagcgacacgtttgtgaaggagttcttggaggacaatctgggcatcaagcacgatttccttgggtatgtggtgctggcgcactttgtgttcatcatcgccttcttctttgtgtttggctactccatcaaggtgttgaacttccagaaacgttaggccttcttctttgttttaatttatatatatagtgtttgtgtgtatatgaatgaatgtaatgtatagtagaaagagtagagttgacaagggaaattgttgcatagataggccgacctggtacgtataaattagaggaatgagacaagaggtggtggtgacatgatgcctatttcttgttttaccattgacattgatatattaaatacgaaaagttcatttttggtgcaaaaaaaaaaaaaaaacga

SEQ ID NO: 1577 - DNA, 4903 bp, Triticum aestivum
ttcgggagcagtgctattctctgcatcacatgcacatgtgctgactagtcgtagccgtcgttggaagtttctgtcatttcatgtggaaacatccagatgcagccttacatgcacgcatgacctcccttcccttcccttccctatatatgctttgctttgcttcctactgctagaaaattaaaggtcacggacagacagacaggcacagaaagagagagactgtctgcatcgccacagacaggcacagaaagagagagactgtctgcatcgccatggagctggcctcgggcaggggcagccgccgcagtgccagcgcggcctcctggggctcccgccgctccttctccatccacagccaggcggcggaccccttcggccgcgccgcctcgcagcagggccaccacgatgacgaggagaacctgcgctgggccgcgctcgagaagctgcccacctacgaccgcatgcgccgcgccgtcgtccatggcggtgccgccgtcgacggccacgagaatacggagatggagggcttggtggacatcaaccgcctggccagcggcgaggccggcagggcgctgctggagcgcgtcttccaggacgacagcgagcgcttccttaggagactgagggaccgcgtggaccgggtgggcatcgacctgccggcgatcgaggtccgctaccaggggctctccgtccaggtggacgccttcgtcggcagccgggcgctgcccacgctctggaactcggccacaaacttcctccagggtcttgtcggccgccttgcttcctccaacaagaagaccatccacatactccaaaatgtcaatggcatcatcaaaccatcaaggatgacccttcttctcggacctccatcctcaggaaagagcacacttatgcgtgccctcactggcaagcttgacaaaagcctcaaggtatctggcaacatcacttactgtggtcatacatttgaggagttctaccctgagaggaccagtgtgtatgttagccagtacgatctccacaatgcagagatgaccgtaagagagacgctcgatttctccaggcgctgcttaggcgtcggtgccagatatgacatgctctctgagctcgctgccagggagcgcgaagctggcataaagccagatcccgagatcgatgcttatatgaaagctactgccgtgcaaggacaggagagtaatattgttaccgatcttactctcaaggtgcttgggcttgatatttgtgccgatatgcccattggtgacgacatgatcagaggaatttcaggcggccaaaagaagcgagtaacaactggggagatgttaacaggacctgcaagagctttgttcatggatgaaatttccactggtttggacagctctagcacatttcagattgtgaaatacatagggcaattggtccatgtgatgaatgagaccgtgatgatctccctcctgcaaccaccgccagagacctacaacctgtttgatgacattattctgctatcagaagggtacatagtgtaccatgggccacgcgacaacatcttggaattcttcgaagctgctggttttaggtgccctgaaaggaaaggagttgctgacttccttcaagaggtcacttccaagaaagaccagcaacagtactggtaccttgaccaggagcagtatcgtcacgtgtctgtcccagagtttgccgaacgattcaagtcattccacgtaggccagcagatgctcaaggagctgcaaattcctttcgacaagtcccaaactcatcctgctgcgctgaccaccagtaagtatgggcaatccagctgggagtcattcaagacagtgatgtcgagagagctgttgttgatgaagcgcaactccttcatctacatcttcaaggttacccagttgctcatccttgggctcgtggccatgactgtgttcttcagaacaaagatgccatatgggcagatttctgacagcgccaaattctttggtgctctgactttcagtttaatcaccgtcttgttcaatgggtttgctgagctacagtttactattaaaatgcttcctacgttctacaaacagagagatttcttgttctttcctccatggacctttggactggtaaacatcatctcgaaagttcccgtttcgcttgtggagtcctcggtatgggtcatactcacgtactacgtaatgggctttgcacctgctgcaggaaggttctttcgtcagcttttagctttcttccttactcaccaaatggcaatgggtttattccgatttcttggtgctgttttgaaatcaatggttgtggccaataccttggggatgtttgtgatccttattatttttatatttggagggtttgtcatacctagaggtgacatccaaccatggtggatctgggcttactggtcatctcctatgatgtacagtcagaacgcgatatcagtcaatgaattcctttccagtaggtgggccaacccaaacaatgatacatctatcgctgcacgaacagtaggcgaggctattcttaaatccagaggattgtttactggagactcgggattttgggtttccatcggagccattgtaggattcgctattctgttcaacatattgtaccttctggcacttacgtatttgagctttggcagcagctcaaatacagtttcagacgaggagaatgagaatgagacaaacacttcaatgcctatagatgaagccacaaatcggccaactcggtcacaaatcaccttgcctttccagcctctttcactttctttcaaccatgttaactattacgtggacatgcctgcagaaatgagagaacaaggattcgccgaaagtcgtctccagttgctctccgatatcagtggtgcttttaggccaggtgttctgacagcattagttggtgtgagtggagctgggaaaaccactctaatggatgtcctggcaggaaggaaaactagtgggtctattgaaggaagtatcaccctctctggttaccctaaaaaacaagaaacttttgcccgcatcagtggctattgtgaacagactgatatccattcaccaaatgttactgtctatgaatccatactctactctgcctggctgcgtctttcctcagatgttgacgaaaaaacgagaaagatatttgtggaggaagtcatgactcttgtagagcttgatgtgttgcgtaatgctatggttggtcttcctggagtggacgggttatccactgaacaaagaaagagactgacaattgccgtggagctggtagcaaatccttcaatcatattcatggatgagccaacttctggtcttgatgctagagccgcggcgattgtaatgcgggcggtgagaaatacagttaacactgggcgaactgtggtttgcacaattcatcaacccagcatcgatatattcgagtcttttgatgagcttctgcttatgaaaagaggcggacgggttatttatgctggtgaacttggtcgccactctcataaaatagttgaatattttgaggcaattccaggtgttgaaaagatcacagaaggatataatcctgcaacatggatgctggaagttagctccccttcagccgaggctcgcctgaacataaattttgctgacatttatgctaattctgacctttataggaaaaaccaagaacttattaaggaattaagcgttcccccgccaggttacgaggatctctcatttcctacaaagtattctcagaatttctacaaccaatgtgttgcaaacttctggaagcaatacaaatcttattggaagaatccagctcacaacgccatgcgcttccttatgacgttgatctatgcccttgtatttggcacggttttttggcagaaggggacaaaaataaactcgcaacaagatttagccaatctacttggagccacttatgctgcggtctttttccttgggtctgccaactgtatcacagttcagcctgttgtggcaattgagcgaacagttttctaccgtgaaaaggcggcagggatgtactctccattagcctatgcattcactcagacatgcgtggaggtgatgtacaacatcgtgcaggggattgaatacacgttgatcatctattcgatgattggatatgaatggaaagctgcaaagttcttctatttcctcttcttcataatttcctgcttcaactacttcacattgtttggcatgatgctggtggcgttgagctcatctgccatgctcgcaaacataatcatagcctttgtactccccctgtggaaccttttttctggattcctcgttatgagaccgttaataccaatttggtggaggtggtactactgggcaaaccccgtgtcctggaccatatatggcgtcatcgggtcgcagtttggcgataacaccagcccagtgtcggtcaccggtgggagcctcgtggtggtgaagcaattcttggaggacggtatgggcattaagcacgatttccttgggtatgtcgtgctcgcgcatttcgcgtacgtcatcggcttcttcttggtgtttgcttactccatcaaggtgttgaacttccagaaacgttaggaatgcaggcgtcccaatccatagtttgtgtgtatatctgtatagtaggatacatacgtaggcattgttgcataaactctgctatttagagtttgtagtgatatgccggccctattttttaacgttcatttttggtctgtcggttgttgtcaaagtgtaatttggttcattttttgtctaataaatatactgtgacccttgtgtagaaacttttcatctcactggaagcggatttatcattggtctctgttaattccttcacgggattgagagatttattcatgtgggtcaattcaattcaatcacatgatttgatttgattg

SEQ ID NO: 1578 - DNA, 4577 bp, Brachypodium distachyon
atggagacggcggcggtggtgagcgctagcgctagccggcggcggagcacgagctgggggtcatccatgacgcactcgttccggcagcaggcggacacggaggacccgttcgggcgcgcccagtcgcagcagggccacgacgacgacgaggagaaccttcgctgggcggcgctcgagaagctgcccacctacgaccgcatgcgccgcgccatcatccaccaagacgacgacgatgccggcggtaatcagctgcttgacatcgagaaggtggccggcggcgaggccggccgtgccctcctggagcgcgtcttccaggacgacagcgagcgcttcttgcgccgcctcagggatcgcgtcgacagggtcggcatcgacctccccgccatcgaggtccgctacgccgacctcaccgtcgacgctgatgtctttgtcggcagccgtgcgctccccacgctatggaactccaccacaaacttcctccagggtcttattggacgatttggtacctcaaacaagaggaccattaacatactccagcacgtccatggcatcctcaaaccatccaggatgacccttcttctcggacctccatcttcaggaaagagcacacttatgagagcccttaccgggaagcttgacaaaagcctcaaggtatctggcaacatcacatactgtggtcatacattttcggagttctacccagagaggaccagtgcgtatgttagtcagtacgatctccataacgcagagatgactgtaagagagacattggatttctccaggcgatgcttaggcatcggtgccagatatgacatgcttgcagagctcgctaaaagggagcgcgatgccggcataaagccagatcctgagatcgatgctttcatgaaagctactgcagtgcaaggacaagagactaatattataacagatcttactctcaaggtgcttgggcttgatatttgtgccgatatcatcattggtgatgagatgatcagaggagtttctggtggccaaaagaagcgtgtcacaactggggagatgctaacaggacctgcaagggctttattcatggatgaaatttccactggtttggatagctctagcacattccagattgtaaaatacgtgaggcaattggtccatgtgatgaatgagactgtgatgatctcccttctccagccaccacccgagacctacaacctgtttgatgacataattctgctatcagaaggatacattgtgtaccatgggccacgtgagaacatcttggaattcttcgagtctgctggtttccggtgccctgaaaggaaaggagttgctgacttccttcaagaggtctcttccaagaaagaccagcgacagtattggtaccttgaacaggagcagtatcggtacgtgtcagtgctggagtttgctgaacgtttcaagtcattccatgtaggccagcagatgctcaaggagcttcaaattcctttcgaaaaatcgaaaacccatcctgccgcgttgaccaccagcaagtatgggcaatccagctgggagtcactcaaggctgtgatgttgagagagcagctgttgatgaagcgcaactccttcatctacatcttcaaggtcacccagttgatcatccttgcgctcatggccatgactgtatttctcagaacagagatgcccgttggcaagatttctgatggcaccaaattctttggagctctggctttcagtttaatcaccatcttgttcaatggttttgctgagctacaactcaccataaagaagcttcccgtgttcttcaaacatagggatttcttgttctttccaccatggacatttggactggcaaacatcatcttaaaagttcctgtttcgcttgtggagtctgcagtatgggtcgtccttacgtactatgtgatgggctttgcacccgctgcaggaaggttctttcgccagcttctagctttcttcgctactcaccaaatggcgatggctttgttccgatttcttggtgctattttgaaaacaatggttgtggccaatacttttgggatgttcgtgctccttattattttcatctttggtggatttatcatccctagaggtgacatcagaccatggtggatctggggttactgggcatctcctatgatgtacagtcagaatgccatatcggtcaatgaattcctcgccagtaggtgggccattccaaacaatgacacaactattgatgcaccaacagtaggcaaggctattctcaaatctaaaggcttgtttactgaagagtggggcttttgggtttccaccggagccattgtaggattcactattttgttcaacatcctgtatcttttggcccttacatacttgagctataccaatggagcagcaaataggccaactcagtcaggaattgtcttgcctttccagcctctttcactatctttcaaccatataaactattacgtggatatgcctgcagaaatgaaggagcaaggattctcagaaagtcgtctccagttgctctctgatatcagtggtgcttttaggcctggtgtcctgacagcattagttggcgtgagtggagctgggaagaccactctaatggatgtccttgcagggaggaaaactactggagctattgaaggaagtatcgaactctccggttaccccaaacaacaagaaacttttgcccgcattagcggctattgtgaacaaactgatatacactcaccaaatgttactgtatatgaatccattctctactctgcctggctgcgtctttcctcagatgttgatgacagtacgagaaagatgtttgtggaggaagtcatggcccttgtagagcttgatgtgctgcgtaatgctctggttggtctccctggagttgacgggttatcgactgaacaaagaaagagactaacaattgccgtggagctggtagcaaatccttcaatcatattcatggatgagccaacttctgggcttgatgctagagctgcagcaattgtcatgcgcacggtgagaaacacagtcaatactgggcgtacagtggtttgcacaatccatcaacccagcatcgatatattcgagtcttttgatgagcttctgcttttgaaaagaggagggcatgtcatctatgctggtgaacttggtcgccattctcataagctagttgaatattttgaggcaattccaggggttccaaagattacggaaggatataatcctgcaacatggatgctcgaagttagctcccctctggctgaggctcgcctggacataaattttgctgaaatttatgctaattctgtgctttacacgaaaaaccaagaacttatcaaggagttgagtgttccacctccaggctatcaggatctctcatttcctacaaagtattctcagaacttctacaaccaatgtgtcgcaaacttttggaagcaatacaaatcttattggaagaatccaccctacaatgccatgcgctatctcatgacgttgctcaatggcattgtatttggcacggtgttttggcagaagggaaaaaacttagactcgcaacaagatttgttcaacctacttggagccacttatgctgctatcttcttccttggggctgcgaattgcatcacagttcagcctgttgtggcaattgaacgaacagttttctaccgtgaaaaggcagcggggatgtactctccattatcctatgcattagctcagacgggtgtggaggtcatatacaacatcttgcaggggatcctatacacactgctcatatatgtgatgattggatatgagtggagagctgacaagttcttctatttcctgttcttcattgttgcaagcttcaactacttcacattgtttggcatgatgctggtgtcgttgaccccgtctgcgttgattgcaaacatactcatatcctttgcgctcccactttggaacctgtttgctggattcctggttgtcagaacggcaataccaatttggtggagatggtactactgggcaaacccagtgtcatggacaatctatggagtcgttgcgtcgcagtttggggagaacggtggttctcttacggtccctggtggcaaccctgtggtggtgaagcaatttttggaggacaatctgggcatccgccatgatttccttggctacgttgtgctagcccactttgcctacatcattgccttcttcttcgtcttcggctattccatcaagttcttcaacttccaaaaacgttaataaggcactagcaattattttcatctttctttctttttttctttcctgcaatcggaagcaatctaccactctctctctctctctctctctctctctgggtgtatatatattatcatgttgtaaagtagccagccagtaggattaagaaatgctccattggggtttttcttttgaggtacatttttagttttactagcagaaaattttattctacttgattattaattgtcttcatgcttccattaggggcattcctcttttgtgttttgaggcgcatgttatcttactagataagctgtattatatacgttaaatatatgattagtgtgttttctgac

SEQ ID NO: 1579 - DNA, 4669 bp, Zea mays
atcgtgcgtcgatagacgatgatgccggagtcgcatccgcatccccacgcgggggcggtgctggcgtcgacgtctagccgtcggagcctcagcttggggtcctccatctcgcagtcgttccggcagatggacacggaggaccccttcgcgcggtcgcagtcggagcatgagcaccgcgacgacgaggagaacctgcgctgggccgcgctcgagaagctgcccacctacgaccgcatgcgccagggtatcctacgccgggcgctcgaccaacaacaagagagcggcggcggcggcgtcgagatcgtcgacatccacaagctggccgccggcgacgggggccgtgcgctcctggagcgcctcttccaggacgacagcgagcgattcctgcgccggctcagggaccgaatcgacatggttggcatcgagctccccacagtggaagttcggtacgagcagttgacggtggaggctgacgtgattaccgccgggagggccctcccgacgctgtggaacgccgccaccaattttcttcagggtctcattggacgcttcggttcttcaaacaagaggaacatcaccatacttaagaatgtcaatggtatcctgaagccatccaggatgacgcttcttcttgggcctccatcctcagggaagagcacactaatgcgagcactcgctggcaaacttgacaaaaatctcaaggtctctggcagcattacgtattgtggccatccaatttcagaattctatcctgagaggactagcgcgtatgttggtcaatatgatctccacaatgccgagatgactgtaagggagacacttgatttctctaggcggtgcctaggcattggtgccagatatgagatgattacagaacttgctagaagggagcgggatgccggcattaagccagatcctgagattgatgctttcatgaaagctactgcagtacaaggacaggagactaatattataacagatctcactctcaaggtgcttgggctggacatttgtgctgatgttattattggtgatgagatgatcagaggaatttctggcgggcaaaagaaacgtgtgacaactggggagatgctaacagggccagcaacggctttatttatggacgaaatatccactggtttggatagctcgagcacatttcagattgtaaagtttatgaggcatttggtccatgtaatgaatgaaactgtcatgatctctctgctccagccaccgccagagacctacaatctttttgatgacataatcctgctatcagaaggatacatagtgtaccatgggccacgcgagaatatcctggaattctttgagtctgtcggtttccggtgccctgacaggaaaggtgtcgcagactttcttcaagaggttacttccaagaaagaccagcaacaatattggtatcttgatcaggagcaatatcattatgtatctgtacccgactttgcagaacgtttcaaatcattccatgcatgccaacagatgcagaaggagttgcaaataccttttgaaaagtccaaaacccatcctgctgcgttgaccaccaaaaaatatgggctttctagctgggaatcactcaaggcagtgatgtcaagggagcagctattgatgaagcgcaactctttcatctatattttcaaggtcacagtgttgatcatccttgcattcgtgtccatgactgtgtttctcagaacaaagatgccccatgggcaaattgctgatggcaccaaattctttggggccctgacttttggtttaataacgatcatgttcaatgggttcgctgagctacaattgaccataaagaagctaccagttttctacaaacatagggatttcttattcttccctgcatggacctttggagtggcaaacatactcttaaaagttcctatctcgctcgtggaatcagtagtatgggttgttctcacatactatgtgatgggctttgcacctgctgcaggaaggttctttcgtcagtttatagctttctttgccacacaccaaatggcaatggctttatttcggtttcttggtgctgttttgaaaacaatggttgtggccaatacttttgggatgtttgtgctgctcattattttcatttttggaggatttgtcatccgtagaaatgacattaaaccttggtggatctggggttattgggcatcacctatgatgtatagccaaaatgcaatatctatcaacgaattccttgctagtaggtgggctattccaaacaatgacacgactattgatgcaccaacagtaggcaaagcaattcttaaatccaaaggcttgtttactgaagaatggggattttggctttccattggagcccttataggattcattattttgttcaacagtctctacctttgggcccttacatatttaagtcctagtagtggctccaatgccctagtttcagaaggtgaagatgatgtaaatgaaatagcattgaaagaaagaagcagagatgcaagaagcgaagatgaaatatcccaagttgtatacggggatctaggtgcaaacacatgcactaatggagcaacaaacacactagttcagtcacgagtcactttgcctttccagcctctttcactttgctttaaccatgtaaactattacgtcgacatgcctgcggaaatgaaggaacaaggattcacagaaagccgtttacaactgctctctgatatcagtggtgcttttaggccaggggttctaacagcattagttggtgtgagtggagctggaaagaccactttaatggatgtcctggcaggaaggaaaactagtggagccattgaaggagatattaccctgtccggataccccaaaaaacaagaaacttttgcccggattagtggttattgtgaacaaaccgatatccattctccgaatgttactgtatttgaatccatcacgtactctgcatggttgcgtctttcctcggatattgatgatggtacgaaaaagatgtttgtggaggaagtgatggcccttgtagagcttgatgtgttgtgcgacgctcttgtgggtctccctggagttagtgggttatcaactgagcaaagaaaaaggctgacaattgctgtggagctggtagcaaacccttcgatcatcttcatggatgagccaacttctggtcttgatgctcgagctgctgcgattgtcatgcgtacagtaagaaatacggttaacactggacgtactgtggtctgcacaatccatcagccaagcatcgacatatttgagtcttttgatgagctactgcttttgaaacgtggaggtcaggttatttatgctggtgaacttggtcgccactctcacaaattagttgaatattttgaggcgattccaggtgttcaaaagatcacagaaggatataatcctgcaacatgggcgctggaagttagctctcctctatccgaggctcgattgaacatgaattttgctgaaatttatgctaactctgtgctttataggaaaaatcaagagctcatcaaggagttgagtgttccctcaccagactaccaggacctgtcattccctacaaaatattcgcagaatttctacaaccaatgcgccgcgaacttttggaagcaataccgttcctattggaagaatccgccctacaatgctatgcgctacctgatgacatttctcttcggccttgtatttggtacagtgttctggcaaaaaggaaagaacatagattcacagcaagatttatataatctactcggagccacttacgctgctaccttctttctgggggcttcaaatagcatcacggttcagcctgttgtatcaattgagcgagcagtgttctaccgtgagaaggcagcggggatgtactctccattatcctacgcatttgctcagacgtgcgtggaggtgatctacaccatcttacaggggatactgtacacagtcatcatatatgcgacgatcggatacgactggaaagcggataagttcttgtacttcctgtttttcatgaccgcgtgcttcaactacttcgggttgttcggcatgatgttggtagcgtgcactccctccgcattgctcgccaacattctcatcacgtttgctctgcctctttggaacctcttcgctggattcctcatcgttagaccggcaataccaatttggtggaggtggtactactgggcgaaccccgtgtcgtggaccatctacggcgttgttgcgtctcagttcggcgagaaccaaggcgagctttcagttcccggtgggaagcccgtggtggtgaagcagttcttgaaggataatctcggcatccagcatgacttactcggctatgtcgtgctagtccatttcgcctacatcattgcgttcttcttcgttttcggttattccatcaagttcttcaacttccagaaacgttagctgcacctctactctctgctgtctcacacggacggtcatttgtaatctactttctcgtacgtcgaagcaaatgcttgtttgggaagcctgtttgcaagtagccaagtactagtatattctcctctagcatgttccttcaatggaaaatgttaaaaaaagatgacgaatacataaagtgacatctttgtttagatatcggtgtcgtatctgttgtaccgtaataaaaaaattgttgggactg

SEQ ID NO: 1580 - DNA, 2221 bp, Triticum aestivum
  misc_feature (42)..(42): n is a, c, g, or t
  misc_feature (72)..(72): n is a, c, g, or t
  misc_feature (74)..(74): n is a, c, g, or t
  misc_feature (92)..(92): n is a, c, g, or t
  misc_feature (103)..(103): n is a, c, g, or t
  misc_feature (157)..(157): n is a, c, g, or t
  misc_feature (308)..(308): n is a, c, g, or t
  misc_feature (340)..(340): n is a, c, g, or t
  misc_feature (346)..(346): n is a, c, g, or t
  misc_feature (353)..(353): n is a, c, g, or t
  misc_feature (392)..(392): n is a, c, g, or t
  misc_feature (394)..(394): n is a, c, g, or t
  misc_feature (412)..(412): n is a, c, g, or t
  misc_feature (442)..(442): n is a, c, g, or t
  misc_feature (457)..(457): n is a, c, g, or t
  misc_feature (466)..(466): n is a, c, g, or t
  misc_feature (470)..(470): n is a, c, g, or t
  misc_feature (484)..(484): n is a, c, g, or t
  misc_feature (499)..(499): n is a, c, g, or t
  misc_feature (502)..(502): n is a, c, g, or t
cagcggctcaaacacagtttcagacaaggagaatgagaatgngacaaacacttcaacaccgatgggtactantnatgaagccacaaaccgancaactcagacncaaatcaccttgcctttccagcctcttgcactatctttcaaccatgtaaactantacgtggacatgcctgcagaaatgagggagcaaggattcgccgaaagtcgtctccagttgctctctgatatcagtggtgcttttaggccaggtgttctgacagcattagttggtgtgagtggagctgggaaaaccactctaatggatgtcntggcaggaaggaaaactagtggatctattganggaagnatcaccntctctggttaccctaaaaaacaagaaacttttgcccgcntnagtggctattgtgaacanactgatatccattcaccaaatgttactgtntatgaatccattctntactctgcntggntgcgtctttcctcngatgttgacgaaaanacnagaaagatgtttgtggaggaagtcatgactcttgtggagcttgatgtgttgcgtaatgctatggttggtctccctggagtggacgggttatcgactgaacaaagaaagagactgacaattgccgtggagctggtagcaaatccttcaatcatattcatggatgagccaacttctggtcttgatgctagagccgcggcaattgtaatgcgggcggtgagaaatacagtgaacactgggcgaactgtggtttgcactatccatcaacccagcatcgatatattcgagtcttttgatgagcttctgcttatgaaaagaggaggacgagttatttatgctggtgaacttggtcagcactctcacaaattagttgaatattttgaggcaattccaggtgttgaaaagatcacagaaggatataatcctgcaacatggatgctggaagttagctcccctttagctgaggctcgcctgaacgtaaattttgctgaaatttatgctaattctgatctttataggaaaaaccaagaacttattaaggaattaagcgttcccccacctggctatgaagatctctcatttcctacgaagtattctcagaatttctacaatcaatgtgttgcaaacttctggaagcaatacaaatcttactggaagaatccaccccacaacgccatgcgctttcttatgacgttgatctatggccttgtatttggcacagtgttttggcagaaggggacaaaaatagactcaccacaagatttgtccaatctacttggagccacttatgctgctgtcttcttccttggttctgccaactgcatcacagttcagcctgttgtgtcaatcgaacgaactgttttctaccgtgaaaaggcggcagggatgtactctccattatcctatgcattagctcagacatgcgtggagatgatctacaacgtcgtgcaggggattcagtacacggtcatcatctatgcgatgattggatatgagtggaaagctgcaaagttcttctatttccttttctttacaatttcatgcttcaactacttcacattgtttggcatgatgctggtggcgttgacctcatcttccatgctcgcaaacatacccatagcctttgtactccctctttggaatctttttgctgggttcctcgttgcgagaccgttactaccaatttggtggaggtggtactactgggcgaaccctgtgtcttggaccatctatggcgtcatcgggtcgcagtttggcgataacaccagtcctctgtctgtccccgacgggagccgcccggtggtgaagcaattcttggaggacaatctgggcatcaagcacgatttccttgggtatgtcgtgctcgcgcatttcgcgtacgtcatcgccttcttcttggtgttcggctactccatcaaggtgttgaacttccagaaacgttaggcagacggccgtttattttatgctgctgcaagagagaggcggcaataatctatagtttgtgtgtatttgtgtatagtagaagtagtaggatacatacatagacatcgttgtacaagctctgctatttagaggaatggattttttttcgacttcatcaaaaataaaaatgacatccttttccgtttagttaattgtttgttgtaaattcggttaatcgatcgcatgtaaatgtaatagttgttggtgcggacaaggtaccttggcatgttccaaaaaaaa

SEQ ID NO: 1581 - DNA, 4654 bp, Zea mays
atgccgatgccggagtcacatccgcacgctgttgctgctgctgcggcgggtctggctctggcgtcgacgtctagccgtcggagcctcagcttgggctcctccatctcgcagtcattccggcagatggacacggaagaccccttcggccgggcgcagtcggaccacgacgacgaggagaacctgcgctgggccgcgctcgagaagctacccacctacgaccgcatgcgccagggtatcctccgccgggcgctggacaacgatcaacagcaacaacagcggcagagcgtcgaggtcgtcgacatccacaagctggccgccggcggcgacgggggccgtgcgctcttggaccgcctcttccaggaggacagcgagcgattcctgcgccgcctcagggacagaatcgacatggttggcatcgacctccccaccgtcgaagttcgctaccaccagttgacggtggaggctgacgtcattaccgccggtcgcgccctccccacgctctggaacgccgccaccaattttctccagggtctcattggacgatttggttcttcaaacaagaagaacatcaccatacttaagaatgtcaatggtatcctcaagccatccaggatgacacttcttcttgggcctccatcctcggggaagagcacactcatgcgggcactcgccggcaagcttgacaaaaatctcaaggtctctggcagcattacgtattgtggccatccaatttcagagttctatcctgagaggactagcgcgtatgttggtcaatatgatctccacaatgccgagatgaccgtaagagagacactggatttctccaggcggtgcctaggcattggtgccagatatgagatgatcgccgaacttgctagaagggagcgggatgcaggcatcaagccagatcccgagattgatgctttcatgaaagctactgcagtacaaggacaggagactaatattataactgatctcactctcaaggtgcttgggctggacatttgtgctgacgttattattggcgatgagatgatcagaggaatttctggcgggcaaaagaaacgtgtgacaactggggagatgctaacggggccagcaagggctttatttatggacgaaatatccactggtctggatagctcgagcacatttgagattgtaaagtttatgaggcagttggtccatgtaatgagtgaaaccgtcatgatctctctgctccagccaccgccagagacatacaatctttttgatgacataatcctgctatcagaaggatacatagtgtaccatgggccgcgcgagaatatcctagaattctttgagtctgccggtttccggtgccctgacaggaaaggtgtcgcagactttcttcaagaggttacttccaagaaagaccaacaacaatactggtatcttgatcaggagcagtatcattatgtatctgtacccgactttgcagaacgtttcaaatcattccatgcatgccagcagatgcagaaggagttgcaaataccttttgaaaagtccaaaactcatcctgctgcgttgaccaccagaaaatatgggctttccagctgggaatcactcaaggcagtgatgtcaagagagcagctattgatgaagcgcaactctttcatctatattttcaaggtcacccagttgatcatccttgcactcatgtccatgactgtgtttctcagaataaagatgccccatgggcagattgctgatggcaccaaattctttggggctctgacttttggtttaataacaatcatgttcaatgggttcgctgagctacaattaaccataaagaagcttccagttttctacaaacatagggatttcttattcttccccgcttggaccttaggagtggcaaacataatcttaaaagttcctgtctcgttcgtggaatcagcagtatgggttgttctcacgtactatgtgatgggctttgcacctgctgcaggaaggttctttcgtcagtttatagctttctttgccacacaccaaatggcaatggctttattccggtttcttggtgctgttttgaaaacaatggttgtggccaatacttttgggatgtttgtgctgctcattattttcatctttggaggatttgtcatccgtagaaatgacatcagaccatggtggatctggggttactgggcatcacctatgatgtatagccaaaatgcaatatcggtcaacgaattccttgccagtaggtgggctattccaaacaatgacacgactatcgacgcgccaacagtaggcaaagcaattcttaaatccaaaggcttgtttactggagaatggggattttggctttccattggagccctcataggattcattattttgttcaacatgctctacctttgggcccttacatatttaagtcctagtagtggctccaatgccctggtttcagaaggtgaggatgatgtaaatgaaatggcattggaaggaagaaggaaagatgcaagaagaagcaaagatgaaatatcccaagttgtatccagtgatccaggcactaatggaggaacaaacacgctagctcaatcacgagtcactttgcctttccagcctcttgcactttgctttaaccatgtaaactattacgtcgacatgcctgcagaaatgaaggaacaaggattcacagaaagccgtttacaactactctctgatatcagtggcacttttaggccaggggttctaacagcactggttggtgtgagtggagctggaaagaccactttaatggatgtcctggcaggaaggaaaactagtggagctattgaaggagatattaccctgtcgggataccccaaaaaacaagaaacttttgcccggattagtggttattgtgaacaaactgatatccattctccaaatgttactgtatttgaatccatcacctactctgcttggttgcgtctttcctcagatattgatgatggtacaaaaaagatgtttgtggaggaagtgatggcccttgtagagcttgatgtgttgcgcgacgctctagtgggtctccctggagttagtgggttatcaactgagcaaagaaaaaggctgacaattgctgtggagctggtagcaaacccttcaatcatcttcatggatgaaccaacttctggtcttgatgctcgagctgcggcaattgtcatgcgtacagtaagaaatacggttaacactgggcgtactgtggtctgcacaatccatcagcccagcatcgacatatttgagtcttttgatgagcttctgcttttgaaacgtggaggtcaggttatttatgctggtgaacttggtcgccactctcacaaactagttgaatattttgaggcgattccaggtgttccaaagatcacagaaggatataatcctgcaacatgggtgctggaagttagttctcctctatctgaggctcgattgaacatgaattttgctgaaatttatgcaagctctgtgctttataggaaaaatcaagaggttatcaaggagttgagtattccccgatcagacaaccaggacctgtcatttcctacaaaatattcacagaatttctacggtcaatgtgccgcaaacttttggaagcaataccgttcgtactggaagaatccaccctacaatgctatgcgctatctgatgacatgtctctttggccttgtatttggtacagtattttggcaaaaaggaaagaacatagattcacaacaagatttatataatctgcttggagccacttacgctgctacattctttcttggggcttcaaattgcatcacggttcagcctgttgtatcgattgagcgagcagttttctaccgtgagaaggcagcggggatgtactctccgttatcctatgcatttgctcagacatgtgtggaggtcatctacaccatcttacaggggatactgtacacagtcatcatatatgcgatgatcggatacgactggaaagcggataaattcttctatttcctgtttttcatcactgcaagcttcaactacttcacattgttcggcatgatgttggtagcatgcactccctccgcattgctcgcgaacattctcatcacgtttgctctacctctgtggaacctctttgctggattcctcatcgttagaccggcaataccaatttggtggaggtggtactactgggcgaaccctgtgtcgtggaccatctatggcgttgttgcgtctcagtttggcgagaacgaaggtgagctttcagttcccggtgggacgcccgtggtggtgaagcagttcttgaaggataatctcggcatccagcatgacttactcggctatgttgtgctcgtccatttcgcctacgtcattgtgttcttcttcgtattcggttattccatcaagttcttcaacttccagaaacgttagcgggatcatttgtatgtaattaatcggtcgccgtaagttctagttctagttctagttctagtcaaagcaagtgcttgtttgggaggaagcctgtatgcaagtagcagtgtattcctcttgtttcttcaatgcaaaaatattaaaaggaagatgacgaatgcaaaagtgacatgtcttgttccttttcttcttgagtaatctgtgaggctaagagcagccgcagtgtgacggggttcgtttc

SEQ ID NO: 1582 - DNA, 1763 bp, Triticum aestivum
gggaaaaccactctaatggatgtcctggcaggaaggaaaactagtggatctattgaaggaagtatcaccgtctctggttaccctaaaaaaacaagaaacttttgcccgcgtgagtggctattgtgaacaaactgatatccattcaccaaatgttactgtgtatgaatccattctgtactctgcttggctgcgtctttcctcagatgttgacgaaaatacgagaaagatgtttgtggaggaagtcatgactcttgtggagcttgatgtgttgcgtaatgctatggttggtctccctggagtggacgggttatcgactgaacaaagaaagagactgacaattgccgtggagctggtagcaaatccttcaatcatattcatggatgagccaacttctggtcttgatgctagagccgcggcaattgtaatgcgggcggtgagaaatacagtgaacactgggcgaactgtggtttgcactatccatcaacccagcatcgatatattcgagtcttttgatgagcttctgcttatgaaaagaggaggacgagttatttatgctggtgaacttggtcagcactctcacaaattagttgaatattttgaggcaattccaggtgttgaaaagatcacagaaggatataatcctgcaacatggatgctggaagttagctcccctttagctgaggctcgcctgaacgtaaattttgctgaaatttatgctaattctgatctttataggaaaaaccaagaacttattaaggaattaagcgttcccccacctggctatgaagatctctcatttcctacgaagtattctcagaatttctacaatcaatgtgttgcaaacttctggaagcaatacaaatcttactggaagaatccaccccacaacgccatgcgctttcttatgacgttgatctatggccttgtatttggcacagtgttttggcagaaggggacaaaaatagactcaccacaagatttgtccaatctacttggagccacttatgctgctgtcttcttccttggttctgccaactgcatcacagttcagcctgttgtgtcaatcgaacgaactgttttctaccgtgaaaaggcggcagggatgtactctccattatcctatgcattagctcagacatgcgtggagatgatctacaacatcgtgcaggggattcagtacacagtcaccatctatgcgatgattggatatgagtggaaagctgcaaagttcttctatttccttttctttacattcatgcttcaactacttcacattggttggcatgatgctggtggcgttgacctcatcctccatgctcgcaaactacccatagcctttatactccctctttggaacctttttgctgggttcctcgttgcgagaccgttattaccaatttggtggaggtggtactactgggcgaaccctgtgtcttggaccatctatggcgtcatcgggtcgcagtttggcgataacaccagtcgtctgtcggtccccggcgggagccccacggtggtgaagcaattcttggaggacaatatgggcatcaagcacgatttccttgggtatgtcgtgctcgcgcattttgcgtatgtcatcggcttcttcttgatgttcggctactccatcaaggtgttgaacttccagaaacgttaggcagacggccgtttatgctgctgcaagagagaagcggcaatctatatacttagtgtgtatatgtgtatagtagaagtggtagggtacatacatagacatcgttgta

SEQ ID NO: 1583 - DNA, 4406 bp, Sorghum bicolor
gtagctagctagctagcttgcaggagctagagtcaattcatggcgagcgcagtcggagcatgagcaccgcgacgacgaggagaacctgcggtgggccgcgatggagaagctgccgacctacgaccgcatgcgccagggcatcctccggcaggcgctcgccgccggcgaccaacaacagagcggcggcgtcgaggtggtggacatccagaagctggccggcggcgacgggggccgtgaactcttggagcgcctcttccaggacgacagcgagcgattcctgcgccggctcagggaccgaatcgacatggttggcatcgagctcccgaccatcgaggttcggtatgagcagctgaatgtggaggctgacgtcatcgccgccggtcgcgccctccccacgctctggaacgctgccaccaatcttttcgagggtctcattggacggtttggttcttcaaacaagaggaacatcaccatacttaagaatgtcaatggtatcctcaagccttccaggatgacgcttcttcttgggcctccatcctcaggaaagagcacgctcatgcgagcactcgctggcaagcttgacaaaaatctcaaggtctctggcagcatcacgtattgtggccatccaatctcagagttctatcctgagaggactagcgcatatgttggtcaatatgatctccacaatgccgagatgactgtaagagagacgctggatttctccaggcgatgcctaggcattggtgccagatatgagatgatagcagaacttgctagaagggagcgggatgcaggcattaagccagatcctgagattgatgctttcatgaaagctactgcagtacaaggacaggagactaatattataacagatctcactctcaaggtgcttgggctggacatttgtgctgatgttattattggcgatgagatgatcagaggaatttctggtgggcaaaagaaacgtgtgacaactggggagatgttaacgggaccagcaagggctttatttatggacgaaatatcaactggtctggatagctcaagcacatttcagattgtaaagtttatgaggcaattggtccatgtaatgaatgaaaccgtcatgatctctctgctccagccaccgccagagacctacaatctttttgatgacataatcctgctatcagaaggatacatagtctaccatgggccacgggagaatatattggaattctttgagtctgccggtttccggtgccctgacaggaaaggtgttgcagactttcttcaagaggttacttccaagaaagaccaacagcaatactggtaccttgatcaggagcagtatcattatgtatctgtaccagactttgcacaacgtttcaagtcattccatgcatgccagcagatgcagaaggagttgcaaattccttttgaaaagtccaaaacccatcctgctgcgttgaccaccagaaaatatggtctttccagctgggaatcactcaaggcagtgatgtcgagagagcaactattgatgaagcgcaactccttcatctatattttcaaggtcacccagctgatcatccttgcactcatgtccatgactgtgtttctcagaacaaagatgccccatgggcagattgctgatggcaccaaattctttggggctctgacttttggtttaataacgatcatgttcaatgggtttgctgagctacaattgaccataaagaagcttccagttttctacaaacatagggatttcttattcttccctgcatggaccttaggagtggcaaacataatcttaaaagttcctgtctcgctcgtggaatcagcagtatgggttgctctcacgtactatgtgatgggctttgcacctgctgcaggaaggttctttcgtcagtttatagctttctttgccacacaccaaatggcaatggctttattccggtttcttggtgctatattgaaaacaatggttgtggccaatacttttgggatgtttgtgctgctcattattttcatctttggaggatttgtcatccgtagaaatgacatcaaaccatggtggatctggggttattgggcatcacctatgatgtatagtcaaaatgcaatatctatcaacgaattccttgctagtaggtgggctattccaaacaatgacacgactattgatgcaccaacagtaggcaaagcaattctaaaatccaaaggcttgtttactggagaatggggattttggctatccatcggagcccttataggattcattattttgttcaacatgctctacatttgggcccttacatatttaagtcgcactaatggagcaacaaacacactagctgagtcacgagtcactttgcctttccagcctctttcactttgctttaaccatgtaaactattatgttgacatgcctgcagaaatgaaggaacaaggattcacagaaagccgtttacaactgctctctgatatcagtggtgcttttaggccaggggttctgacagcattagttggtgtgagtggagctggaaagaccactttaatggatgtcctggcaggaaggaaaactagtggagctattgaaggagatattaccctgtccggtttccccaagaaacaagaaacttttgcccggattagtggttattgtgaacaaactgatatccattctccgaatgttactgtatttgaatccatcacctactctgcctggctgcgtctttcctcagacattgatgatggtacgaaaaagatgtttgtggaagaagtgatggcccttgtagagcttgatgtgttgcgcgacgctcttgtgggtctccctggagttagtggattatcaactgagcaaagaaaaaggctgacaattgctgtggagctggtagcaaacccttcaatcatcttcatggatgagccaacctctggtctcgatgctcgagctgcagcaattgtcatgcgtacacttctgcttttgaaacgtggaggtcaggttatttatgctggtgaacttggtcgccactctcacaaattagttgaatattttgaggcgattccaggtgttccaaagatcacagaaggatataatcctgcaacatgggtgctggaagttagctctcctctatctgaggctcgactgaacatgaattttgctgaaatttatgctaactctgtgctttataggaaaaatcaagagcttataaaggagttgagtattcccccaccagactaccaggacctgtcatttcctacaaaatattcacagaatttttatggccaatgcatctcaaacttttggaagcaataccgttcctattggaagaatccgccctacaatgctatgcgctatctgatgacatttctctttggccttgtatttggtacagtattttggcaaaaaggaaagaacatagattcacaacaagatttatacaatctacttggagccacttacgctgctaccttctttcttggggcttcaaattgcatcacggttcagcctgttgtatcgattgagcgagcagttttctaccgtgaaaaagcagcggggatgtactctccattatcctatgcatttgctcagacatgtgtggaggtcatctacaacgtcttacaggggatactgtacacagtcatcatatatgcgatgatcggatacgactggaaagcagataaattcttctatttcctgtttttcatcactgcaagcttcaactacttcacattgttcggcatgatgttagtagcatgcactccctctgcattgctcgcaaacatttttatcacgtttgcactacctctttggaacctctttgctggattcctcatcgttagaccggcaataccaatttggtggagatggtactactgggcgaaccctgtctcgtggaccatctacggtgttgttgcatctcagtttggcgagaacgaaggtgagctttcagttcccggtggcagtgggaaacccgtggtggtgaagcagttcttgaaggataatctcggcatccagcatgacttcctcggctatgttgtgctcgtccatttcgcctacatcattgcattcttcttcgtattcggttattccatcaagttcttcaacttccaaaaacgttagctccacctctacgggccgtcggaatctgtaatcggttgccgtaagttctagttctagtcaaaataagtgcagtcgaaatgtgtcattaagaggatttttttaggagttaccatatatatatagcgctattctacaccttaggtgtagaatattattctacaccgcaagtcaaaactgggtagaaaaaatactgagcagtactgaacaacattcagtatcatcttgtctaacacccaagatcacgaaatgctgaacaatcctgaaacacgagcactgaacgatactgaattttgttcagtat

SEQ ID NO: 1584 - DNA, 4398 bp, Zea mays
gcggtgctggcgtcgacgtctagccgtcggagcctcagcttggggtcctccatctcgcagtcgttccggcagatggacacggaggaccccttcgcgcggtcgcagtcggagcatgagcaccgcgacgacgaggagaacctgcgctgggccgcgctcgagaagctgcccacctacgaccgcatgcgccagggtatcctacgccgggcgctcgaccaacaacaagagagcggcggcggcggcgtcgagatcgtcgacatccacaagctggccgccggcgacgggggccgtgcgctcctggagcgcctcttccaggacgacagcgagcgattcctgcgccggctcagggaccgaatcgacatggttggcatcgagctccccacagtggaagttcggtacgagcagttgacggtggaggctgacgtgattaccgccgggagggccctcccgacgctgtggaacgccgccaccaattttcttcagggtctcattggacgcttcggttcttcaaacaagaggaacatcaccatacttaagaatgtcaatggtatcctgaagccatccaggatgacgcttcttcttgggcctccatcctcagggaagagcacactaatgcgagcactcgctggcaaacttgacaaaaatctcaaggtctctggcagcattacgtattgtggccatccaatttcagaattctatcctgagaggactagcgcgtatgttggtcaatatgatctccacaatgccgagatgactgtaagggagacacttgatttctctaggcggtgcctaggcattggtgccagatatgagatgattacagaacttgctagaagggagcgggatgccggcattaagccagatcctgagattgatgctttcatgaaagctactgcagtacaaggacaggagactaatattataacagatctcactctcaaggtgcttgggctggacatttgtgctgatgttattattggtgatgagatgatcagaggaatttctggcgggcaaaagaaacgtgtgacaactggggagatgctaacagggccagcaacggctttatttatggacgaaatatccactggtttggatagctcgagcacatttcagattgtaaagtttatgaggcatttggtccatgtaatgaatgaaactgtcatgatctctctgctccagccaccgccagagacctacaatctttttgatgacataatcctgctatcagaaggatacatagtgtaccatgggccacgcgagaatatcctggaattctttgagtctgtcggtttccggtgccctgacaggaaaggtgtcgcagactttcttcaagaggttacttccaagaaagaccagcaacaatattggtatcttgatcaggagcaatatcattatgtatctgtacccgactttgcagaacgtttcaaatcattccatgcatgccaacagatgcagaaggagttgcaaataccttttgaaaagtccaaaacccatcctgctgcgttgaccaccaaaaaatatgggctttctagctgggaatcactcaaggcagtgatgtcaagggagcagctattgatgaagcgcaactctttcatctatattttcaaggtcacagtgttgatcatccttgcattcgtgtccatgactgtgtttctcagaacaaagatgccccatgggcaaattgctgatggcaccaaattctttggggccctgacttttggtttaataacgatcatgttcaatgggttcgctgagctacaattgaccataaagaagctaccagttttctacaaacatagggatttcttattcttccctgcatggacctttggagtggcaaacatactcttaaaagttcctatctcgctcgtggaatcagtagtatgggttgttctcacatactatgtgatgggctttgcacctgctgcaggaaggttctttcgtcagtttatagctttctttgccacacaccaaatggcaatggctttatttcggtttcttggtgctgttttgaaaacaatggttgtggccaatacttttgggatgtttgtgctgctcattattttcatttttggaggatttgtcatccgtagaaatgacattaaaccttggtggatctggggttattgggcatcacctatgatgtatagccaaaatgcaatatctatcaacgaattccttgctagtaggtgggctattccaaacaatgacacgactattgatgcaccaacagtaggcaaagcaattcttaaatccaaaggcttgtttactgaagaatggggattttggctttccattggagcccttataggattcattattttgttcaacagtctctacctttgggcccttacatatttaagtcgcactaatggagcaacaaacacactagttcagtcacgagtcactttgcctttccagcctctttcactttgctttaaccatgtaaactattacgtcgacatgcctgcggaaatgaaggaacaaggattcacagaaagccgtttacaactgctctctgatatcagtggtgcttttaggccaggggttctaacagcattagttggtgtgagtggagctggaaagaccactttaatggatgtcctggcaggaaggaaaactagtggagccattgaaggagatattaccctgtccggataccccaaaaaacaagaaacttttgcccggattagtggttattgtgaacaaaccgatatccattctccgaatgttactgtatttgaatccatcacgtactctgcatggttgcgtctttcctcggatattgatgatggtacgaaaaagatgtttgtggaggaagtgatggcccttgtagagcttgatgtgttgtgcgacgctcttgtgggtctccctggagttagtgggttatcaactgagcaaagaaaaaggctgacaattgctgtggagctggtagcaaacccttcgatcatcttcatggatgagccaacttctggtcttgatgctcgagctgctgcgattgtcatgcgtacactactgcttttgaaacgtggaggtcaggttatttatgctggtgaacttggtcgccactctcacaaattagttgaatattttgaggcgattccaggtgttcaaaagatcacagaaggatataatcctgcaacatgggcgctggaagttagctctcctctatccgaggctcgattgaacatgaattttgctgaaatttatgctaactctgtgctttataggaaaaatcaagagctcatcaaggagttgagtgttccctcaccagactaccaggacctgtcattccctacaaaatattcgcagaatttctacaaccaatgcgccgcgaacttttggaagcaataccgttcctattggaagaatccgccctacaatgctatgcgctacctgatgacatttctcttcggccttgtatttggtacagtgttctggcaaaaaggaaagaacatagattcacagcaagatttatataatctactcggagccacttacgctgctaccttctttctgggggcttcaaatagcatcacggttcagcctgttgtatcaattgagcgagcagtgttctaccgtgagaaggcagcggggatgtactctccattatcctacgcatttgctcagacgtgcgtggaggtgatctacaccatcttacaggggatactgtacacagtcatcatatatgcgacgatcggatacgactggaaagcggataagttcttgtacttcctgtttttcatgaccgcgtgcttcaactacttcgggttgttcggcatgatgttggtagcgtgcactccctccgcattgctcgccaacattctcatcacgtttgctctgcctctttggaacctcttcgctggattcctcatcgttagaccggcaataccaatttggtggaggtggtactactgggcgaaccccgtgtcgtggaccatctacggcgttgttgcgtctcagttcggcgagaaccaaggcgagctctcagttcccggtgggaagcccgtggtggtgaagcagttcttgaaggataatctcggcatccagcatgacttactcggctatgtcgtgctagtccatttcgcctacatcattgcgttcttcttcgttttcggttattccatcaagttcttcaacttccagaaacgttagctgcacctctactctctgctgtctcacacggacggtcatttgtaatctactttctcgtacgtcgaagcagcaactgcttgtttgggaagcctgtttgcaagtagccaagtactagtatattctcctctagcatgttccttcaattgaaaatgttaagaaaaaagatgacgaatacataaagtgacatctttgtttagatatcggtgtcgtatctgttgtaccgtaataaaaaaattgttgggactg

SEQ ID NO: 1585 - DNA, 4202 bp, Zea mays
aacctgcgctgggccgcgctgcagaagctgcccacctacgaccgcatgcgccagggtatcctccgccgggcgctcgacgaccaagaacagcagagcggagacggcgacgtcgaggtcgtcgacatccacaagctggccgccggcgacgggggccgtgcgctcttggagcgcctcttccaggaggacagcgacccattcctgcgccggctcagggacagaatcgacatggttggcatcgagctccccaccgtggaagttcgctacgagcagttgacggtgcaggctgacgtggttgctgccggccgcgccctccccacgctctggaacgcggccaccaattttctccagggtctcattggacggtttggttcctcaaacaagaggaacatcaccatacttaagaatgtcaatggtatcctcaagccatccaggatgacgcttcttcttgggcctccatcctcagggaagagcacactcatgcgagcactcgctggcaagcttgacaaaaatctcaaggtctctggcaacatcacatattgtggccatccaatttcagagttctatccagagaggactagcgcatatgttggtcagtatgatctccataacgccgagatgactgtaagagagacgcttgatttctccaggcggtgcctaggcgttggtgccagatatgagatgattgcagaacttgctagaagggagcgggatgcaggcattaagccagatcctgagattgatgctttcatgaaagctactgcagtacaaggacaggagacaaatattataacggatttcactctcaaggtgcttgggctggacatttgtgctgatgttattattggcgatgagatgatcagaggaatttctggcgggcaaaagaaacgtgtgacaactggggagatgctaacagggacagcaagggctttatttatggacgagatatccactggtttggatagctcaagcacatttcagattgtaaagtttatgaggcaattggtccatgtcatgaatgaaactgtcatgatctctctgctccagccaccgccagagacctataatctttttgatgacataatcttgctatcagaaggatacatagtgtaccatgggccacgcgagaatatcctggagttctttgagtctgccggttttcggtgccctgacaggaaaggtgtcgctgactttcttcaagaggttacttccaagaaagaccaacaacagtactggtatcttgatcaggagcagtatcgttatgtatctgtacccgactttgccgaacgtttcaaatcattccatgcttgccagcagatgcacaaggagttgcaaataccttttgacaagtccaaaacccatcctgctgccttgaccaccacaaaatatgggctttccagctgggaatcattcaaggtagtgatgtcaagagagcagctattgatgaagcgcaactctttcgtctatattttcaaggtcacccagttgatcatccttgcactcatgtccatgaccgtgttcctcagaataaagatgccccatgggcagattgctgatggcaacaaattctttggggctctgacttttggtttaataacgatcatgttcaatgggttcgctgagctacaaatgacaataaagaagcttccagtcttctacaaacatagggatttcttattcttccccgcttggaccttaggagtggcaaacatactcttaaaagttcctatctcattcgtggaatcactagtatgggttgttctcacatactatgtgatgggctttgcacctgctgcaggaaggttctttcgtcagtttatagctttctttgccacacaccaaatggcaatggctttattccggtttcttggagctgttttgaaaacaatggttgtggccaatacttttgggatgtttgtgctgctcattattttcatttttggaggatttgtcatacgtagaaatgacatcaaaccatggtggatctggggttactgggcatcacctatgatgtatagccaaaatgcactatctgtcaacgaattccttgctagtaggtgggctagtccaaataatgacacgattattgacgcgccaacagtaggcaaagcaattcttatatccaaaggcttgtttactggagaatggggattttggctttccattggagcccttgtaggattcattattttgttcaacatgctctacctttgggcccttacatatttaagtcgcactaatggagcgacaaacacagtagctcagtcgtcacgagtcactttgcctttccagcctcttgcactttgcttcaaccatgtaaactattacgtcgacatgcctgcagaaatgaaggaacaaggattcacagaaagccgtttacaactgctctctgatatcagtggcacttttaggccaggggttctaacagcactagttggttttagtggagctggaaagaccactttaatggatgtcctggcaggaaggaaaactagtggagctattgaaggagatattaccctgtcgggataccccaaaaaacaagaaacttttgcccggatcagtggttattgtgaacaaactgatatccattctccaaatgttactgtatttgaatccatcacctactctgcctggctgcgtctttcctcagatattgatgatgatacaaaaaagatgtttgtggaggaagtgatgacccttgtagagcttgatgtgttgcgcgacgctcttgtgggtctccctggagttaatgggttatcaactgagcaaagaaaaaggctgacaattgccgtggagctggtagcaaacccttcaatcatcttcatggatgagccaacttctggtcttgatgctcgagctgctgccattgtcatgcgtacagtaagaaatacggttaacactggccgtactgtggtctgcacaatccatcagcccagcatcgacatatttgagtcttttgatgaggtctcctatccccctagctccctcacaacagctgattattattttttttccaatatcctcacaacagttggtttgttaattttccagcttctgcttttgaaacgtggaggtcaggttatttatgctggtgaacttggtcgccactctcacaaactagttgaatattttgagtcgatttctggtgttccaaagatcacagaaggatataatcctgcaacatgggtgctggaagtcagctctcctctatcggaggctcgattgaacatgaattttgctgaaatttatgcgaactctgtgctttataggaaaaatcaagagcttatcaaggagttgagtatccccccaccagactaccaggacctgtcatttcctacaaaatattcgcagaatttctacggtcaatgcgtcgcaaacttttggaagcaatgccgttcctattggaagaatccgccctacaatgctatgcgctatctgatgacatctctctttggccttgtatttggtacagtattttggcaaaaaggaaagaacatagattcacaacaagatttatataatctacttggagccacttatgctgctatcttctttcttggggcttcaaattgcatcactgttcagcctgttgtatcgattgagcgagcagttttctatcgtgaaaaggcagcggggatgtactctccattatcctatgcatttgctcagacatgtgtggaggtcatctacaccaccttacaagggatactgtacactgtcatcatatatgggatgatcggatatgactggaaatcagataaattcttctatttcctgtttttcatcactgcaagcttcaactacttcacattgttcggcatgatgttggtagcatgcactccctctgcattgcttgccaacattctcatcacctttgctctacccttttggaacctctttgctgggttcctcatcgttagaccggcaataccaatttggtggaggtggtactactgggcgaaccctgtgtcgtggaccatctacggtgttgttgcgtctcagtttggcgagaaccaaggtgagctttcagttcccggcgggaagcccatgctggtgaatcaattcttgaaggataatctcggcatccagcatgacttactcggctatgttgtgctcgtccatttcgcctacgtcattgtcttcttcttcgtattcggctattccatcaagttcttcaacttccagaaacgttaattagctag

SEQ ID NO: 1586 - DNA, 4343 bp, Zea mays
ctggctctggcgtcgacgtctagccgtcggagcctcagcttgggctcctccatctcgcagtcattccggcagatggacacggaagaccccttcggccgggcgcagtcggaccacgacgacgaggagaacctgcgctgggccgcgctcgagaagctacccacctacgaccgcatgcgccagggtatcctccgccgggcgctggacaacgatcaacagcaacaacagcggcagagcgtcgaggtcgtcgacatccacaagctggccgccggcggcgacgggggccgtgcgctcttggaccgcctcttccaggaggacagcgagcgattcctgcgccgcctcagggacagaatcgacatggttggcatcgacctccccaccgtcgaagttcgctaccaccagttgacggtggaggctgacgtcattaccgccggtcgcgccctccccacgctctggaacgccgccaccaattttctccagggtctcattggacgatttggttcttcaaacaagaagaacatcaccatacttaagaatgtcaatggtatcctcaagccatccaggatgacacttcttcttgggcctccatcctcggggaagagcacactcatgcgggcactcgccggcaagcttgacaaaaatctcaaggtctctggcagcattacgtattgtggccatccaatttcagagttctatcctgagaggactagcgcgtatgttggtcaatatgatctccacaatgccgagatgaccgtaagagagacactggatttctccaggcggtgcctaggcattggtgccagatatgagatgatcgccgaacttgctagaagggagcgggatgcaggcatcaagccagatcccgagattgatgctttcatgaaagctactgcagtacaaggacaggagactaatattataactgatctcactctcaaggtgcttgggctggacatttgtgctgacgttattattggcgatgagatgatcagaggaatttctggcgggcaaaagaaacgtgtgacaactggggagatgctaacggggccagcaagggctttatttatggacgaaatatccactggtctggatagctcgagcacatttgagattgtaaagtttatgaggcagttggtccatgtaatgagtgaaaccgtcatgatctctctgctccagccaccgccagagacatacaatctttttgatgacataatcctgctatcagaaggatacatagtgtaccatgggccgcgcgagaatatcctagaattctttgagtctgccggtttccggtgccctgacaggaaaggtgtcgcagactttcttcaagaggttacttccaagaaagaccaacaacaatactggtatcttgatcaggagcagtatcattatgtatctgtacccgactttgcagaacgtttcaaatcattccatgcatgccagcagatgcagaaggagttgcaaataccttttgaaaagtccaaaactcatcctgctgcgttgaccaccagaaaatatgggctttccagctgggaatcactcaaggcagtgatgtcaagagagcagctattgatgaagcgcaactctttcatctatattttcaaggtcacccagttgatcatccttgcactcatgtccatgactgtgtttctcagaataaagatgccccatgggcagattgctgatggcaccaaattctttggggctctgacttttggtttaataacaatcatgttcaatgggttcgctgagctacaattaaccataaagaagcttccagttttctacaaacatagggatttcttattcttccccgcttggaccttaggagtggcaaacataatcttaaaagttcctgtctcgttcgtggaatcagcagtatgggttgttctcacgtactatgtgatgggctttgcacctgctgcaggaaggttctttcgtcagtttatagctttctttgccacacaccaaatggcaatggctttattccggtttcttggtgctgttttgaaaacaatggttgtggccaatacttttgggatgtttgtgctgctcattattttcatctttggaggatttgtcatccgtagaaatgacatcagaccatggtggatctggggttactgggcatcacctatgatgtatagccaaaatgcaatatcggtcaacgaattccttgccagtaggtgggctattccaaacaatgacacgactatcgacgcgccaacagtaggcaaagcaattcttaaatccaaaggcttgtttactggagaatggggattttggctttccattggagccctcataggattcattattttgttcaacatgctctacctttgggcccttacatatttaagtcgcactaatggaggaacaaacacgctagctcaatcacgagtcactttgcctttccagcctcttgcactttgctttaaccatgtaaactattacgtcgacatgcctgcagaaatgaaggaacaaggattcacagaaagccgtttacaactactctctgatatcagtggcacttttaggccaggggttctaacagcactggttggtgtgagtggagctggaaagaccactttaatggatgtcctggcaggaaggaaaactagtggagctattgaaggagatattaccctgtcgggataccccaaaaaacaagaaacttttgcccggattagtggttattgtgaacaaactgatatccattctccaaatgttactgtatttgaatccatcacctactctgcttggttgcgtctttcctcagatattgatgatggtacaaaaaagatgtttgtggaggaagtgatggcccttgtagagcttgatgtgttgcgcgacgctctagtgggtctccctggagttagtgggttatcaactgagcaaagaaaaaggctgacaattgctgtggagctggtagcaaacccttcaatcatcttcatggatgaaccaacttctggtcttgatgctcgagctgcggcaattgtcatgcgtacacttctgcttttgaaacgtggaggtcaggttatttatgctggtgaacttggtcgccactctcacaaactagttgaatattttgaggcgattccaggtgttccaaagatcacagaaggatataatcctgcaacatgggtgctggaagttagttctcctctatctgaggctcgattgaacatgaattttgctgaaatttatgcaagctctgtgctttataggaaaaatcaagaggttatcaaggagttgagtattccccgatcagacaaccaggacctgtcatttcctacaaaatattcacagaatttctacggtcaatgtgccgcaaacttttggaagcaataccgttcgtactggaagaatccaccctacaatgctatgcgctatctgatgacatgtctctttggccttgtatttggtacagtattttggcaaaaaggaaagaacatagattcacaacaagatttatataatctgcttggagccacttacgctgctacattctttcttggggcttcaaattgcatcacggttcagcctgttgtatcgattgagcgagcagttttctaccgtgagaaggcagcggggatgtactctccgttatcctatgcatttgctcagacatgtgtggaggtcatctacaccatcttacaggggatactgtacacagtcatcatatatgcgatgatcggatacgactggaaagcggataaattcttctatttcctgtttttcatcactgcaagcttcaactacttcacattgttcggcatgatgttggtagcatgcactccctccgcattgctcgcgaacattctcatcacgtttgctctacctctgtggaacctctttgctggattcctcatcgttagaccggcaataccaatttggtggaggtggtactactgggcgaaccctgtgtcgtggaccatctatggcgttgttgcgtctcagtttggcgagaacgaaggtgagctttcagttcccggtgggacgcccgtggtggtgaagcagttcttgaaggataatctcggcatccagcatgacttactcggctatgttgtgctcgtccatttcgcctacgtcattgtgttcttcttcgtattcggttattccatcaagttcttcaacttccagaaacgttagcgggatcatttgtatgtaattaatcggtcgccgtaagttctagttctagttctagttctagtcaaagcaagtgcttgtttaggaggaagcctgtatgcaagtagcagtgtattcctcttgtttcttcaatgcaaaaatattaaaagaaagatgacgaatgcaaaagtgacatgtcttgttccttttcttcttga

SEQ ID NO: 1587 - DNA, 4161 bp, Zea mays
gcggggctggcgtcgacgtctagccgtcggagcctcagcttggggtcctccatctcgcagtcgttccggcagatggacagtacggatgaccccttcgcgcgggcacagtcggagcatgagcaccgggacgacgacgaggagaacctgcgctgggccgcgctgcagaagctgcccacctacgaccgcatgcgccagggtatcctccgccgggcgctcgacgaccaagaacagcagagcggagacggcgacgtcgaggtcgtcgacatccacaagctggccgccggcgacgggggccgtgcgctcttggagcgcctcttccaggaggacagcgacccattcctgcgccggctcagggacagaatcgacatggttggcatcgagctccccaccgtggaagttcgctacgagcagttgacggtgcaggctgacgtggttgctgccggccgcgccctccccacgctctggaacgcggccaccaattttctccagggtctcattggacggtttggttcctcaaacaagaggaacatcaccatacttaagaatgtcaatggtatcctcaagccatccaggatgacgcttcttcttgggcctccatcctcagggaagagcacactcatgcgagcactcgctggcaagcttgacaaaaatctcaaggtctctggcaacatcacatattgtggccatccaatttcagagttctatccagagaggactagcgcatatgttggtcagtatgatctccataacgccgagatgactgtaagagagacgcttgatttctccaggcggtgcctaggcgttggtgccagatatgagatgattgcagaacttgctagaagggagcgggatgcaggcattaagccagatcctgagattgatgctttcatgaaagctactgcagtacaaggacaggagacaaatattataacggatttcactctcaaggtgcttgggctggacatttgtgctgatgttattattggcgatgagatgatcagaggaatttctggcgggcaaaagaaacgtgtgacaactggggagatgctaacagggacagcaagggctttatttatggacgagatatccactggtttggatagctcaagcacatttcagattgtaaagtttatgaggcaattggtccatgtcatgaatgaaactgtcatgatctctctgctccagccaccgccagagacctataatctttttgatgacataatcttgctatcagaaggatacatagtgtaccatgggccacgcgagaatatcctggagttctttgagtctgccggttttcggtgccctgacaggaaaggtgtcgctgactttcttcaagaggttacttccaagaaagaccaacaacagtactggtatcttgatcaggagcagtatcgttatgtatctgtacccgactttgccgaacgtttcaaatcattccatgcttgccagcagatgcacaaggagttgcaaataccttttgacaagtccaaaacccatcctgctgccttgaccaccacaaaatatgggctttccagctgggaatcattcaaggtagtgatgtcaagagagcagctattgatgaagcgcaactctttcgtctatattttcaaggtcacccagttgatcatccttgcactcatgtccatgaccgtgttcctcagaataaagatgccccatgggcagattgctgatggcaacaaattctttggggctctgacttttggtttaataacgatcatgttcaatgggttcgctgagctacaaatgacaataaagaagcttccagtcttctacaaacatagggatttcttattcttccccgcttggaccttaggagtggcaaacatactcttaaaagttcctatctcattcgtggaatcactagtatgggttgttctcacatactatgtgatgggctttgcacctgctgcaggaaggttctttcgtcagtttatagctttctttgccacacaccaaatggcaatggctttattccggtttcttggagctgttttgaaaacaatggttgtggccaatacttttgggatgtttgtgctgctcattattttcatttttggaggatttgtcatacgtagaaatgacatcaaaccatggtggatctggggttactgggcatcacctatgatgtatagccaaaatgcactatctgtcaacgaattccttgctagtaggtgggctagtccaaataatgacacgattattgacgcgccaacagtaggcaaagcaattcttatatccaaaggcttgtttactggagaatggggattttggctttccattggagcccttgtaggattcattattttgttcaacatgctctacctttgggcccttacatatttaagtcgcactaatggagcgacaaacacagtagctcagtcgtcacgagtcactttgcctttccagcctcttgcactttgcttcaaccatgtaaactattacgtcgacatgcctgcagaaatgaaggaacaaggattcacagaaagccgtttacaactgctctctgatatcagtggcacttttaggccaggggttctaacagcactagttggttttagtggagctggaaagaccactttaatggatgtcctggcaggaaggaaaactagtggagctattgaaggagatattaccctgtcgggataccccaaaaaacaagaaacttttgcccggatcagtggttattgtgaacaaactgatatccattctccaaatgttactgtatttgaatccatcacctactctgcctggctgcgtctttcctcagatattgatgatgatacaaaaaagatgtttgtggaggaagtgatgacccttgtagagcttgatgtgttgcgcgacgctcttgtgggtctccctggagttaatgggttatcaactgagcaaagaaaaaggctgacaattgccgtggagctggtagcaaacccttcaatcatcttcatggatgagccaacttctggtcttgatgctcgagctgctgccattgtcatgcgtacacttctgcttttgaaacgtggaggtcaggttatttatgctggtgaacttggtcgccactctcacaaactagttgaatattttgagtcgatttctggtgttccaaagatcacagaaggatataatcctgcaacatgggtgctggaagtcagctctcctctatcggaggctcgattgaacatgaattttgctgaaatttatgcgaactctgtgctttataggaaaaatcaagagcttatcaaggagttgagtatccccccaccagactaccaggacctgtcatttcctacaaaatattcgcagaatttctacggtcaatgcgtcgcaaacttttggaagcaatgccgttcctattggaagaatccgccctacaatgctatgcgctatctgatgacatctctctttggccttgtatttggtacagtattttggcaaaaaggaaagaacatagattcacaacaagatttatataatctacttggagccacttatgctgctatcttctttcttggggcttcaaattgcatcactgttcagcctgttgtatcgattgagcgagcagttttctatcgtgaaaaggcagcggggatgtactctccattatcctatgcatttgctcagacatgtgtggaggtcatctacaccaccttacaagggatactgtacactgtcatcatatatgggatgatcggatatgactggaaatcagataaattcttctatttcctgtttttcatcactgcaagcttcaactacttcacattgttcggcatgatgttggtagcatgcactccctctgcattgcttgccaacattctcatcacctttgctctacccttttggaacctctttgctgggttcctcatcgttagaccggcaataccaatttggtggaggtggtactactgggcgaaccctgtgtcgtggaccatctacggtgttgttgcgtctcagtttggcgagaaccaaggtgagctttcagttcccggcgggaagcccatgctggtgaatcaattcttgaaggataatctcggcatccagcatgacttactcggctatgttgtgctcgtccatttcgcctacgtcattgtcttcttcttcgtattcggctattccatcaagttcttcaacttccagaaacgt

SEQ ID NO: 1588 - DNA, 4569 bp, Oryza sativa
atggcgggggagataaccccgtcggggagccggcggagctggctgtcgtcgggggcggcgtcgctggcgcggtcgctgcgcgacggggacgacccgttccggcggtcggcggcggcgagccggcgcgacgccggggacgacgaggagaacctgcggtgggcggcgctggagaagctgccgacgtacgaccgcatgcgccgcggcatcctccgcaaggcggtggacggcggcggcgacggcgagggggccgggtcgctgttcaaggccgacgaggtggacatcgccaacctcgacccgcgcgagggccgcgagctcatggagcgcgtcttcaaggccgtcgaggacgacaacgagcgcttcctccgccgcttccgcgaccgcctcgaccaggttgggattgagctgccgaagatcgaggtgaggtaccagcatctggacatcgaggcggacgtgcacgtcggcaagcgcgcgctgcccacgctgctcaacgccaccatcaacacgctagagggtctcgttagcctatttatctcgtcgaacaagaggaagcttaagatactcaacgatgttaatggcattatcaagccatcaaggatgactcttcttctcgggcctccatcgtctggaaaaagcacacttatgcgagcactaaccggcaagcctgataaaaatctcaaggtgtctggcgagatcacatactgtggtcatacgtttaaagagttctatcctgagaggactagtgcttacgtcagtcagcatgatctgcacaatcctgagatgacagtaagagagacactggatttctcgagacgatgccttggaagtggtgccagatatgatatgctgtcagaattaacaagacgggaacgtaatgcaggcattaaacctgaccctgagattgatgctttgatgaaggcaactgtagtagaaggaaaacagaacaatattgtcacagatcttgttctgaaggcgcttggactggacatttgtgccgatactattgttggtggtgctatgataagaggcatttctggtggtcaaaagaaacgtgtgactactggggagatgctcactggaccagcaacagctttgttcatggatgaaatatctactgggcttgatagttctagcacatttcagattgtcaaatacatcagacaggtgacccatgtgatgaatgctacagtgatgatgtctctcctacagcctccacctgagacctatgctttattcgatgacatcgttcttatagcagaaggttacatagtctaccatggaccacgggagaacatacttgaattctttgagagtgctggttttcggtgtcctgaacggaaaggagtggccgactttcttcaagaggtgacttctaggaaagatcaacagcaatactggttccttgagcaggatcattatcgttatgtgtcagtcgaagagtttgctcagaatttcaagaaatttcatgttgggcaaaagctgcagaaagagcttcaagttccctatgacaaatctaagacacatcctgctgcattgactaccaagaagtatgggttatctagtctagagtcccttaaggcagtgatgtcaagagagtggttgctaatgaagcggaattcattcctcttcatattcaaggcctttcaactgtttgtccttggatttataaccatgactctgtttttgagaacaaagatgccccacgagaaattttctgatacctctaaatatgttggtgctttaactgcttctttgattacaatcatgttcaatggttttggtgaacttcaattgactatagataaactcccgatattctacaaacaaagagacttcctgttctttccagcatggacctatggacttgcaaacatcattctgaaggtgcctttatcccttatggaatcatctctttggatagttttgacatattatgttgtgggttttgcacctgctgcaggaaggttcttcaagcagtttcttgcatacttttggacacaccagatggccttggccttgttccggttgctaggtgcaattttaagatcaatggtggtagctaatacatttggcatgtttgtgctgctacttattttcctctttggaggatttctcgtttccagaaaggacattaaaccgtggtggatatggggctactggacatctcccatgatgtatagcaataatgccttatcagttaatgaattccttgccagtaggtgggccattccaaacaatgactcaagtatcagtgcaccaacaatagggaaggcttttcttcaatccaaaggctacttcacaggagaatgggggtattggctttccattggagccatgataggatttatgattgtttttaacattctctacctttgtgctcttacattcctaagacctattggcagtgcaagcactgttgtttctgatgatgacaccaaaagtgagctcgaagcagaatctaatcaggaacaaatgtcagaggttattaatggtacgaatggaacagaaaacagaagaagccagagaggaatggtcttgccattccagcctctttccctttctttcaaccatatgaactactacgttgacatgcctgctgaaatgaaagcacaaggattcacagaaagccgcctccaactactatctgatattagtggtgcattccgaccaggtgttctaacagcactagttggtgtcagtggagctggaaaaaccactctaatggatgtactggcaggaagaaagactagtggaacgattgagggagatatcaagctttctggttaccctaaaaaacaagaaacctttgctcgcatcagtggctattgtgaacaaactgatatacattcaccaaatcttactgtatatgaatccattgtttattctgcttggctgcgcctttcctcagaagttgataagaacaccaggaaggtgtttgtggaggaagtgatgtcactagttgagcttgatgtattgcgtgatgctctggttggtctccctggtgttagtgggttgtcaactgaacaaaggaagaggctgacaatcgcagtagaactagtggcaaatccttcaattatcttcatggatgaaccaacttcaggtcttgatgctagagctgcagcaattgttatgcgtactgtgagaaatacagttaacacaggacgaactgtggtttgcacaatccatcaacctagcattgatatctttgagtcttttgatgagcttctgttgctaaagaggggaggacgggttatatatgctggccagcttggtctccattcacaaatactagtcgaatatttcgaggcaattccaggggtcccaaaaatcacagaaggatataacccagcaacatggatgcttgaagttagctcttctctagctgaggctcgtctggacatagactttgctgaagtttatgccaattctgcactttaccggagcaatcaagaacttattaagcagctgagtgttccacctccaggcttccaggatctctcatttcctaccaaatattcccagaatttcctaaatcagtgtgtggcaaatacatggaagcaatttcaatcttattggaaggatccaccctacaatgctatgcgttatgttatgacgcttctctatggtcttgtgtttggtactgtcttttggcggaggggaaagaatatagagtccgtgaatgatctgaacaatctacttggagccacctatgctgctgttttcttccttggagcagcaaatttgctcacacttttgcctgtggtgtcagttgagaggacagtcttttaccgtgaaaaggcagcagggatgtactctccactgtcttatgcgtttgcacaaggatttgtcgagttctgctacagtgcagttcaaggtgttctttacactatcctcatctattccatgattggctatgagtggaaggcggacaagttcttctacttcctgttctttatgattgcggccttcgcctacttcacattgtttagcatgatgctggttgcgtgcactgcttcggaaatgcttgcggccgttcttgtttcatttgtgctctcctcgtggaacaattttgccggattcattataccccgtccactgattcctgtttggtggagatggttctattgggccaacccggtctcctggaccatctatggagtgattgcgtcgcagtttgcggacagcgaccgtgttgtcaccgttcctggccaatctaccaccatggtggtgaaggatttcttggagaagaacatgggctttaagcacgacttcctcggctacgttgtgctggctcatttcggctacgtcatcatcttcttcttcctctttggatacggcatcaagtgcttgaacttccagaaacggtaggaggccggtgtccagcaggatgtcaatccgaggtcacgtttttggagtgtaaagcaaatgtagcaacttaataccgatgctttttttgtgtagatatatagtctgttcgatatctgctagcttgtattgacacttaatgtacaacattatttactcaaatgttctgagtttatggtatattattctttttctatgttatcgcca

SEQ ID NO: 1589 - DNA, 2378 bp, Triticum aestivum
ctcttctcggcacactactccccccacttctcccccgcatcgcctcccccgacatggcgatcaccggcggcccgcgcggccgcctcctcctcctccccctcttcctcgtcgccgccgccgtatgcctcgtctccacccccgcccgcgccttctacctccccggcgtcgccccccgcgacttccagaaggatgatgatctccaggtgaaggtcaacaagctgtcatctataaagacacaacttccatatgactattatttcctggactactgcaaacctgaggcgattaagaacagtgctgagaacttaggggaagtccttcgtggggaccgcattgaaaactctgtctataatttcaagatgaggagggacgagagttgcaaagttgtttgtcgaacaaagctgtctgcagaagctgcaaagaatttcagagagaagatcgatgatgaatatcgagtgaacatgattttggataatctcccagttgtggtccctaggcagacacgggaagggagccaaccgatctttgatcatggttaccgcgttggctataagctcaaggatgacaagtactatattaacaatcacttgagctttaaagtcttgtaccatgaagacctaaactccccagaggctcgtattgttggcttccatgtgattcctagcagcattaaacatgaatatggtgcctgggatgacaagaatcctacagtacaaacctgcaacgctaacacgaagataactcctggtagtcacacacctcaagaggtggcccctgatgcatatgttgtattctcttacgacgttacctttgagtctagtgagatcatatgggcatctcgctgggatgtctaccttctttccagtgacagccaaatccactggttctcgatcattaactccttgatgattgtccttttcctttctggcatgatagccatgattatgatgaggaccctttacaaggacatagcaaactataatcagcttgacaatcaggaggaggcccaggaagaaactggatggaagttagtgcatggtgatgccttcaggcctcctgttcattcaggtcttctttgcgtttatgttggaactggtgtgcagttctttggcatgacagtggtaaccatgatgtttgcgctacttggattcttatcccctgcaaaccgtggaggactcatgactgctatggtccttctgtgggttttcatgggtgtattggcgggttacacgtcgtctcgcctctacaagatgttcaagggcaccgagtggaagaagatcaccctcaaaactgccttcatgtttcctggtataatctttggggtctttttcgtcctgaatgcccttatctggggtgagaaatcatctggtgcagttccttttgggacaatgtttgctctggtccttctctggtttggcatctccgtgccactggtctttgttggaagtttcttgggattcaagcagccagccattgaggacccagtcaagacaaacaagattcccaggcaaattcccgagcaagcatggtacctgcagccagctttctcgatacttgctggtggcatattgccatttggtgctgtcttcattgagctcttcttcatcctcacatctatctggctgaaccagttctactacatctttggcttcctcttcatagtcttcgtcattctcctggtaacctgtgctgagatcacaattgtgctctgctacttccagctatgcagcgaggactaccactggtggtggagagcctacctgaccgcaggctcttcagctctatatcttttcgcttatgctatcttctacttcttcaacaagttggagatcacaaagcttgtttcaggcattctctactttggttacatgctgatcatttcttatgccttcttcgtcctgactggcaccattggcttctatgcttgcttctggtttgtgaggaagatctatgcttctgtgaagatcgactgatgtagcaacttccaagataagtttcctgtctgcttctagagactctcccggacaaggttttcttgcaatatcatacatgctgctgttcaagtgacatatatgaaggaaactgggatttgagatgggattccatggttttggtagaatatgtagcctggtaggagtaagaatcaccggatgttcacggatgttgaagagagaatttgatactcgttgcagattagcatgtcttgtaattctaaagatattgagtgctcctgtactgtttcggatctcgattgaccatgtctgttccatttgtgttttatgtcttacacgcagtacgctggacatggcactatttcttagtgcataactttctcgttggttgaatgatttcattcgatattaccctggtgctgagct

SEQ ID NO: 1590 - DNA, 2312 bp, Triticum aestivum
ggagttccccaccaccagggcaggcaccaccaccccaccccatatttctcttctcggcacactactcccccacttctcccccgacatggcgatcaccggcggcccgcgcggccgcctcctcctcctccccctcttcctcgtcgccgccgccgtatgcctcgtctccacccccgcccgcgccttctacctccccggcgtcgccccccgcgacttccagaaggatgatgatctccaggtgaaggtcaacaagctgtcatctataaagacacaacttccatatgactattatttcctggactactgcaaacctgaggcgattaagaacagtgctgagaacttaggggaagtccttcgtggggaccgcattgaaaactctgtctataatttcaagatgaggagggacgagagttgcaaagttgtttgtcgaacaaagctgtctgcagaagctgcaaagaatttcagagagaagatcgatgatgaatatcgagtgaacatgattttggataatctcccagttgtggtccctaggcagacacgggaagggagccaaccgatctttgatcatggttaccgcgttggctataagctcaaggatgacaagtactatattaacaatcacttgagctttaaagtcttgtaccatgaagacctaaactccccagaggctcgtattgttggcttccatgtgattcctagcagcattaaacatgaatatggtgcctgggatgacaagaatcctacagtacaaacctgcaacgctaacacgaagataactcctggtagtcacacacctcaagaggtggcccctgatgcatatgttgtattctcttacgacgttacctttgagtctagtgagatcatatgggcatctcgctgggatgtctaccttctttccagtgacagccaaatccactggttctcgatcattaactccttgatgattgtccttttcctttctggcatgatagccatgattatgatgaggaccctttacaaggacatagcaaactataatcagcttgacaatcaggaggaggcccaagaagaaactggatggaagttagtgcatggtgatgccttcaggcctcctgttcattcaggtcttctttgcgtttatgttggaactggtgtgcagttctttggcatgacagtggtaaccatgatgtttgcgctacttggattcttatcccctgcaaaccgtggaggactcatgactgctatggtccttctgtgggttttcatgggtgtattggcgggttacacgtcgtctcgcctctacaagatgttcaagggcaccgagtggaagaagatcaccctcaaaactgccttcatgtttcctggtataatctttggggtctttttcgtcctgaatgcccttatctggggtgagaaatcatctggtgcagttccttttgggacaatgtttgctctggtccttctctggtttggcatctccgtgccactggtctttgttggaagtttcttgggattcaagcagccagccattgaggacccagtcaagacaaacaagattcccaggcaaattcccgagcaagcatggtacctgcagccagctttctcgatacttgctggtggcattttgccatttggtgctgtcttcattgagctcttcttcatcctcacatctatctggctgaaccagttctactacatctttggcttcctcttcatagtcttcgtcattctcctggtaacctgtgctgagatcacaattgtgctctgctacttccagctatgcagcgaggactaccactggtggtggagagcctacctgaccgcaggctcttcagctctatatcttttcgcttatgctatcttctacttcttcaacaagttggagatcacaaagcttgtttcaggcattctctactttggttacatgctgatcatttcttatgccttctttgtcctgactggcaccattggcttctatgcttgcttctggtttgtgaggaagatctatgcttctgtgaagatcgactgatgtagcaacttccaagataagtttcctgtctgcttctagagactctcccggacaaggttttcttgcaatatcatacatgctgctgttcaagtgacatatatgaaggaaactgggatttgagatgggattccatggttttggtagaatatgtagcctggtaggattaagaatcaccggatattcacggatgttgaagagagaatttgatactcgttgcagattagcatgtcttgtaattctaaagatattgagtgctcctgtactgtttcggatctcaattgaccatgtctgttccatttgtgtttta

SEQ ID NO: 1591 - DNA, 2282 bp, Brachypodium distachyon
cccattctcttctcgcacagacacagccggtcagccccaacgtcgcgtcgcgtggtcgcgccctccaccatggcgatcaccggcggcccgcgccgccgcttactcctgcccctcatagtctgctccatttttctcgcgtcctccccggcccgcgctttctacctccccggcgtcgccccccgtgacttccagaaggatgacgatctccaggtgaaggtcaacaaactgtcatctataaaaacacaacttccatatgactactatttcctggactactgcaaacctgaggcgattaagaatagtgctgagaacttaggggaagtccttcgtggagaccgcattgaaaattccgtctataatttcaagatgaggagggatgagagttgcaaagttgtttgtcgaacaaagctttctccagaagctgcaaagaatttcaaagagaagattgatgatgaatatcgagtgaacatgattttggataatctcccagttgtggtccctaggcagacacgggaaggaagccaaacaccaagctttgagcatgggtaccgagttggctacaagctcaaggatgacaagtactatatcaacaatcacttgagttttacagtcttgtaccatgaagacctaaacgccgcagaagctcgtattgttggcttccatgtgattcctagcagcattaagcatgaatatggtgcctgggatgacaagaatcctacagtgcaaacttgcaatgctaacactaagataactcctggtagtcatacacctcaagaggtggcccctgaggcatatgttgtattctcttatgacgttatctttgaggctagtgagatcatatgggcatctcgctgggacgtgtaccttctttccagcgacagtcaaatccattggttctcaatcattaactcattgatgattgtccttttcctgtctggcatgatagccatgattatgatgagaaccctgtacaaggacatagcaaattataatcagctagacaatcaggaggaggcccaagaagaaactggatggaagttagtgcatggtgatgccttcaggcctcctgttcattcaggccttctttgtgtttatgttggaactggtgtgcagttctttggtatgacagtagtaaccatgatgtttgcactacttggattcttatcacctgcaaaccgtggagggctcatgactgctatggtccttttgtgggttttcatgggtgtattggccggctacacatcatctcgcctctacaagatgttcaagggcactgaatggaagaagatcaccctcaaaactgccttcatgtttcctggtataatctttggggtcttttttgtcttgaatgcccttatctggggtgagaaatcatctggtgcagttccttttgggacaatgtttgctctgtttctcctttggtttggcatctctgtgcctctggtctttgttggaagtttcttgggattcaagcagccagcaattgaggacccagtcaagacaaacaagattcccaggcaaattcctgagcaagcatggtacctgcagccagctttctcgatacttgctggtggcatattgccatttggtgctgtatttattgagctcttcttcatcctcacatctatctggctgaaccagttctactacatctttggcttcctcttcatagtctttgtcattctcctggtaacgtgtgctgagatcacaattgtgctctgctacttccagctatgtagcgaggactaccattggtggtggagggcatacctgacagcaggctcttcagctctatatctatttgcttatgctatcttctacttcttcaataggctggagatcacaaagcttgtttcaggcattctatattttggttacatgctgatcatttcttatgccttctttgtgttgactggtactattggcttctatgcttgcttctggttcgtgaggaagatctatgcttctgtgaagattgactgacggatcaaccgccgagagaaacttgtctgctagtagagcatcaacctggctaaggatgtgttacaaggctaaggatgtgttacaatgtgatacttggtgatgttcgatgtcatatatgaagaaaacagatctgaggtggagttccatggttttggtagaacatgtagcctggtaggaagaatcgccgaatgttcaagagagatcttgatactctctcagtgtagcatggattatgtacttctaaggatattgaatgcttgtaatgttccatatgttgttttaccatgcatgttccattt

SEQ ID NO: 1592 - DNA, 2263 bp, Sorghum bicolor
gcccatcccgctcctttctccgcccgcacgcctccgggacccggccccaaccatggcgacccacggcggcggcccgcgcccctgccacctcctcatcctcctcgccgccgccgcgctctactccgcgtcctcccccgccggcgccttctacctccccggcgtcgccccccgcgacttccagaaggatgatgaacttcaagtgaaagtcaataaattgtcatctataaaaacacagcttccatatgactactatttcctggattactgcaaacctgaggcgattaagaacagtgctgagaacttaggcgaagtccttcgtggggaccgcatcgaaaattctgtctacaatttcaagatgaggagggatgagagttgcaaggttgtttgtcgaaagcagctttctcaagaagctgcgaagaatttcaaagaaaagattgatgatgaataccgagtaaacatgatcctagataatcttccagttgtggtacctaggcagacacgggaaggaagccaaacaccaagctttgaacatggttaccgagtaggttacaagctcaaagatgacaagtattatatcaacaatcacttgagttttaaagtgttgtaccatgaagaccaaacttctcctgatgctcgcattgttggcttccatgtgattcctagcagcatcaagcatgaatatggtgcctgggatgacaataatcccacagcgcaaacttgcaatgctaacattaagattacacctggtagtcacactcctcaagaggtggcccctgatgcatatgttgtattctcttatgacgttacttttgagtccagtgatatcatatgggcatctcgatgggatgtataccttctttccagtgatagtcaaatacactggttctcaattgttaactcattgatgatcgtcctattcctttctggtatggtggccatgatcatgatgagaactctttacaaggacatagcaaactataatcagcttgacaaccaggatgaggctcaggaagaaactggatggaagttagtgcatggtgatgtattccggcctcctgttcactcaggcctcctttgtgtctatgttggcactggtgttcagttctttgggatgacacttgtaaccatgatgtttgctcttcttggattcttatcgcctgcaaaccgtggaggacttatgactgctatggtccttttgtgggtgttcatgggtgtattggcaggatacacctcatctcgcctgtacaagatgttcaaaggcactgaatggaagaagatcaccctcaaaactgccttcatgtttcctggtattatcttttcggtcttcttcttcctgaatgcactgatctggggtgagaaatcatctggtgcagttccttttggaacaatgttcgcattgttcctcctctggtttggcatctctgtgccactggtctttgttggaagtttcttgggattcaagcagccagccattgaggacccagtgaagacaaacaagattcccaggcaaattcctgagcaagcatggtacctgcagccagcttttgcaatactagctggcggcatattgccatttggggctgtctttattgagctcttcttcatcctgacatctatctggctgaaccagttctactacatctttggcttcctcttcatagtctttgtcatcctcattgtgacatgtgctgagatcacaattgtgctatgctacttccagctgtgcagtgaggattaccactggtggtggagggcatacctgactgcaggctcgtcagcactctatttgtttgcttatgctatcttctacttcttcaataagttggagatcacaaagctcgtctcaggcatcctgtactttggttacatgctgatcatctcttatgccttctttgtgctgactggtaccattggcttctatgcctgcttctggttcgtgaggaagatatatgcttctgtgaagatcgactgattaaacaaccagtgtctagagaaaccttttttctgctcatagagtaccttctaccaaggttttgctgcaatgtcgtgcatggtgctgctggattgacatataaaggaaactggggttctggatgggattccatgggttttggtagaatatgtgtagcctgttaggagcaagaactggtggaagttcaagtgcgatctagatacgcgatgttgtagtgcaacatggattttgtacgcctaaagatgttcagtgctgcattgtaatataccttgatttgccctgcttgttcca

SEQ ID NO: 1593 - DNA, 3126 bp, Oryza sativa
acacacccccgcatgctcctctctctctctcataaactcgcatctcccgagtccccacctcaccgacctccaccacacctcgccatcctcctcccttgtcgcgcacacttccccactcgcctccgcctcgcccccccatggcgatcgccggcggcacgggctgccgccgcggcctcctcctcccgcccctcctcttcgcggcggccctcctgctctccgccgcctcccccgcccgcgccttctacctccccggcgtcgccccgcgcgacttccagaaggatgatgagcttcaagttaaagtcaacaagctttcgtctacgaagacacaacttccatatgactactattttctagactactgcaaacctgaggcaattaagaatagtgctgagaacttaggggaagtccttcgtggggatcgcattgaaaactctgtctataatttcaagatgaggagggatgagacctgcaaggttgtttgtcgatcaaagctttctccagaagctgcaaagaatttcaaagaaaagattgacgatgagtatcgagtgaacatgattttggataatctcccagttgtggtgcctagacaaacaagggaaggaagccaaacaccaagctttgagcatggttaccgagttggttataagctcaaggatgacaagtattatatcaacaatcacttaagttttaaagtcttgtatcatgaagacccaaactctcctgatgctcgtattgttggcttccatgtgattcctagcagcattaagcatgaatacagtgcttgggatgacaagaaccctacagtgcaaacttgcaatgctaacaataagataactcctggtagccacacgcctcaagacgtggttcctgaagcatatgttgtattctcttatgatgttacctttgaggctagtgagatcatatgggcatctcgttgggatgtctatcttctttcaagtgatagccagatccattggttctcaatcattaactcactgatgattgtccttttcctttctggcatggtagccatgatcatgatgagaactctttacaaggatattgcaaactataatcagcttgacaaccaggatgaggcccaggaagaaactggctggaagttagtgcatggtgatgtcttcaggccacctgtccactcaggcctcctttgtgtttatgttggaactggtgtgcagttctttggaatgacactggtaaccatgatgtttgcgctacttggattcttgtcccctgcaaaccgtggtggactaatgactgctatggtccttctgtgggtgttcatgggtgtattggcaggatacacctcatctcgcctatataagatgttcaaaggcactgaatggaagaaaatcaccctcaagactgcctttatgtttcctggtataatctttgcactctttttcttcctaaatgccctgatctggggtgagaaatcatcaggtgcagttccctttggaacaatgtttgctctgttcctcctttggtttggcatctctgtgccgctagtctttgttggaagtttcttgggcttcaagcagccagccattgaggacccagtgaagacaaacaagattcccaggcaaattcctgagcaggcatggtacctgcagccagctttctcaatacttgctggtggcatattgccatttggcgctgtcttcatcgagctcttcttcattctgacatcaatctggctgaaccagttctactacatcttcggcttcctcttcatagtcttcatcatcctcatcgttacttgtgctgagatcacaattgtgctctgctacttccaactatgcagcgaggactatcactggtggtggagagcatacctgactgctggctcttcagcactgtatctttttgcttatgccatcttctacttcttcaacaagctggagatcacgaagcttgtttcaggcattctctactttggttacatgctgatcatctcgtatgctttcttcgtgctgactggtaccattggcttctatgcttgcttctggttcgtgaggaagatatatgcttctgtgaagatcgactgatgagacagctcgaaacatcatctgctacaaatgtgatacaatggtgtctcccaattaacatatataaatggaagtgggatgtgcgaccggattggatggtttttggtagaacatgtagtctggtaggaggtaagaattgcctgatgttcaagagagttcttgatactccctgtagcgtgacatgaattttgtaactctgaagatgtttgagtgcttcttgtaatattccatgtctctttatcttacggcttcacatatttctttttctggagatttgaggcatatcacattcgaacatacgtactttatcatggtttgctatccactagctggagatttgcttgtgctgggtgtccactctttgccagcaacaccgtgcaatatttttggtgtacattgcaacaatattacacaatcatcttaattagcaaacatggacattatttcttagttacatgagattattgagcatgcatatgaccaaacaatctaaaccactcttcatcagtgagtgatcttatttcgcagtggccaatcacaatgttacggcaaaaatggcatttaactggaatgggcatgctgaggaggagctcatggcgccggcgccggcgacggaggcagcggcgttgccggggtgagcggcgtggcggccgtcctggcgacgaggccgcacgccatggcgtccttgggcacgtcgagctcgtgcatcctgtcctccccctcgacgaagacgacgcccatgcccatgtggaggtgcggctcgatgtggcagtggaacgcccacgcgccggtgttgttggcgacgaaccgaagcgccgtccacccgtgcgggaagaccaccgccgtgttccgcagcggcgggtcggcggcgttgagccccgccgcgtgcgccgccgggtcgtaccggccgtcgccgtagccgagcacccagaagtcgtggccgtggaggtgccacgggtgcgtctcgctcacctcctccctcagcatgttggcgttctggagcaccacgtccaccacgccgccgtgtcgcagccggaacaccctgtcgctcgccgtcgtc

SEQ ID NO: 1594 - DNA, 2267 bp, Panicum virgatum
acctccctcgccccgcccatcccactcttttccccgtccaacgccaccgggccgcgcacccatggcgaaccccggcggcggcctgcgcccccgccacctcctcatcttcgtcgccgccgccgtgctctgcgccgtctcctcccccgccggcgccttctacctccccggcgtggcaccccgcgacttccagaaggatgatgagcttcagatgaaagtcaacaaactgtcatctataaagacacagcttccatatgactactatttcctggactactgcaaacctgaggcgattaagaacagtgctgagaacttgggtgaagtccttcgtggggaccgcatcgaaaattctgtctataatttcaagatgaggagggatgagagttgcaagattgtttgtcgaaagaagctttctcaagaagctgtgaagaatttcaaagaaaaaatcgatgatgaataccgagttaacatgattctagataatctcccagttgtggtacctagacagacacgggaaggaagccaaacaccaagctttgagcatggttaccgagttggttataagctcaaggatgacaagtattatatcaacaaccacttgagttttaaagtcttgtaccatgaagaccaaacttctcccgatgctcgcattgttgggtttcatgtgattcccagcagcatcaagcatgaatatggtgcctgggatgatgctaatcccacagcgcaaacttgcaatgctaacattaagattacacctggtagtcacactcctcaagaggtggcccctgatgcatatgtagtattctcttacgatgttacctttgaggctagtgatatcatatgggcatctcgctgggatgtctaccttctttctagcgatagccaaatccattggttctcaattgttaattcattgatgattgtcctattcctttctggtatggtagccatgatcatgatgagaaccctttacaaggacatagcaaactataatcagcttgacaatcaggatgaggcccaggaagaaactggatggaagttagtgcatggtgatgtattccgggcctcctggtccattcaggtctccttttgtgtttatgttggcaccggcgtgcagttctttgggatgacactagtaaccatgatgtttgcgctacttggattcttatctcctgcaaaccgtggaggactcatgactgctatggtccttttgtgggtgttcatgggtgtattggcaggatacacctcatctcgcctgtacaagatgttcaaaggcactgagtggaagaagatcaccctcaaaactgccttcatgtttcctggtattatctttgcggtcttcttctttttgaatgccctcatctggggtgagaaatcatctggtgcagttcctttcggaacaatgtttgctttgttcctcctctggttcggcatctctgtaccactggtctttgttggaagtttcttgggattcaagcagccagccattgaggacccagtgaagacgaacaagattcccaggcaaattcccgagcaagcatggtacctgcagccagcttttgctatacttgctggtggcatattgccatttggggctgtctttattgagctcttcttcatcctgacatccatctggctgaaccagttctactacatttttggcttcctcttcatagtcttcatcatcctcattgtgacctgtgctgagatcacgattgtgctatgctacttccaactatgcagcgaggattaccactggtggtggagggcatacctgactgcaggctcatcagcgctctatctgtttgcttatgctatcttctacttcttcaacaagttggagatcacaaagcttgtctcaggcatcctgtactttggttatatgctgatcatctcttatgccttcttcgtgctgactggtaccattggcttctatgcctgcttctggttcgtgaggaagatctatgcttctgtgaagattgactgatagaaccactctctagagaaacttagagcaccttgtttccaaggtattgttgcaacatcgtgcacgctgctgctcggttgacatataaaggaaactgggatttgagatgggattccatggttttggtagaatatgtgtagcctattaggagtaagaactgctggaagttcaaagtgagatcttgatacgtgatgatcaacatggaatttgtacctttaaagataattgagtttgtcttgtaatatgccttatcgtaattttcgttgcctgttccacctcaaga

SEQ ID NO: 1595 - DNA, 2219 bp, Setaria italica
ctcttccgatctcggcgccttctacctccccggcgtcgccccccgcgacttccagaaggatgatgagcttcaggtgaaagtcaacaagctgtcatccataaagacacagctcccatatgactactatttcctggactactgcaaacctcaagcgattaagaacagtgccgagaacttgggtgaagtccttcgtggggaccgcattgaaaattctgtctataatttcaagatgaggagggatgagagttgcaaggttgtttgtcgaaggaagctttctcaagaagctgcgaagaatttcaaagaaaaaatcgatgatgaataccgagtgaacatgattctagataatctcccagttgtggtacctagacagacacgggaaggaagccaaacaccaagctttgagcatggttatcgagttggttataagctcaaggatgacaagtattatatcaacaaccacttgagttttaaagttttgtaccatgaagaccaaacttctccagacgctcgcattgttggcttccatgtgattcctagcagcatcaagcatgaatacggtacctgggatgacaataatcccacagtgcaaacttgcaatgctaacattaagattacacctggtagtcacactcctcaagaggtggctcctgatgcatatgtagtattctcttatgatgttacctttgaggcaagtgagatcatatgggcatctcgctgggatgtctaccttctttctagcgatagccaaatccattggttctcaattgttaactcattgatgattgtcctattcctttctggtatggtggccatgatcatgatgagaactctttacaaggacatagcaaactataatcagcttgacaatcaggatgaggcccaggaagaaactggatggaagttagtgcatggtgatgtattccggcctcctgtccactcaggcctcctttgtgtttacgttggtactggcgtgcagttctttgggatgacactagtaaccatgatgtttgcgctacttggattcttatcaccagcaaaccgcggaggactcatgactgctatggtccttttgtgggtgttcatgggtgtactggcaggatacacctcgtctcgcctgtacaagatgttcaaaggcactgagtggaagaagatcaccctcaaaactgccttcatgtttcctggaattatctttgcgctcttcttctttttgaatgccctcatctggggtgagaaatcatctggcgcagttccttttggaacaatgtttgctttgttcctcctatggtttggcatctctgtgccgctggtctttgttggaagtttcttgggattcaagcagccagccattgaggacccagtgaagacaaacaagattcccaggcaaattcccgagcaagcatggtacctgcagccagcttttgctatacttgctggtggcatattgccatttggggctgtctttattgagctcttcttcatcctgacatccatctggctgaaccagttctactacatctttggcttcctcttcatagtcttcatcatcctcattgtgacctgtgctgagatcacgattgtgctatgctacttccagctatgcagtgaggattaccactggtggtggagggcatacctgactgcaggctcatcagcactctatctgtttgcttatgctatcttctacttcttcaacaagttggagatcacgaagcttgtctcaggcatcctgtactttggttacatgctgatcatctcttatgccttctttgtgctgactggtaccattggcttctatgcctgcttctggttcgtgaggaagatatatgcttctgtgaagattgactgattgaactactgtctagagaaacttagagcaccttgtttccaaggttttatttcaaggtcgcgcatggtgctgctcgattgacatatagaggaaactgggatttgagatgggattccatggttttggtagagtatgtgtagtccattaggagtaagaactgctggaagttaaagtgagatcttgatacgtgatgatcagcatggattttgtacctttaaagatattgagtgctgtcttgtaatatgccttatcatgattttctttgcatgttccaccacaccacgtgtgctgatattgtgctccagaatccagatcatagctgaacaggtggtcaagctttctcaccggcttgtgagtttgaaatctcgatcgt

SEQ ID NO: 1596 - DNA, 2537 bp, Brachypodium distachyon
atggcccccgcctggtcaggccttttcagactggggcccgggggtcgcgtgacggtcgcgcctggggcatcaatcatttccaggacagagatccaacgggtatggggagcggcgcgacagaaggagcatttacacttccttcgattctctccttgcaaaaccctccctaacccctccctgctctgcacaaggacacatgttctggtattcccgaaagcagcaaaaaggcgagtggttgatctccatcccctcgatttctttcccatcccctccccctccaagttcatcccctttgtcaagtattgttcatcgagcgcctcgggtaccaaaaccgggaagattttcatctcctccttacacaggaagtacctaaagtttggcgttcgattactgattccccgcaggacaaatctccgttcccctggcatgggagaacgctcaccctcgcccccactccgtccagcgccatccctaccccttcctcttgtctacaccaatgtgatcagaaccggggattctagctccgcgctgttcgatttgcttgtaagatcaaccggataccagtttcgatgggatgacgatctccaggtgaaggtcaacaaactgtcatctataaaaacacaacttccatatgactactatttcctggactactgcaaacctgaggcgattaagaacagtgctgagaacttaggggaagtccttcgtggagaccgcattgaaagttccgtctataatttcaagatgaggagggatgagagttgcaaagttgtttgtcgaacaaagctttctccagaagctgcaaagaatttcaaagagaagattgatgatgaatatcgagtgaacatgattttggataatctcccagttgtggtccctaggcagacacaggaaggaagccaaacaccaagctttgagcatgggtaccgagttggctacaagctcaaggatgacaagtacaatatcaacaatcacttgagttttaaagtcttgtaccatgaagacctaaacgccgcagaagctcgtattgttggcttccatgtgattcctagcagcattaagcatgaatatggtgcctgggatgacaagaatcctacagtgcaaacttgcaatgctaacactaagataactcctggtagtcatacacctcaagaggtggcccctgaggcatatgttgtattctcttacgacgttatctttgaggctagtgagatcatatgggcatctcgctgggacgtgtaccttctttccagcgacagtcaaatccattggttctcaatcattaactcattgatgattgtccttttcctgtctggcatgatagccatgattatgatgagaaccctgtacaaggacatagcaaattataatcagctagacaatcaggaggaggcccaagaagaaactggatggaagttagtgcatggtgatgccttcaggcctcctgttcattcaggccttctttgtgtttatgttggaactggtgtgcagttctttggtatgacagtggtaaccatgatgtttgcactacttggattcttatcacctgcaaaccgtggagggctcatgactgctatggtcctttcgtgggttttcatgggtgtattggccggctacacataatctcgcctctacaagatgttcaagggcactgaatggaagaagatcaccctcaaaactgccttcatgtttcctggtataatctttggggtcttttttgtcctgaatgcccttatctggggtgagaaatcatctggtgcagttccttttgggacaatgtttgctctgtttctcctttggtttggcatctctgtgccgctggtctttgttggaagtttcttgggattcaagcagccagcaattgaggacccagtcaagacaaacaagattcccaggcaaattcctgagcaagcatggtacctgcagccagctttctcgatacttgctggtggcatattgccatttggtgctgtatttatagagctcttcttcatcctcacatctatctggctgaaccagttctactacatctttggcttcctcttcatagtctttgtcattctcctggtaacgtgtgctgagatcacaattgtgctctgctacttccagctatgtagcgaggactgtcattggtggtggagggcatacctgacagcaggctcttcagctctatatctatttgcttatgctatcttctacttcttcaataagctggagatcacaaagcttgtttcaggcattctatattttggttacatgctgatcatttcttatgccttctttgtgttgactggtactattggcttctatgcttgcttctggttcgtgaggaagatctatgcttctgtgaagattgactgacgaatcaaccgccgagagaaacttgtctgccagtagagcatcaacctggctaaggatgtgttacaatgtgatacttggtgatgttcgatgtcatatatgaagaaaacagatctgaggtggagttccatggttttggtagaacatgtagcctggtaggaagaatcaccgaatgttca

SEQ ID NO: 1597 - DNA, 1872 bp, Pennisetum glaucum
ttcaaaatgaggagggatgagagttgcaagattgtttgtcgaaggaagctttctcaagaagctgcgaagaatttcaaagaaaaaattgatgatgaataccgagtgaacatgattctagataatctcccagttgtggtacctagacagacacgggaaggaagtcaaacaccaagctttgagcatggttatcgagttggttataagctcaaggatgacaagtattatatcaacaaccacttgagttttaaagtcttgtaccatgaagaccaaacttctccagaggctcgcattgttggcttccatgtgattcctagcagcatcaagcatgaatatggtacctgggatgacaataatcccacagcgcaaacttgcaatgctaacattaagattacacctggtagtcacactcctcaagaggtggctcctgatgcttatgttgtattctcttatgatgttacctttgaggcaagtgagatcatatgggcatctcgttgggatgtctaccttctttctagcgacagccaaatccattggttctcaattgttaactcattgatgattgtcctattcctttctggtatggtagccatgatcatgatgagaaccctttacaaggacatagcaaactataatcagcttgacaatcaggatgaggcccaggaagaaactggatggaagttagtgcatggtgatgtattccggcctcctgtccactcaggcctcctttgtgtttacgttggtactggcgtgcagttctttgggatgacactagtaaccatgatgtttgcgctacttggattcttatcaccagcaaaccggggaggactcatgactgctatggtccttctgtgggtgttcatgggtgtattggctgggtacacctcgtctcgcctatacaagatgttcaaaggcactgagtggaagaagatcaccctcaaaactgccttcatgtttcctggaattatctttgcgcttttcttctttctgaatgccctcatctggggtgagaaatcatctggcgcagttccttttggaacaatgtttgctttgttcctcctatggtttggcatctctgtgcctcttgtctttgttggaagttttttgggattcaaacagccagcccttgaggatccagtgaagacaaacaagattcccaggcaaattcctgagcaagcatggtacctgcagccagcttttgctatacttgctggtggcatattgccatttggggctgtctttattgagctcttcttcatcctgacatccatctggctgaaccagttctactacatctttggcttcctcttcatagtattcatcatcctcatggtgacttgtgcggagatcacgatcgtgctatgctatttccagctatgcagtgaggattaccactggtggtggagggcatatctgactgcaggctcatcagcactttatctgtttgcttatgctatcttctacttcttcaacaagttggagatcacaaagcttgtctcaggcatcctgtactttggttacatgctgatcatctcttatgccttctttgtgctgactggtaccattggcttctatgcctgcttctggttcgtgaggaagatatatgcttctgtgaagattgactgattactgtttagagaaacttagaaccttgtttccaaggttttgctgcagggtcgcgcatggtgctgctctattgatgacatagagaggaaactgggatttgagatggggttccctggttttgatagagtgtgtagtctattaggagttagaactgctggcagttaaaagtgagatgttggtacgtgatggtcaacatggattttgtacctttaaagatattgtcttgtaatatccttatcatgattttct

SEQ ID NO: 1598 - DNA, 1873 bp, Pennisetum glaucum
tttcaaaatgaggagggatgagagttgcaagattgtttgtcgaaggaagctttctcaagaagctgcgaagaatttcaaagaaaaaattgatgatgaataccgagtgaacatgattctagataatctcccagttgtggtacctagacagacacgggaaggaagtcaaacaccaagctttgagcatggttatcgagttggttataagctcaaggatgacaagtattatatcaacaaccacttgagttttaaagtcttgtaccatgaagaccaaacttctccagaggctcgcattgttggcttccatgtgattcctagcagcatcaagcatgaatatggtacctgggatgacaataatcccacagcgcaaacttgcaatgctaacattaagattacacctggtagtcacactcctcaagaggtggctcctgatgcttatgttgtattctcttatgatgttacctttgaggcaagtgagatcatatgggcatctcgttgggatgtctaccttctttctagcgacagccaaatccattggttctcaattgttaactcattgatgattgtcctattcctttctggtatggtagccatgatcatgatgagaaccctttacaaggacatagcaaactataatcagcttgacaatcaggatgaggcccaggaagaaactggatggaagttagtgcatggtgatgtattccggcctcctgtccactcaggcctcctttgtgtttacgttggtactggcgtgcagttctttgggatgacactagtaaccatgatgtttgcgctacttggattcttatcaccagcaaaccggggaggactcatgactgctatggtccttctgtgggtgttcatgggtgtattggctgggtacacctcgtctcgcctatacaagatgttcaaaggcactgagtggaagaagatcaccctcaaaactgccttcatgtttcctggaattatctttgcgcttttcttctttctgaatgccctcatctggggtgagaaatcatctggcgcagttccttttggaacaatgtttgctttgttcctcctatggtttggcatctctgtgcctcttgtctttgttggaagttttttgggattcaaacagccagcccttgaggatccagtgaagacaaacaagattcccaggcaaattcctgagcaagcatggtacctgcagccagcttttgctatacttgctggtggcatattgccatttggggctgtctttattgagctcttcttcatcctgacatccatctggctgaaccagttctactacatctttggcttcctcttcatagtattcatcatcctcatggtgacttgtgcggagatcacgatcgtgctatgctatttccagctatgcagtgaggattaccactggtggtggagggcatatctgactgcaggctcatcagcactttatctgtttgcttatgctatcttctacttcttcaacaagttggagatcacaaagcttgtctcaggcatcctgtactttggttacatgctgatcatctcttatgccttctttgtgctgactggtaccattggcttctatgcctgcttctggttcgtgaggaagatatatgcttctgtgaagattgactgattactgtttagagaaacttagaaccttgtttccaaggttttgctgcagggtcgcgcatggtgctgctctattgatgacatagagaggaaactgggatttgagatggggttccctggttttgatagagtgtgtagtctattaggagttagaactgctggcagttaaaagtgagatgttggtacgtgatggtcaacatggattttgtacctttaaagatattgtcttgtaatatccttatcatgattttct

SEQ ID NO: 1599 - DNA, 4025 bp, Saccharum officinarum
gtcgacccacgcgtccgcggacgcgtgggccagtccttccggttttctagggtttaaagagcccgccgagcccgccgtgcgccggcccagccagagcccactacattccgccatcgccggagccgacccctccgtctccgcgcacggcaatggcattctccttcgcctcgccgacggctttgaaccctttccagacgccgcctgcgtcgaatcccttccagaccccagctgcgtccaatcccttccagacgccggcggcgccgaatccgtttcagacaccggctccggccacctcgcaggcgccgtccctatcgccctcgcctttccagttcagcttccagcagcagcagcagccgcaaccacagccgcagccacagcagcaggtggcgccggcggcgcaacctcagcagcagaagctgatgctgtacacgacggatatgaaacccgcggggtacaacaccaagtgggaggagctgcacgccgagtcgcagaaggctttgctccagatcgaggacaagatacgggactacagagacgagagtgagaggttggatcagtgcagtcgcctttatgactcctcaatctcgaatgtcaattttgagcttgatgcgagtcgcattgctcaggaacttggtgggaccaccactgtaatggagagagagaaggcttccattcaagagttgatgactgttgtcaatgaaatgatgtggaacacagaatctgctataaggtcatatctgatgttgaggccaagattcacccgtccaggtgctggagttgcaaatggtggttcttcaaatccttcttctggtgctccacccaatcagccagtggtagatttctacagtggagtcccaaagcgtccttccatttttatgcagcgcactgtcaacaggtttgagtgctatcttgcggagtgttgcaagtggatctgtgagctagagcagctggttcaaatggagacaaataaaagatcatcagattctctagaatctctgccaaaagttatgtcaaatgtgcatgattacttcatatatgttgcttctaaagtggaaaatcttcatcaatatgttgaatcaatgaaaactgaatatcttaatgaacaacgccgcatcggtaatgggagcaatccatttctggaggcaaacagacgagaagcagctaaacaagaagcagctgctagaagggtccatccaacactgcatttgcctacccctgcgcagcccatggctcaaatcgctgcaccagctacaagccaaccgcagcaatcttcctttccatctgctgcgacttcctcaagtgccttgtcaacttttagcactccggcttctgctccatcctcatctagtctctttgcaactccaacaactccagctccatcaggcaacctttttggtgcatctggatcggctcagttgaccacaccatttgggacagcctccactcctacattaacatcaacaccagctcctggatttgggactagcactacatctttgggtggaacatctctattttctacaccatttggaggtggagctaccgcttcaggttccagctttggtggtgcatcgaaaggaaggtcgaagccccggagtcgacgctagatgtaaatgaaccaatgtgaaatgtggatgctattggttctcttgactgttcccttttcccctatcttatgcaaaatttgtaactaattctccccagcaattctagtggagttttaagtaatttgtttaactgttttatcaaatactatcgtactagttgtcataaagttataatccccgtgtcaaaaaaaaaaaaaaaaagggcggccgccgcgctctattccgcgtcctcccccgccggtgccttctacctccccggcgtcgccccccgcgacttccagaaggatgatgaacttcaagtgaaagtcaataaattgtcatctataaaaacacagcttccatatgactactatttcctggattactgcaaacctgaggcgattaagaacagtgctgagaacttaggtgaagtccttcgtggggaccgcatcgaaaattctgtctacaatttcaagatgaggagggatgagagttgcaaggttgtttgtcgaaggcacctttctcaagaagctgcgaaaaatttcaaagaaaagatcgatgatgaataccgagtaaacatgatcctagataatctcccagttgtggtacctaggcagacacgggaaggaagccaaacaccaagctttgagcatggttaccgagttggttacaagctcaaagatgacaagtattatatgaacaatcacttgagttttaaagtgttgtaccatgaagaccaaacttctgatgctcgcattgttggcttccatgtgattcctagcagcatcaagcatgaatatggtgcctgggatgacaataatcccacagcgcaaacttgcaatgctaacattaagattacacctggtagtcacactcctcaagaggtggctcctgatgcatatgttgtattctcttatgacgttacttttgagtccagtgatatcatatgggcatctcgatgggatgtataccttctttccagtgatagccaaatacactggttctcaattgttaactcattgatgatcgtcctattcctttctggtatggtggccatgatcatgatgagaaccctttacaaggacatagcaaactataatcagcttgacaaccaggatgaggctcaggaagaaactggatggaagttagtgcatggtgatgtattccggcctcctgttcactcaggcctcctttgtgtttatgttggcactggtgttcagttctttgggatgacacttgtaaccatgatgtttgctcttcttggattcttgtcgcctgcaaaccgtggaggactcatgactgctatggtccttttgtgggtgttcatgggtgtattggcaggatacacctcatctcgcctgtacaagatgttcaaaggcactgaatggaagaagatcaccctcaaaactgccttcatgtttcctggtattatcttttcggtcttcttcttcctgaatgcactgatctggggtgagaaatcatctggtgcagttccttttggaacaatgtttgcattgttcctcctctggtttggcatctctgtgccgctggtctttgttggaagtttcttgggattcaagcagccagccattgaggacccagtgaagacaaacaagattcccaggcaaattcctgagcaagcatggtacctgcagccagcctttgcaatactagctggtggcatattgccatttggggctgtctttattgagctcttcttcatcctgacatcaatctggctgaaccagttctactacatctttggcttcctcttcatagtctttgtcatcctcattgtgacatgtgctgagatcacaattgtgctatgctacttccagctgtgcagtgaggattaccactggtggtggagggcatacctgactgcaggctcgtcagcactctatttgtttgcttatgctatcttctacttcttcaataagttggagatcacaaagcttgtctcaggcatcctgtactttggttacatgctgatcatctcttatgccttctttgtgctgactggtaccattggcttctatgcctgcttctggttcgtgaggaagatatatgcttctgtgaagatcgactgattaaacaaccactgtctagagatacttattttctgctcatagagtacctcctgccaaggttttgctgcaatgtcgtgcatggtgctgcttgattgatatatgaaaggaaactaggattcgggatggaattccatggttttggtaggaatatgtgtagcctgttaggagcaagaactgctggaagttgaagtgagatcttgatacgcgatgttgtagtgcaacatggattttgtacgcctaaagatatttagtgctgcactgtaatatgccttgatttaccctgcttgttccacatcatgccctgtgcgcttgatgtgcttcggttttcaatttaacaacaggtggcaat

SEQ ID NO: 1600 - DNA, 973 bp, Saccharum officinarum
agggcacagttctctcctcctccagtcccaggtggtagtagaggctagagctagctagcaagcagatcgagtgcgtggcgcatggccatggccacggccaagctcgtcctccttatgatcctcgtggccggcagctcctgcggcggcagcgcgtgggggccgctgagccgcctccggatgctgccgacggcgcaggacgtggaggcggcggctgagcgcctgaaggaggacgtgtcggcgccgctgatccacgcgctgcacccgctgctcggctccgccggggacttgggccggcgcgccggcgtgccgtgcgacagctggcgcctggccgtggagacgtacaacaagcgcgactggacgacggtgccggccagctgcgagggctacgtcggccactacatgctcggcgggcactaccgccgggactcccgcgtcgtggtcgacgaggccatcgcgtacgccgaggcgctcaggctcggcggcaacggcaaggaggtgtgggtgttcgatatcgacgagacgtccctctccaacctcccctactacgccacccatggcttcggcactaagccgtacaacgcgacgagcttcaacgagtacgtactggaggggagcgcaccggtgctgccggagacgcaacggctgttcaagaagctcatctcgctcggcatcaagccggtgttcctgacgggccgcaccgaggaccagagggccatcacggtcaccaacctccgccgacagggctactccggctggatggacctgctgctcaagcccgtcgggctcaaggccaccgccatcgcctacaagtccggcgagcggcagaagctgcaggacgctgggtacgtcatcgtcggcaacatcggcgaccagtggagcgacatcctcggcgcgccggagggcgcgcgcaccttcaagctgcctgaccccctctactaaattggctaattaagcgatgctgccacgctggcct

SEQ ID NO: 1601 - DNA, 2243 bp, Setaria italica
aagaaaggacgcttgttacgttgcgaggcaaaagtctgtttcaaagcggcgaacgctgaagaagaagaagaaaaataagggatctaaggcttctgggaagaagtcggcttcagctaaagcgaagaagtctgctcctgttagacggcgtagaaagcgttcaatgattgacgaatatgaggaggatgaggatgaggatgaggatgatgatgacttcattgtggaggatgaacgccccaggaagaaggccaggaaaaggaatgggagggaggcagagttggacgctgaagtatcacctgttgaggaagagacatggccaaaccttgagtcagacacatcagactttgagtttgcaacatctgacgaggaacataacaatgttgagacaccggtagttgagcagattaccgtcaaaaaggggaggaagaagaggatatctggatctgagtcgtcttctgattctgaattcgttgtatcagataaggaattggaggatttgagggagactgagcttccaaagcctgtgccaataatgctccctgcatcgatgagaaggatttgtattacaaggcatggagaaggcaagggtaaggagaaacaggaacaagaggaggctgggaagccaatatgcgggatctgcctctcggaggaacagagagctactgtgcagggcgtcctcaattgttgctcacactacttttgcttcgggtgcatcatggaatggtctagagttgagtcaaggtgcccattgtgtaagcagcggttcactacaatcaccaagtcgtcaaaggtggatcttggtcttggagtgaggaaagctgtaatcaaggtcgaagagcgtgaccaggtttatcagcccactgaagaggaaataaggcgttggttagatccatatgagaatgtcgtgtgtatagagtgcaatcaaggtggcgatgatagtctcatgctactatgcgacatttgtgattcctcagcgcatacttattgtgttggcttgggaagggaagtgcctgaaggaaattggtactgtggaggatgtagacttggtgatgagggaccgtcctataccggaattcagcgcaccgtggcttatgaaagacaaaattacagaaatcatgttgatagtagttctgttagttttggcacagctgcacctagtggcacattggaaaggccgccatcaatcaaccctcgccgatcttttcaagggattgatctaaatctatccccaagagagtttcctggggaaactcatcctgctgaatcacaagtttcaactgatagtgtatcaactcccactggtaggcgtgcaactctttcaggaaggcgtcaaatacatcgatatattcggattttgctaactagaccaaggccaccgagtagacaagacgcataccataatattgcacagcacagtggtggtgtaccaagaactgaaccaaaccgtcgtaacttcccgtcttcatcagaagaaaacacatcacacagtatgcctgatggcattcagaaccatcacaatggccttccatttgttcaagctcacaacaattttgctccatgcatgtccctcgatggtgatgaaggtgtcaagagcaacctcaggaacatataatacaagcccccttgttagaatgccattctaccgtgtgaagcttactaagggagcaacatgtgccatttttattggcttgtggaattgaacatagcaagcgtatgcctgttgcgtcaccttaacaccctcccagaatttacacccatgctcccattttagcgatgcaggcatttctcattggaaatggctggtcgatgtggtccggctcgttgtgggagatgtggtcaatgacataacatacatgctttttctcggggccctttgtttaagtttaggcattttttgttgttattgccattctcaattcattcggtcattaaacacaacatcgaaagatcacacagcaacaaaggctggatagcttcatatttatacactgtaacattgtggggacaccattttcattaggctgatcattctttctctgtcgagacgttcttttaagaaaggttgctagctgttcccagcctccctcttccgtactaagcatgtacgtggtggtaagcattatccaaaactttgacacttccaggtactagctttctgttctgtcagtgctggtttattttggctcatattcttctttctggagggcatggtgcatcaaccgagaaaagtcgaattcagattaaga

SEQ ID NO: 1602 - DNA, 1660 bp, Panicum virgatum
gttgagcagatttcagttagaaagggaaggaagaagaggatatctgggtctgagtcatcctctgattctgaatttgttgtatcagataaggaattggaggatttgaaggagcctgagcttccaaagcctgtgccaatgctccctgcttcaatcagaaggatttgtattacaaggcaaggagaaggcaagggaaaggagaaacaggaaccagaggaggctgggaatccaatatgcgggatctgcctctcagaggagcagagagctactgtgcagggcgtcctcaattgttgttcgcactacttttgctttgcgtgcatcatggaatggtccagagttgagtcaaggtgcccgttgtgtaagcagcggtttactacgatcaccaagtcatcaaaggtagatcttggtcttggagtgagaaagtctgtaatcaaggttgaagagcgtgaccaggtttatcagcccactgaagaagaaataaggcgctggttggacccatatgagaacgtggtgtgtatagagtgcaatcgaggtgtcgatgatagtctcatgctactatgcgatatttgtgattcctcagcgcatacttattgtgttggcttgggaagggaagtgcctgaaggaaattggtactgtggaggatgtagacttggtgacgagggaccgtcctatactggaattcagcgcacagtggctaatgaaagacaaaattacagaactcaggttgatagtagttctgtaagttttggaccggctgcaccaagtggcacattcgagagatcgccatcaatcaaccctcgtcgttcttttcaagggattgatctaaatctatccccaagagattttcctggggacacccatcctgctgaatcacaagtttcaactgatagcgtatcaactccaactggaaggcgtgcaaccctttcaggaaggcgtcaaatacatcgttatattcggattttgctaactagaccaagacagcctagcagacaagacacataccataatgttgcacagcacagtggtggggtaccaagaactgaaccaaatcgtcgtaacttcccttcttcatcagaagcaaacacatcacacagtctgcctgatggcattcagaaccatcacaatggacttccatttgttcaagctcacagcaattttgctccatgcatgtcccttgatggggatgattttcagcaattggaaggtgtcaaaagcaaccttaggaatgtgtagtagaatcccttgttagaagcatttccgtctgaagcttactaagggagcaacatgtgccattttaatggcttgtggaattgaacatagcaagcgcgtaccctgttacctcacattaacaccctccctggattttcattcatgctgtcatttgtgacaggcatttcctcattgaaaatggctggtgaatgtggttcggttcatttgtgggagatgtggtcaatgacataacatacatgctttttctcaaatcctttgtttaaatttaggtattttttgttgttattgccattctcattcattcgggcatcaaacaaatcattgaaagatcacagagaaacaaaggcatttctgaatgtctggataacttcatatttatacactgtaacattgtggggacacaattttcattaggctgatcattctttctttg

SEQ ID NO: 1603 - DNA, 714 bp, Triticum aestivum
aaggtcgaagagcgtgatcaggtttatcagcccactgaagaagaaatcaggcgttggctagacccgtatgagaatgtcgtttgtatagagtgcaatcaaggtggtgatgatagtctcatgctactatgtgacatttgtgattcctcagcacatacatattgtgttggcttgggaagagaagtacctgaaggaaactggtactgtggaggatgtagactcggtgatgagggaccatcatatactggaattcagcgtacagtggcttatgaaagacaaacttacagaaatcatgtcgatagtagttctgtaagttttggcatgcttgcatcaagtggcacatttgaaaggccaccatcaatcaaccctcgccattcttttcaagggattgatctaaatctatcaccaagagagtttcctggagaatcacatcctgctgaatcacaagtttcaactgatagcgtatcaactcccactggaagacgaactgtttcggcaaggcgtcaaatacatcggtacattcggattttgctagccagaccaagacaacctagtagaccagacgtattccacaatattgcgcagcacagtggtggtgtaccaagaactgaaccgaaccgccagaacttcccttcttcatcagaagcaaacacatcacataatctgcctgatggcattcagaaccatcacggtagccttccatttgttcaagctcaa

SEQ ID NO: 1604 - DNA, 3233 bp, Zea mays
gacgcgacgatgcttccccacaactcgagcccctcgtagcttccacccggcccccatccgcggcctccctcctccgttcccctttcccgttttcctcctccgcttcccgattcaactcgcaacgccgccgccttcgctgacccatgagcgggcgcgagccgatttaggcccgccgctacagagatttcgagagaatttttgggctagcggggtgtgaacaaaaacttggtgccccgctgctctgccttttgtcgtccactgtttcgcgtcaattctcgcgcgaaaagggatgggcactggagaggggtcgccgccggcgaggcggggcatcagcggtaggcgccgtcgatggccggacgaggacgacgacgagtatgtgctggaggaggaagaagaagaggattatgtggaggagctctccgcctcgagcgccggcgaggagggggatgggttggattcagacgccgaataccaggaggcagaggaggaggacgacgacgaaatcgagacgccgcgcccgaagcgacgggcaaagggcagcaacagagtacggaaaggaaaggtggatctggccgccgcacgatctcgacgccggaagtatgaggaggacgaggactacgaggaggaggttgacgaagacgacgaggtggaggaggagtaccatgatgaccttgaggaggtcgaggaggaggaagaagtggcaccacagcggccgaagagcattgtgaaatgcggtgcccgtggccggaatgtgaagctgtctctggcagcgaagcgatctcatcagcggaagcaggaggatgatgaggatatggattttgacccagagttggatgacgaggaggtcgagatagatgaggatattgattttgatcccgatgtcgatggtgacgaggaggatgagtatcaagacgaggaggaagaggaactggttcctgcccgtgccagaaaggtaactgtaaagaatccggtgaagcgaaagtccatttcaaagaggcgaacaccaaagaagaagaagaaaaataggggatctaaggtttctaggcggaagggggcttcagctaaagtgaagaaatcagcacctgttaggaggcggagaaagcgttcagtgatagatgattacgaggatgaggatgtggatgatgacgatgacgacgacttcattgtcgacgatgaggtcattgtgaatcggcaccccaagaagaaggccaggatagggagtgggagggagacagtggtggaccctcaagtatctattgaggaagagacatggccagaccttgagtcagactcatcggactttgagtttgcgacgtccgatgaagaacctaacaatgttgaaacacctgtagctgagcagactacagtcagaaaagggaggaagaagaggatatctgagtcagagtcatcctcagattctgaatttgttgtatcaggtaaggaattggaagaattgagggagcctgagcctccaaaggctgcaccaaatctgcatgtgtccttgagaaggatttgtattacaaggcatggagaaggcaagggaaaggagaaacaggaacatgaggaggctgggaagccaatatgcgggatctgtctctcggaggagctgagagctactgtacaaggtgtcctcaattgttgctcacactatttttgcttcgcatgcatcatggaatggtctagggttgagtcgagatgcccattgtgcaagcagcggttcactacaatcaccaagtcatcaaaggtagatcttggtcttggagtgagaaaagctgtagtcaaggtcgaagagcgtgatcaggtttatcagcccactgaagaagaaataaggcgttggctagacccatatgaaaatgttgtttgtatagagtgcaatcaaggtggcgatgataatctcatgctactatgtgacatttgtgattcctcagcacatacttattgtgttggcttgggtagagaagtgcccgaaggaaactggtactgtggaggatgtagactcggtgacgagggaccatcatatactggaattcagcgtacagtagcttatgaaagacaaaattacagaagtcatgtcggtagttctgtaagttttggcatggctgtaccaggcggtacatttgaaaggccgtcatcaatcaatcctcgccattcttttcaagggattgatctaaatctatctccaagagagtttcccggagaatcacatcctgctgaatcacaagtttcaactgatagcgtatcaactcccactggaagagctggaagctatttcaggaaggcgtcaaatacaacggtacattcagagtttgttcagaccaagtctacctagtagaccagacacgtaccacaatattgcgcagaacagtggtggtgtatcaagaaatgaaccgaaccgctggaacttcccttcttcatcagaagcaaacacatcacagaatctgcctgatggcattcagaaccatcacagtgaccttccatttgttcaagctcacagcaattttgctccatttatgtccctagatggggatgatttccagcaaattgagggtgtcaagagcaacctcaggaacatgcagtagagcccttacggcgttactagaagctcgattctaccctgtgaagcttaccaagggggcaacatgtgccgttttaatggcttgtggaactgaacataacaaaagcttgtgcctgttgcattctcccagaaattgatgtggttcggctcatttgcggagatgtgatgtggtcaacgatataagatacatgctctctttgtttaagtttaggcattttttgttgtcgtcattcttattcattcagtcattaagcacaacctcagattacacagcgaaggcatttctgaatgtcttgatagcttcaaatttatacattgtaatattgtggtaacaccaatttcattaggctgaccattcttttcctcgcgagatgctcttttgcctactaggaatgctgataactgagcttcccagcctcttctataatcatataccgcgcggtggcaaactagcctcgttcgggtactggctttctgttctattagcatactggtctagtggatcaaccgagaaaagctatcaacaatcttagtactaacaatctatggtctgaagactcgtcttctttaagtgttttgttgtatagcgcagctgctttttgtacagatgaatgtttgttccatattgcttaagtttgtatccagtatccccttcata

SEQ ID NO: 1605 - DNA, 3550 bp, Zea mays
gacgcgacgatgcttccccacaactcgagcccctcgtagcttccacccggcccccatccgcggcctccctcctccgttcccctttcccgttttcctcctccgcttcccgattcaactcgcaacgccgccgccttcgctgacccatgagcgggcgcgagccgatttaggcccgccgctacagagatttcgagagaatttttgggctagcggggtgtgaacagaaacttggtgccccgctgctctgccttttgtcgtccactgtttcgcgtcaattctcgcgcgaaaagggatgggcactggagaggggtcgccgccggcgaggcggggcatcagcggtaggcgccgtcgatggccggacgaggacgacgacgagtatgtgctggaggaggaagaagaagaggattatgtggaggagctctccgcctcgagcgccggcgaggagggggtggattcagacgccgagtaccaggaggcagaggaggaggacgagatcgagaagccgcgcccaaagcgaccagcgaagggcatcacatcgagcgccggcgagaggggattggattcagacgccgaataccaggaggcagaggaggacgacgagatcgagccgccgcgcctgaagcgaccggccaagggcagcacatcgagcgcgggtgaggaggggttggattcagacgccgaataccaggaggcagaggaggacgagatggagacgccgcgcccaaagcgaccggcgaaggacagcacatcgagcgccggcgaggatgggttggattcagacgccgaataccaggaggcagaggaggaggacgacgacgaaatcgagacgccgcgcccgaagcgacgggcaaagggcagcaacagagtacggaaaggaaaggtggatctggccgccgcacgatctcgacgccggaagtatgaggaggacgaggactacgaggaggaggttgacgaagacgacgaggtggaggaggagtaccatgatgaccttgaggaggtcgaggaggaggaagaagtggcaccacagcggccgaagagcattgtgaaatgcggtgcccgtggccggaatgtgaagctgtctctggcagcgaagcgatctcatcagcggaagcaggaggatgatgaggatatggattttgacccagagttggatgacgaggaggtcgagatagatgaggatattgattttgatcccgatgtcgatggtgacgaggaggatgagtatcaagacgaggaggaagaggaactggttcctgcccgtgccagaaaggtaactgtaaagaatccggtgaagcgaaagtccatttcaaagaggcgaacaccaaagaagaagaagaaaaataggggatctaaggtttctaggcggaagggggcttcagctaaagtgaagaaatcagcacctgttaggaggcggagaaagcgttcagtgatagatgattacgaggatgaggatgtggatgatgacgatgacgacgacttcattgtcgacgatgaggtcattgtgaatcggcaccccaagaagaaggccaggatagggagtgggagggagacagtggtggaccctcaagtatctattgaggaagagacatggccagaccttgagtcagactcatcggactttgagtttgcgacgtccgatgaagaacctaacaatgttgaaacacctgtagctgagcagactacagtcagaaaagggaggaagaagaggatatctgagtcagagtcatcctcagattctgaatttgttgtatcaggtaaggaattggaagaattgagggagcctgagcctccaaaggctgcaccaaatctgcatgtgtccttgagaaggatttgtattacaaggcatggagaaggcaagggaaaggagaaacaggaacaggaggaggctgggaagccaatatgcgggatctgtctctcggaggagctgagagctactgtacaaggtgtcctcaattgttgctcacactatttttgcttcgcatgcatcatggaatggtctagggttgagtcgagatgcccattgtgcaagcagcggttcactacaatcaccaagtcatcaaaggtagatcttggtcttggagtgagaaaagctgtagtcaaggtcgaagagcgtgatcaggtttatcagcccactgaagaagaaataaggcgttggctagacccatatgaaaatgttgtttgtatagagtgcaatcaaggtggcgatgataatctcatgctactatgtgacatttgtgattcctcagcacatacttattgtgttggcttgggtagagaagtgcccgaaggaaactggtactgtggaggatgtagactcggtgacgagggaccatcatatactggaattcagcgtacagtagcttatgaaagacaaaattacagaagtcatgtcggtagttctgtaagttttggcatggctgtaccaggcggtacatttgaaaggccgtcatcaatcaatcctcgccattcttttcaagggattgatctaaatctatctccaagagagtttcccggagaatcacatcctgctgaatcacaagtttcaactgatagcgtatcaactcccactggaagagctggaagaactatttcaggaaggcgtgaattacaacggtacattcagagtttgttcagaccaagtctacctagtagaccagacacgtaccacaatattgcgcagaacagtggtggtgtatcaagaaatgaaccgaaccgctggaacttcccttcttcatcagaagcaaacacatcacagaatctgcctgatggcattcagaaccatcacagtgaccttccatttgttcaagctcacagcaattttgctccatttatgtccccagatggggatgatttccagcaaattgagggtgtcaagagcaacctcaggaacatgcagtagagcccttacggcgttactagaagctcgattctaccctgtgaagcttaccaagggggcaacatgtgccgttttaatggcttgtggaactgaacataacaaaagcttgtgcctgttgcattctcccagaaattgatgtggttcggctcatttgcggagatgtgatgtggtcaacgatataagatacatgctctctttgtttaagtttaggcattttttgttgtcgtcattcttattcattcagtcattaagcacaacctcagattacacagcgaaggcatttctgaatgtcttgatagcttcaaatttatacattgtaatattgtggtaacaccaatttcattaggctgaccattcttttcctcgcgagatgctcttttgcctactaggaatgctgataactgagcttcccagcctcttctataatcatataccgcgcggtggcaaactagcctcgttcgggtactggctttctgttctattagcatactggtctagtggatcaaccgagaaaagctatcaacaatcttagtactaacaatctatggtctgaagactcgtcttctttaagtgttttgttgtatagcgcagctgctttttgtacagatgaatgtttgttccatattgcttaagtttgtatccagtatccccttcata

SEQ ID NO: 1606 - DNA, 2350 bp, Panicum virgatum
taagtactaggaggatgatgactaccaggaggagatcgaggaagaagaggatgtggaggagtaccaccattagcttgatgaggatgaagaggcgcctccgcagccaaagagccttgcgaaatgtggtaaccgtaaccgaaatgtgaagccgtctactgcagcgaagcgatctcatcagcggaggcacttggacgatgaggatatggactttgaccctgagttggatgaggaggaggatgagttagatgaggacatcgatttcgatcctgaagtggatgatgacgatgaggatgaataccaagatgaggatgaagaggaactggctgctatccgtgccagaaaggtaactgttaagaatccggcggagcgaaagtctgcttcaaagcggcgaacgctgaagaagaagaaaaaaaaactaagggatctaaggtttctgggaggaaatcggcttcggctaaagcgaagaagtccgcgcccattagacggcggagaaagcgttccgtagttgatgaatacgaggacgatgaagatgatgatgatgatgatgacgacttcattgtagaggatgaacaccccaggaagaaggccagggacaaggaatgggagggaggcacaagtggaccctgaagtatccccggttgaggaagagacatggccaaacgttgagtcagacacatcagactttgaatttgcaacatctgatgaggaacataacaatgttgagacacaggtggttgagcagatttcagtcagaaagggaaggaagaagaggatatctgggtctgagtcatcctctgattctgaatttgttgtatcagataaagaattggaggatttgaaggagcctgagcttccaaagcctgtgccaatgctcccttcttcaatcagaaggatttgtattacaaggcatggagaaggcaagggaaaggagaaacaggaaccagaggaggctgggaatccaatatgcgggatctgcctctcagaggagcagagagctactgtgcagggcgtcctcaattgttgttcgcactacttttgttttgcgtgcatcatggaatggtctagagttgagtcaaggtgcccgttgtgtaagcagcgattcactacaatcaccaagtcatcaaaggtagatcttggtcttggagtgagaaagtctgtaatcaaggttgaagagcgtgaccaggtttatcagcccactgaagaagaaataaggcgctggttagacccatatgagaatgtggtgtgtatagagtgcaatcgaggtggcgatgatagtctcatgctactatgtgatatttgtgattcctcagcacatacttattgtgttggcttgggaagggaagtgccggaaggaaattggtactgtggaggatgtagacttggtgatgaaggaccatcctatactggaattcagcgcaccgtggctaatgaaagacaaaattacagaactcaggttgataatagttctgtaagttttggaccggctgcaccaagtggcacattcgagagatcgccgtcaatcaaccctcgtggttcttttcaagggattgatctaaatctatccccaagagattttcctggggacacccatcctgctgaatcacaagtttcaactgatagcgtatcaactccaactggaaggcgtgcaaccctttcaggaaggcgtcaaatacatcgctatattcggattttgctaaatagaccaagacaacctagcagacaagacacataccataatgttgcacagcacagtggtgttgtaccaagaactgaaccaaattggcttaactttccttcatcagaaccaaacacatcgcacagtctgcctgatggcattcagaaccatcacaatggacttccatttgttcaagctcacagcagttttgctccatgcatgtccctcgatggggatgatttccagcaaattgaaggtgtcaaaagcaaccttaggaatgtgtagtagaatcccttgttagaagcgtttccgagtgaagcttactaagggagcaacatgtgccattttaatggcttgtggaattgaacatagcaagcacctacctggtgcctcacattaacacccttcctggattttcattcatgctctcatttgtgacaggcatttcctcattgaaaatggctggtgaatgtggttgggctcatttgtgggagatgtggtcaatgacataacatacatgctttttctcaaatcctttgtttaaatttaggtattttttattgttattgccattctcattcattcggtcattaaacacaacattgaaagatcacacagaaacaaaggcatttctgaatgtctggataacttcatatttatacactgtaacattgt

SEQ ID NO: 1607 - DNA, 1701 bp, Pennisetum glaucum
aacaggaacaagaggagtctgggaaaagccaatatgcgggatttgcctctcggaggaacagagagctactgtgcagggtgtccttaattgttgctcacactacttttgctttgcgtgcatcatggaatggtctagagttgagtcaaggtgcccattatgtaaacagcggttcactacaatcaccaagtcatcaaaggtggatcttggtcttggagtaaggaaagctgtaatcaaggtcgaagagcgcgaccaggtttatcagcccactgaagaggagataaggcgctggttagacccatatgagaatgttgtgtgtatagagtgcaatcaaggtggtgatgatagtctcatgctactatgcgatatttgtgattcctcagcgcatacttattgcgttggcttgggaagggaagtgcctgaagggaattggtactgtggaggatgtagactaggggatgaaggaccgtcctatactggaattcagcgcacagtggcttatgaaagacaaaattacagaattgttgataatagttttggctcagctgcaccaagtggcacattggaaagaccgccatcaatcaacactcgccgatcttttcaagggatcgatctaaatctatccccaagggagtttcctggggaaactcatactgctgaatcacaagtttcaactgatagtgtatcaactcccactggtaggcgtgcaactctttcaggaaggcgtcaaatacaccgatatattcggattttgctaactagaccaaggccacctagcagacaagacgcataccataatattgcacagcacagtggtggtgtaccaagagctgaaccaagccgtcgtaacttaccgacttcatcagaaacaaacacatcacatagtctgcctgatggcattcagaaccatcacagtgaccttccatttgttcaagctcacaacaattttgctccatgcacaccccttgatggtgatgaaggtgtcaagagcaacctcaggaacttgtagtacaagcccttgttagaatgccattcttccgtgtgaagcttacaaagggagcgacatgtggcatttttattgacttgtggaattgaacatagcaagcaaatgcctgttgcctcaccttaacaccctcccagaatttacactcgtgctcccattttacagacgcaggcatttctcattggaaatggctggtcgatgtggtccggcttgttgtgggagatgtggtcaatgacataacatacatgctttttctcagggtcctctgtttaagtttaggcatttttttgttgttattgccattctcaattcattcggtcattaaacacaacatcgaaacatcacatagcaacaaaggctggatagcttcatatttgtacactgtaacattgtggggacaccattttcattaggctgatcattctttctctgttgagaccttaaaaaaagtagttcccagcctccctcttccgtactaatcatgtacgtggtggtaagcatcatcaaacttttgacactttcaggtcactagctttctgttcttgtcagtgctttttattttgggtcatattcttctttctggaggttaccgagatcttcacttttccctaagatgatttgttactgagacatgatgatacttgacacacatggtgaggtcttcattttggattgggcagtgcgtggatcaaagagaacag

SEQ ID NO: 1608 - DNA, 1894 bp, Pennisetum glaucum
agacggcgtaaaaagcgctcagtgattgacgaatatgaggatgatgacgacgacgatgaggatgatgacgacttcattgtggaggatgaacgccccaggaagaaggccaggacaaggaatgggagggaggaccccgaagtatcacctgttgaggaagagacatggccaaaccttgagtcagacacatcagagtttgagtttgcaacatctgacgaggaacataatgatgctgagacaccagtagttgagcagattaccgtaaaaaaggggaggaagaagaggacatctgggtctgaatcatcttctgattctgaattcgtcgtatcagataaagaattggaggatttgagggagactgagcttccaaaacccatgccaatgctccctgcatcagtgagaaggctttgtattacaagaaatggagaaggcaagggaaaggagaaacaggaacaagaggagtctggaaagccaatatgcgggatttgcctctcggaggaacagagagctactgtgcagggtgtccttaattgttgctcacactacttttgctttgcgtgcatcatggaatggtctagagttgagtcaaggtgcccattatgtaaacagcggttcactacaatcaccaagtcatcaaaggtggatcttggtcttggagtaaggaaagctgtaatcaaggtcgaagagcgcgaccaggtttatcagcccactgaagaggagataaggcgctggttagacccatatgagaatgttgtgtgtatagagtgcaatcaaggtggtgatgatagtctcatgctactatgcgatatttgtgattcctcagcgcatacttattgcgttggcttgggaagggaagtgcctgaagggaattggtactgtggaggatgtagactaggggatgaaggaccgtcctatactggaattcagcgcacagtggcttatgaaagacaaaattacagaattgttgataatagttttggctcagctgcaccaagtggcacattggaaagaccgccatcaatcaacactcgccgatcttttcaagggatcgatctaaatctatccccaagggagtttcctggggaaactcatactgctgaatcacaagtttcaactgatagtgtatcaactcccactggtaggcgtgcaactctttcaggaaggcgtcaaatacaccgatatattcggattttgctaactagaccaaggccacctagcagacaagacgcataccataatattgcacagcacagtggtggtgtaccaagagctgaaccaagccgtcgtaacttaccgacttcatcagaaacaaacacatcacatagtctgcctgatggcattcagaaccatcacagtgaccttccatttgttcaagctcacaacaattttgctccatgcacaccccttgatggtgatgaaggtgtcaagagcaacctcaggaacttgtagtacaagcccttgttagaatgccattcttccgtgtgaagcttacaaagggagcgacatgtggcatttttattgacttgtggaattgaacatagcaagcaaatgcctgttgcctcaccttaacaccctcccagaatttacactcgtgctcccattttacagacgcaggcatttctcattggaaatggctggtcgatgtggtccggcttgttgtgggagatgtggtcaatgacataacatacatgctttttctcagggtcctctgtttaagtttaggcatttttttgttgttattgccattctcaattcattcggtcattaaacacaacatcgaaacatcacatagcaacaaaggctggatagcttcatatttgtacactgtaacattgtggggacaccattttcattaggctgatcattctttctctgttgagaccttaaaaaaagtgtt

SEQ ID NO: 1609 - DNA, 2477 bp, Pennisetum glaucum
tgaggaagaggaggaggtggaggagtaccgcgatgagcccgatgaagaagaagtggagtactgcgatgagctcgaggaagaagaggaggtggaggagtaccgcgatgagcttgaggaagaagaggtggagtaccgcgatgagctcgaggaagttgaggaagaggagccgccacgaccaaagggccttgcgaaatgtggtggccgtagccgaaatgtgaagccagctactgcagcgaagcgatctcatcagcgaaggcacttggacgacgatgatatggactttgaccctgagttggatgatgaggacgagttagatgaggacatcgattttgatcctgaagcagatgatgacgatgaggatgagtaccaagatgaggaggaagaggaactgtctgctatccgtgccagaaaggttactgttaagaatccggcgaagcgaaagtctgtttcaaagcgtcgaacgctgaagaagaagaagaagaaaagtaagggatctaaagcttctgggaagaagtcagcttcagctaaagcaaagaagtctgcacccgttagacggcgtaaaaagcgctcagtgattgacgaatatgaggatgatgacgacgacgatgaggatgatgacgacttcattgtggaggatgaacgccccaggaagaaggccaggacaaggaatgggagggaggaccccgaagtatcacctgttgaggaagagacatggccaaaccttgagtcagacacatcagagtttgagtttgcaacatctgacgaggaacataatgatgctgagacaccagtagttgagcagattaccgtaaaaaaggggaggaagaagaggacatctgggtctgaatcatcttctgattctgaattcgtcgtatcagataaagaattggaggatttgagggagactgagcttccaaaacccatgccaatgctccctgcatcagtgagaaggctttgtattacaagaaatggagaaggcaagggaaaggagaaacaggaacaagaggagtctggaaagccaatatgcgggatttgcctctcggaggaacagagagctactgtgcagggtgtccttaattgttgctcacactacttttgctttgcgtgcatcatggaatggtctagagttgagtcaaggtgcccattatgtaaacagcggttcactacaatcaccaagtcatcaaaggtggatcttggtcttggagtaaggaaagctgtaatcaaggtcgaagagcgcgaccaggtttatcagcccactgaagaggagataaggcgctggttagacccatatgagaatgttgtgtgtatagagtgcaatcaaggtggtgatgatagtctcatgctactatgcgatatttgtgattcctcagcgcatacttattgcgttggcttgggaagggaagtgcctgaagggaattggtactgtggaggatgtagactaggggatgaaggaccgtcctatactggaattcagcgcacagtggcttatgaaagacaaaattacagaattgttgataatagttttggctcagctgcaccaagtggcacattggaaagaccgccatcaatcaacactcgccgatcttttcaagggatcgatctaaatctatccccaagggagtttcctggggaaactcatactgctgaatcacaagtttcaactgatagtgtatcaactcccactggtaggcgtgcaactctttcaggaaggcgtcaaatacaccgatatattcggattttgctaactagaccaaggccacctagcagacaagacgcataccataatattgcacagcacagtggtggtgtaccaagagctgaaccaagccgtcgtaacttaccgacttcatcagaaacaaacacatcacatagtctgcctgatggcattcagaaccatcacagtgaccttccatttgttcaagctcacaacaattttgctccatgcacaccccttgatggtgatgaaggtgtcaagagcaacctcaggaacttgtagtacaagcccttgttagaatgccattcttccgtgtgaagcttacaaagggagcgacatgtggcatttttattgacttgtggaattgaacatagcaagcaaatgcctgttgcctcaccttaacaccctcccagaatttacactcgtgctcccattttacagacgcaggcatttctcattggaaatggctggtcgatgtggtccggcttgttgtgggagatgtggtcaatgacataacatacatgctttttctcagggtcctctgtttaagtttaggcatttttttgttgttattgccattctcaattcattcggtcattaaacacaacatcgaaacatcacatagcaacaaaggctggatagcttcatatttgtacactgtaacattgtggggacaccattttcattaggctgatcattctttctctgttgagaccttaaaaaaagtgttcccagcctccctcttccgtactaatcatgtacg

SEQ ID NO: 1610 - DNA, 1127 bp, Solanum tuberosum
cttgttcatttttctcctttgggtattcaattttttgaaattcttggagagttttgtaagtttcttcacttgggtttcttcaaaaaccagtctttttcatctctcaatcaaagaaattgctctgaactactactctgtactgcaacagtgaagaagacatgggtgttgttcatactctgcattttgtttttgggatatttggaaatgccactgctctgtttctgttcttggcaccaataatcacattcaagagggttatacaaaatcgatctactgaacaattctctggcttgccttacgttatgactttactcaactgcctgctttctgcatggtatggattaccatttgtgtcaccaaataatctgttggtgtctacaatcaatgggactggagctgtaattgagaccatttatgtgctgatcttcattgcatttgcaccaagtaaagagaagaagaaaatctcagcacttcttctattagtccttactgtttttgctgctgtagcccttgtttccatgctcgctttacatggaagcaaaaggaagctcttttgtggtatcgctgccacgatcttctctatcattatgtatggatctcctctatccatcataagattggtaatcaagacgaagagtgtggagttcatgccatttttcttgtcgttgttcgtgttcttatgtggcgcttcctggtttgcctttgggcttcttgggaaggaaccttttgttgctattccaaatgggtttagggcttgggtttaggaaccgtgcaactttatcttatatgccatctactgtgagaagaagggattaccaggaatcaactttgatgagtcgttgaacgacgggaaattggtcagtttcacccaaggagggaaaggcaattcttagcaccattaaccaggtccaaggtttgagcacattttgggcctcgaaggttactgggagggctaaactctggaggaaatttcgcaacagcgtgggccccctttgaagagggggcggtgggatagggcgacaaagaggacgtctggaagacaccgcgctgctgcaaagaaagggcgcgacaggccacacacatctatggggagggggcagatgtcacacacacacgtgggggggaga

SEQ ID NO: 1611 - DNA, 940 bp, Gossypium hirsutum
ctcctcccctccttcttcaccacacaccacaactactatactcccaaaatgtctcttacaatccccactaacctctccaaatcccttttgaagccaaagataaactcccaactcacccccaaagtttcacgatcattggtggtatgctccaccgacaagacttcatcgccaccatcatcagcttcaccactccaagccttctcagcagctcttgctctttcttccattcttctctcagccccgcagcctgccgtagctgatattgcaggcctcacaccatgcaaagagtccaagcaattcgccaaacgtgagaagcagcagatcaagaagctggaatcgtcgttgaagctatacgcccctgacagcgctccagctctcgctatcaaagcaaccatcgagaaaaccaagagacggtttgacaactatgggaagtacgggctgttgtgtgggtctgatgggttgcctcatttgatagtgagcggtgatcagaggcactggggtgagttcatcacgcctggtctcttgttcttgtacatcgctggatggatcgggtgggttggaaggagctacctcattgctattagcgatgataagaagcctgccatgaaggagatcatcattgacgtgcctttggctaccggtcttatatttagaggctttatttggcctgtcgctgcttacagagagcttatcaatggtgaccttgttgtcaaggacgtttaatctcctcagggatcgaatggaaggacttgaactccaaggaatagctagggaagaagatgggagtgcttttagactgaatattcttggtgggaaatttcttgtacttaaaaatgttgtttaaaaaaacatacttttgagtcttatgtaatgctaatgttgaaacatttgttaactgaacgactttccatttcaatctttgttatccatattcatgtga

SEQ ID NO: 1612 - DNA, 1060 bp, Gossypium hirsutum
cccgaatctaaaactcatccttccccttctctctcaaatcctcctcccctccttcatcaccacacaccacaactactatactcccaaaatgtctcttacaatccccactaacctctccaaatcccttttgaagccaaagataaactcccaactcacccccaaagtttcacgatcattggtggtatgctccaccgacaagacttcatcgccaccatcatcagcttcatcactccaagccttctcagcagctcttgctctttcttccattcttctctcagccccacagcctgccgtagctgatattgcaggcctcacaccatgcaaagagtccaagcaattcgccaaacgtgagaagcagcagatcaagaagctggaatcgtcgttgaagctatacgcccctgacagcgctccagctctcgctatcaaagcaaccatcgagaaaaccaagagacggtttgacaactatgggaagtacgggctgttgtgtgggtctgatgggttgcctcatttgatagtgagcggtgatcagaggcactggggtgagttcatcacgcctggtctcttgttcttgtacatcgctggatggatcgggtgggttggaaggagctacctcattgctattagcgatgataagaagcctgccatgaaggagatcatcattgacgtgcctttggctaccggtcttatctttagaggctttatttggcctgtcgctgcttacagagagcttatcaatggtgaccttgttgtcaaggacgtttaatctcctcagggatcgaatggaaggacttgaactccaaggaatagctagggaagaagatgggagtgcttttagactgaatattcttggtgggaaatttcttgtacttaaaaaatgttgtttaaaaaaaacatacttttgagtcttatgtaatgctaatgttgaaacatttgttaactgaacgactttccatttcaatctttgttatccatattcatgtgacaatatgtgttataaaagggaatcgtaggataccatgaaatcttgaaaatattaaggagagagagaaatagatggtca

SEQ ID NO: 1613 - DNA, 1028 bp, Ricinus communis
tccacactcttcgtcttttcaaatctcctgctctttcatacttctttttcttcttttaactcttttctccaacccagaaaatcctagagaaaagcaaaatgtcacttacaataccttcaaatctctcaaaacccatgttaaagccaaagcttggctcttcattgaccccaagatcgtccatgattgtttgctcagcttctcaaacaccatcaacccaagaaaaggactcatctaaatctccacttcaagcattctctgcagcattagcactctcttccattctcttatcagctccacttcccgccgtggctgacatctctggcttgaccccgtgcaaagactccaaacagtttgctaaacgtgagaagcagcaaatcaagaagctggaatcttccctgaagctttacgctcctgatagtgcacctgctttggcaattaaggcaacagtagagaagacaaaacgcagattcgataactatggaaagcaagggttgctttgtggatcagatggacttcctcatttgatagtgagcggggaccagaggcactggggtgagtttatcactccagggatattgttcctttacattgcaggttggattgggtgggttggtaggagttacttgatcgctataaggggtgagaaaaagcctgcaatgaaggagattatcattgatgttcctttggccacgggcttgatctttagagggttctcttggcctgttgctgcttacagagagttcgttaatggcgaacttgttgttaaggacgtttaatctttatacattctcagtcacagctcagggatacggacaaagacaacagatggtttcattaaggagtgatttggttaggagattgctggagggatcttgtggaacatttgtacttttatattctgaacattgaacattaacttgtatgtatctaatgcctgtgtcggacatgagaaattgtttggcgttgctcatcttcctttctgattcacaatgatcaattaatgtgccaggaaaaataattactttttt

SEQ ID NO: 1614 - DNA, 1025 bp, Castanea mollissima
cttctctccacaccctttgcttcactcttcatcatcaactcctcccatctcccgcacaacaaacacttccatagaggcataacccaaacaaacatgtctctcactatccccacaaatctctcgaaacccattttgaagccaaagttgagctcttcccccaccccaaaatcaaggcctacgattgtatgcagctcccaaaacagtaaccaagatgagaaaatcaccacttcaccattgaaggccttctcagctgcactagctctctcttccatccttgtctcagccccaatactcccagccaatgctgacatcgcgggtctaaccccatgcaaagactccaagcaattcgccaaacgtgaaaagcaacaaatcaaaaagcttgagtcctcattgaagctttacgcacccgacagtgcaccagctctggctatcaaagcctcagtagaaaagacaaagcgtaggttcgacaattatggaaaacagggcttgctttgtgggtctgatgggcttcctcatttgattgtgagcggtgaccagaggcactggggtgagttcatcactccggggattctgttcctgtacattgctgggtggatcgggtgggtgggtcggagctacctgattgctataagggatgacaagaagccaacccagaaggagatcatcattgatgtgcctttggcttcgagtttgctcttcaggggtttcatttggcctgtggctgcttacagagagttagtgaatggtgatcttgttgtcaaggatgtctaaattcatcgtttctcagtagcttgggatgaagagatgcagtagagggaggtggagtgcttgtcctgggaatttgtttgaaggagaggtgtggtggaatatttcttgtatttaacttgtaaaaggttgcttcattttatgcgatattgcttgtgctggacattttaaactaatcttctttacatttttagccagtgtaatcaacaccaatgccaaatatcccactgaaccagaccgaacggcctaagtgttcattg

SEQ ID NO: 1615 - DNA, 1157 bp, Citrus clementina
agaatctaaaaaccatctatccacactgacaaaatcatttcacgtccatctccgcttctccattagacactcacacacacacacactctcaccctgaaagaaaagaagaaaaggaaaaagaagatgtctctgacaattccaacaaatctttcaaaacccctattgaagccaagatcaaactctcagttgagccatgcaaaattatcgaaacaaatgatcacgtgctcttcttccgctggttctgaagagacttcttcttcttctggcaaggccgccaagccgctccaggctttctcagcagcccttgcactctcctcaattctgctatcagccccacagcccgcagttgccgacatcagcggcctcaccccctgcaaagagtccaaacaattcgccaagcgcgagaagcagcagctcaagaagctcgagtcttcactaaaactgtacgctcccgacagcgccccggctctcgcaatcaaagccaccatggagaagacaaaacggcggtttgacaactacgggaagtacgggttgctgtgcgggtcagatgggttgccgcatctgattgtgagcggtgaccagaggcactggggtgagtttatcactccggggttgttgtttttgtacatagctggatggatcgggtgggttggcagaagctacttgatcgccattagcggggaaaagaagccggccatgaaggagatcatcattgatgttcctttggcttccaggttggtcttcagaggttttagctggcctgttgctgcttacagagagttcgttaatggtgaacttgttgtcaaggacgtttaatcattctatctatttctatctcctctgaagtgggactacagagcagggggctgacagaaagggaggaaatatgaaagctggatgcctggatttctgggaattggttgaggaatggggagagggaaattttatgtgtctaaagtttgtgaatttgattatgttgattgatactgatcctgatcctgatcaaatcaaactcaattctcgtttgctcttcacattcatgtgccactctatctccatgttatttttacgttggaagaaaaagaaagaaagaaagaaatgacaacagaaaatagagagtaagcattagctcaaaatggtgtttaattaagtgggag

SEQ ID NO: 1616 - DNA, 1166 bp, Citrus sinensis
agaatctaaaaaccaactatccacactgacaaaatcatttcacgtccatctccgcttctccattagacactcacacacactcaccctgaaagaaaagaagaaaaggaaaaagaagatgtctctgacaattccaacaaatctttcaaaacccctattgaagccaagatcaaactctcagttgagccatgcaaaattatcgaaacaaatgatcacgtgctcttcttctgctggttctgaagagacttcctcttcttctggcaaggccgccaagccgctccaggctttctcagcagcccttgcgctttcctcaattctgctatcagccccacagcccgcagttgccgacatcagcggcctcaccccctgcaaagagtccaaacaattcgccaagcgcgagaagcagcagctcaagaagctcgagtcttcactaaaactgtacgctcccgacagcgccccggctctcgcaatcaaagccaccatggagaagacgaaacggcggtttgacaactacgggaagtacgggttgctgtgcgggtcagatgggttgccgcatctgattgtgagcggtgaccagaggcactggggtgagtttatcactccggggttgttgtttttgtacatagctggatggatcgggtgggttggcaggagctacttgatcgccattagcggtgaaaagaagccggccatgaaggagatcatcattgatgttcctttggcttccaggttggtcttcagaggttttagctggcctgttgctgcttacagagagttcgttaatggtgaacttgttgtcaaggacgtttaatcattctatctatttctatctcctctggagtgggactctacagagcagggggctgacagaaagggaggaaatatgaaagctggatgcctggatttctgggaattggttgaggaatggggagagggaaattttatgtgtctaaagtttgtgaatttgattatgttgattgatactgatcctgatcctgatcaaatcaaactcaattctcgtttgctcttcacattcacgtgccactctttatctccatgttatttttacgttggaagaaaacaaaagaaaaagaaagaaagaaagaaatgacaacagaagaaaatagagagtaagcattagctcaaaatggtgtttaattaagtgggag

SEQ ID NO: 1617 - DNA, 1015 bp, Citrus sinensis
ccaactatccacactgacaaaatcatttcacgtccatctccgcttctccattagacactcacacacactcaccctgaaagaaaagaagaaaaggaaaaagaagatgtctctgacaattccaacaaatctttcaaaacccctattgaagccaagatcaaactctcagttgagccatgcaaaattatcgaaacaaatgatcacgtgctcttcttccgctggttctgaagagacttcctcttcttctggcaaggccgccaagccgctccaggctttctcagcagcccttgcactttcctcaattctgctatcagccccacagcccgcagttgccgacatcagcggcctcaccccctgcaaagagtccaaacaattcgccaagcgcgagaagcagcagctcaagaagctcgagtcttcactaaaactgtacgctcccgacagcgccccggctctcgcaatcaaagccaccatggagaagacgaaacggcggtttgacaactacgggaagtacgggttgctgtgcgggtcagatgggttgccgcatctgattgtgagcggtgaccagaggcactggggtgagtttatcactccggggttgttgtttttgtacatagctggatggatcgggtgggttggcagaagctacttgatcgccattagcggtgaaaagaagccggccatgaaggagatcatcattgatgttcctttggcttccaggttggtcttcagaggttttagctggcctgttgctgcttacagagagttcgttaatggtgaacttgttgtcaaggacgtttaatcattctatctatttctatctcctctggagtgggactctacagagcagggggctgacagaaagggaggaaatatgaaagctggatgcctggatttctgggaattggttgaggaatggggagagggaaattttatgtgtctaaagtttgtgaatttgattatgttgattgatactgatcctgatcctgatcaaatcaaactcaattctcgtttgctcttc

SEQ ID NO: 1618 - DNA, 1538 bp, Tamarix hispida
gggggtcctccaaactcttatttcctcacttccaactgcccttcctctgccacactcccccgggctctcctcctcctatcctggctacccgaactgaagaatcaaaggagtctgatcaaaccagccaaccagccagccatgtctctcaccatcccaaccacaaacgtgaccaagccacttagtatgaagcccaagctcaacctcccatcatctctaacaccaacaagatcatcttcctcactaagaatactctgttcatcatcagagcaaccccaacaacacaagtcatcgtcgccatcagcttccccactccaggcattctcagcggcactcgcactctcctcaatcctcctatcatccccacagccagccgtggcagacatatcgggtctcaccccatgcaaagaatcaaaacaattcgccaaaagggagaaacaacagctcaagaaactccaatcttctctcaagttatacgcgccggacagtgcaccagctctagcaatcaaagcaacaatggagaagacaaagaggaggttcgataactatggcaaatacggtttgttgtgcggttccgatggtctgcctcatctgatagtaagtggagatcaaaggcattggggcgagtttataacgcccgggttgttgtttttatacatcgctggctggattggatgggttggaaggagttatctgattgctattagagacgaaaagaaacctgcacagaaagagataattatcgacgttcctttggctactgggttgatttttagagggtttagttggcctattgctgcttacagagagttgttgaatggcgatcttgttgacaaaactgtttgattcagcttcctatcatttaaaaggaaaaaaaaatcaacatcgatcgaccaggtccgttttatcttaaattaattaattgccttgtgttaattcgcttgattatgagtgagcttaactcaattgtaagtgtttcagtttactttacgtgcactgttattccatcttcttgtccactaccactctttactcaggaaacggggcggcagaccgaagggtggaaatggccaaatgtgagggcctaccttgcttgcttgaggattccattccgttccactttcatatctagatgactgaacacagcaactatccatatataatctctgtacttaaattctgtgaaacccattggttttgattgtatgtatatttctctttttagtctttgggtgaaaagctcctgagtctacttccaatttttcttcttgctcgggaactaaatgggtcaaacctaatcaacatttacttcatcatcaacaactgaaaacactcgggtgctaattaaacatttcatcccaaagcataagaacttaattaatgcagaatgtaaagggttgaagataaaagagttcataagattacgatataaaaatgttctgttggactaggattacacgttttaattactcaacttacataggttccgtgctctatattaggagcggttcggaaaatgttttgatttccataatatatga

SEQ ID NO: 1619 - DNA, 932 bp, Euphorbia esula
  misc_feature (152)..(152): n is a, c, g, or t
ctccgcattcggcacgaggtcttcatcttctctcccaatcctcaattcattcccaccaaaatcaagcaaaaaaccaaaaaatgtctctcaccataccttcaaatctctctatcctcaagccaaagctcggattgaatccatcaagaacaccntctagatcatcagcaatcgtctgctcttcctcctccggcgaagaatccagcaaaacatcaaacctccaagccttctccgccgcactcgcactctcctcaatcctcctctccgcaccactccccgccgtcgccgacatctccggcctcactccgtgcaaagaatcaaagcaattcgctaaacgcgagaagcagcagatcaaaaaatgggagtcctcactcaaactctacgcgcctgacagcgctccagctctcgctctaaaagcgacgatcgagaagacgaaacgccggttccaagcgtacggtgataaaggactgctgtgtggatctgacggactgccgcatctaatcgtgagcggagatcagaggcattggggagagtttattacgccggggcttttgtttttgtatatcgccgggtggattggatgggttgggcggagctatttgattgcgattagaggtgagaagaagccggcgatgaaggagattattatcgatgttccattggcttcgagcttggttttcaaaggattttcatggccgattgctgcttacagagagcttcttaatggtgaacttgtggtgaaggatgtttgatttttgtgttttggtttgtaaaattcggaatgaatttgaatttcagggataggatgacaaaattggcaagggaaaggaaaggaaaggaaagggtttggagaagagatgatggaaattctgtttgtatgtttaatttattttgtgaacattaaacttgtatgtatctaatgttagtgttttgac

SEQ ID NO: 1620 - DNA, 967 bp, Cleome gynandra
cccccaatttcattcccacaattaaaccctaatttcaccaaatctcttatcccaaatcatgtctctcacgatccccacgaatctcgtgctcaaaccgagatccaattctctctctcagtccattcccaagtcctctaccaccgcgagattcgtctgctcggccgcgtcctccgatgaaaagctggcttctccggctgctcctttgaaggcgttctcggcagcgattgctctctcctctatcctcctctctactccgatgccggcggctgctgatatctctggcctgacgccatgcaaggagtctaagcagttcgcgaagagggagaagcaacagatcaagaagctcgagtcatcgcttaagctatacgctcctgacagtgctcccgctctcgccattaaagctcagatcgagaaaaccaaacgaaggttcgacaattacgggaagtacggactattgtgcgggtcggagggactgccacacctgatagtgaacggcgaccaacgtcattggggcgaattcattacgcccggcctcctcttcctctacattgctggatggatcggatgggtcggacggagttatctcattgccattagtgacgagaagaaacccgccatgaaagaaatcatcatcgatgtccctttagcgacccgtctcctcttccgcggcttcagttggcccgttgctgcttacagagagttccttaatggtgacctggtcgtcaaggacgtctagtttcccttctatattctcttcttcctcttgtgactctcctccaatgaatccaattaagtctttatccatctgttgtgagatttatattaattaatatgtatttatggttggacatatttcattttacatcaaatgacaacatattgtatatccatccttaattggagagttgttttctagagatttctaaagaagtatagaaatctttagagtattatgtagaactcttta

SEQ ID NO: 1621 - DNA, 1061 bp, Cleome spinosa
agtacgcgggtctgcttccacactcctcatatcccttcgccttcctctcgttttctccccaattcatccaaaaaaaccctaagttttcgaatctcgaatttggagcaatgtctctcacggtcccgacgaatctcgtgctcaggccgagatccaactctctctctcagtgcgtccccaagtcatccgccgccgcgagattcgtctgctccgccgcttcctccgacgaaaaatcagcttctccggcggccccgttgaaggcgttctcggcggcggttgctctgtcatccatcctcctgtcggctccgatgccggcggcggcggatatctccggcctgacgccgtgcaaggagtcgaagcagttcgcgaagagggagaagcaacagatcaagaagctcgagtcctcgctcaagctctacgctcccgacagtgctcccgccctcgccattaacgctcagatcgagaagaccaagcgaaggttcgacaactacgggaaatacgggctgttgtgtggatcggacgggctgccacaccttatagtgaacggggaccagcgccattggggagaattcatcacaccagggctcctcttcctctacatagccggatggatcgggtgggtcgggaggagttacctcatcgccattagcgacgagaagaagcccgcgatgaaggagatcattatcgatgtcccgttagccacccgcctcctcttccgtggcttcatctggcccgtcgccgcctacagagagttcctcaacggcgacctcgtcgtcaaggacgtctaaggttcttccccttctccctcgtttgtaaactccccgtaattctcaatacacttcggttcggtttttcatcatgtgtacgtataattaatgttgctactgtcttaccctttccggcaaagtacatgaaaacgttcttcctattgaaaaaaacaaaaatctctgcgagatcatgaattttctcctccattctcttgtttgaatcacataaactctccataattaggtcgctactttcttgcccttttggcccaaatatatgaaaagttcttctcctag

SEQ ID NO: 1622 - DNA, 814 bp, Fagus grandifolia
cttctctccacactctttctctgcaataaccagttttcaatagcagagtactaagggaaaaacaaagatgtctctcactatcccaacaaatctctcaaaacccattttgaagccaaagtttagctctccatcgagcccaaaaccaaggcctatgatactgaattgcagctcatcatcatcatcagccttcccaaaccaacaagcaagatgagaaaacaagttcaccattgcaagccttctcagctgctttagcactctcctccatcctcgtctctgccccactccccgccatggctgacatagctggactaaccccatgcaaggactccaaacagttcgccaagcgcgaaaagcaacagatcaaaaagctcgagtcctcgttaaagctctacgcgcctgatagtgctcctgctttagccatcaacgcaacaatagagaagacgaaacgtaggttcgacaattacgggaaacaaggtttgctttgtggctctgatgggcttcctcatttgatcgtgagtggtgaccagaggcactggggtgagtttatcactcccgggattctgttcctgtacatcgcgggttggatcgggtgggtaggtcggagctacttgattgctataagggatgagaagaagccgaccgagaaggagatcatcattgacgtgcctttggcaagtagtttgcttttcagagggtttatctggcctgtttctgcttacagagcgttcgtcactggtgatcttgttgtcaaggacgtctagattcatcatttctcagtggcatgggatgaagagacgcaggcgagggaggtgga

SEQ ID NO: 1623 - DNA, 973 bp, Cucumis sativus
accactaatctcatgatcctctctgaatctaaaaccgttccctccacactctttctccaaatctccatcttcttcttcctgcaattcccaattccttcgaacccatttcaacaatgtctctcacaatccccactaacctctcaaaacccctcttgaagcccaaatttagctccccactcgccttgaagccaaaaccctcctcatctattctctgctccgcctcccaaaatcaaaaccaaaacacctcttcctctcttcaagccttctccgctgccttggctctctcctccatcctcctctccgctcctctccccgccgtcgccgacatctccggtctcaccccctgcaaggaatccaagcaattcgccaagagggagaagcagcagatcaagaaacttgagtcttctttgaagaactacgccccggatagcgccccggcgcttgccatcaaagccacgatcgaaaagacaaagaggcgatttgccttctatgggaaacaagggcttctttgtggtgctgatggcttgcctcatttgattgtgagtggtgaccagaggcattggggtgagttcattactcctggattcttgttcctttacattgctgggtggattggatgggttggaaggagctacttaatcgccattagagatgaaaagaaacctacccaaaaggagattatcattgatgttcctttggccactagtttggtgtttagaggcttcagctggcctgttgctgcttacagagagcttgtcaatggtgaactcattgccaaagatgtctaattcttctacttcagagatagggaaagtggaagtggaattgagttttggaggatatggaggggaatggcatggagtttgtgaaatatttgtgtatttaatttggaaacttgagatgagtatatgtaatggttggtttgtgttggatacaagggcaatctattcttttcacttcccctttcttttgt

SEQ ID NO: 1624 - DNA, 987 bp, Vigna unguiculata
caccaatctgcctctatcagaatctaaaaaccttcccttcttacttctcttacaacccttcactccattctcttctcacacaaccaaccatgtcgctcacaattcccaccaatctatccaagcccgccgccctccgccccaaactaggcgccaaactgcgtcccaccattgtctgcagtgccactcccaacaactccgacaacaacatatcctccgatctgaaggccttctccgccgccctcgccctctcctccatcctgctctcggcgccgctccccgccgtcgcggacatctccggtctgaccccgtgcaaggagtcgaagcagttcgcgaagcgcgagaagcagtcgataaagaagctggagtcgtcgctgaagctgtacgagccggacagcgctcccgccctggcgataaaggcgtcggtggagaagacgaagcggcggttcgacaactacgcgaagcaggggcttctgtgcggtgccgacgggcttccgcacctgatcgttagcggtgatcagaggcactggggcgagttcatcactcctgggttcctcttcctgtacatcgccgggtggatcgggtgggtgggtcggagctaccttattgccatcagggatgagaaaaaacccaccatgaaagagatcatcattgacgttcctctcgcctctcgcttgctcttccggggcttcagctggcccgttgctgcctacagagagctcatcaacggtgacctcattgccaaggatgtttagcccaattcattccttcccaagatcagatagaggaagccagggtgggatgtttatgcgctcactttgtatcattttttaatccatgtaatgtaatgtaatctaatgcatctcaaccttttcgcttcttttctcttctcattctcttccattatataacacttcactatctgtatgctcaatttcttcactattactcaatcactcaatgcctatactcaccttctatctcaccaca

SEQ ID NO: 1625 - DNA, 813 bp, Brassica juncea
gcctctcagattctttttcttctagagaaaaaagaagaagaggattgtgtttttttgtctcttcttccatattctccgtcaatcctcgctcctctgatattccctatccaattcttcacgtggatcgatctgattgcgttttacaaatcctaagagccatgtcgctcacgatcccgacgaacctcgtcgtcaacagtatatcatccaacaagactctcactcaatccgtacctaaatccaccgcgagattcgtctgctccaccgatgacaagtccatgaaggcattctccgcggcggtggctctctcttccatcctcctctcagctccgatgccagccgtcgctgatatctcgggcttaaccccttgcaaggagtcaaaacagttcgccaagagggagaagcaacagatcaagaagctcgaatcatctctcaagctctacgctcctgagagtgctcctgctcttgctcttaacgctcagatcgagaagaccaaacgcaggttcgacaactacggcaagtacgggcttctgtgcggtgcagacgggctaccacacctgatagtgaacggagaccagaggcattggggagagttcataacacctggacttttgttcctctacattgcgggatggatcgggtgggtggggagaagctacttgattgcgattagtgatgagaagaaacctgcgatgaaagagatcataattgatgttccattggctagtcgtctcatcttccgtggtttcatttggcctgttgctgcttacagagccttgctcaatggcgatctcattgccaaggatgtttaagaaa

SEQ ID NO: 1626 - DNA, 1036 bp, Eucalyptus grandis
gggagcatcacaagccatcgtccgaccagaatcctgcagccatgtcgctcaccatccccaccaatctctccaagcccatcgccgccccgaagctcagcccctccaagtcagtcaggccggccgccaccctcataagatgctcctcttcctcccctgagcagggctccgcctccacctcggcggcgtcgcctctccaggccttctccgccgcgctcgccctctcctccatcctcctctcggcgccgcagcccgcggccgccgacatcgcggggctgaccccgtgcaaggagtcgaagcagttcgcgaagcgggagaagcagcagctcaagaagctggagtcgtcgctgaagctgtacgcccccgacagcgccccggccctggccctcaaggccaccatggagaagacgaagcggcggttcgacaactacggcaagcaggggctgctgtgcggcaccgacgggctcccccacctgatcgtgagcggggaccagcggcactggggcgagttcatcaccccgggcatcctcttcctctacatcgccgggtggatcgggtgggtcggccggagctacctcatcgccatccgcgacgagaagaagcccacccagaaggagatcatcatcgacgtccccctcgcctcccgcctcgtcttccgtggcttcagctggcccatcgccgcttacagagagctcgtcaacggcgagctcatcgccaaggacgtctaatttaagccccctcgacacaaggcgggcggcctcggaggacgagaagcttggtggaagtgggaagcatggattctcccggtatctgtctttcttgtatgaatgaatgcagagcggaacatgggtttgaatgtattctgctttgttcgttggatggcacattggtcccctctatcttctgtacttctgtttctttcgtttacgctccttcttcttcctttttcttccttttttttttttagggtttcttttgtaaattttgatggtggatgacaatatgacttatttccattgatggatggagcattttggtt

SEQ ID NO: 1627 - DNA, 1068 bp, Vitis vinifera
cccaatcacacccacccacctcaccctccaccttatcctcctctccaccaatcccacctcccttggaatctaaaaaccattcctcagtcctccgtcctcaactcttccatctccatttctgtccaactcccctgccaactcgccaacaatgtctctcaccatccccacaaacctctccaagcccctcaagccaaggctcagctctccctccttccaaaaggcaaggcctatgatagtgtgctcagcctcaactgagccacagcccaccaacaaatctccactccaagcattctctgctgcgcttgcactctcctccatcattctagctgctccagtccctgcctatgctgacatcgccgggctcacaccctgcaaggagtccaaacagttcgccaagcgggagaagcaggcactgaagaagctggagtcatcgctgaaattgtacgcgccggactcagccccagcgctggccataaacgcgacgatcgagaagacaaagaggaggttcacaaactatgcgaaccaagggttgttgtgtgggtcggatgggctgccacacttgatagtgagcggggaccagaggcactggggagagttcattacaccagggatattgtttttgtacattgctggatggatagggtgggttggaaggagctatctgatagccatcagggatgagaagaagccaacacagaaggagatcatcattgatgtgcctttggcttctaggttggtcttcagaggctttatttggcctgttgctgcctacagagagttcgtcaatggtgatctcattgccaaggatgtctaattatttctcttctaagttctaccatcaccaccaccagtgggaaagactttggctgacaggaagacaaggcctgagatttgggagttgcatgtgagaggaagagaggagtggaggccagtgggggagaggtgaaagatttcttgtatttattttgtaaacttaattgtatctaatgctttgtgttgaacactaagtctgccttgtctttccatctatgattatttacacccctcttgcacttaccctcttcctca

SEQ ID NO: 1628 - DNA, 1033 bp, Cucumis melo
accactaatctcatgatcctctctgaatctaaaaccgttccctccacactctttttccaaatctccttcttcttcttcctgcaattccctaatccttcaaacccatttcaacaatgtctctcacaatccccactaacctctcaaaacccctcttgaagcccaaattgagctccccattggccttaaagccaaaaccctcttcatccatcctctgctccgcctttccaaatcaaaatcaaagtcaaaacccctcttcctctcttcaagccttctccgctgccttggctctctcctccatcctcctctccgctcctctccccgccgtcgccgacatctccggtctcaccccctgcaaggaatccaagcaattcgccaagagggagaagcagcagatcaagaaacttgagtctgctttgaagaactatgccccggatagcgccccggcgcttgccatcaaagccacgatcgaaaagaccaagaggcgatttgccttctatgggaaacaagggcttctttgtggggctgatgggttgcctcatttgattgtgagtggtgaccagaggcattggggtgagttcattactcctggattcttgttcctttacattgctgggtggattggatgggttggaaggagctacttaatcgccattaggaatgaaaagaaacctacccaaaaggagattatcattgatgttccgttggccactagtttggtgtttagaggcttcagctggcctgttgctgcttacagagagcttgtcaatggtgaactcattgccaaggatgtctaattcttctccttcagagatagggaaagttgaagaggaattgagttttggaggatatggaggggaatggaatggggtttgtgaaatatttgtgtatttaatttggaaacttgagatgagtatatgtaatggttggtttgtgttggatataagggcaatccattcttttcacttcccctttcttttgtattcaaaattctctaacattattgacccagcaatcttttcttaagtaattaact

SEQ ID NO: 1629 - DNA, 855 bp, Cucumis melo
accactaatctcatgatcctctctgaatctaaaaccgttccctccacactctttttccaaatctccttcttcttcttcctgcaattccctaatccttcaaacccatttcaacaatgtctctcacaatccccactaacctctcaaaacccctcttgaagcccaaattgagctccccgttggccttaaagccaaaaccctcttcatccatcctctgctccgcctttccaaatcaaaatcaaagtcaaaacccctcttcctctcttcaagccttctccgctgccttggctctctcctccatcctcctctccgctcctctccccgccgtcgccgacatctccggtctcaccccctgcaaggaatccaagcaattcgccaagagggagaagcagcagatcaagaaacttgagtctgctttgaagaactacgccccggatagcgccccggcgcttgccatcaaagccacgatcgaaaagaccaagaggcgatttgccttctatgggaaacaagggcttctttgtggggctgatgggttgcctcatttgattgtgagtggtgaccagaggcattggggtgagttcattactcctggattcttgttcctttacattgctgggtggattggatgggttggaaggagctacttaatcgccattaggaatgaaaagaaacctacccaaaaggagattatcattgatgttccgttggccactagtttggtgtttagaggcttcagctggcctgttgctgcttacagagagcttgtcaatggtgaactcattgccaaggatgtctaattcttctccttcagagatagggaaagttgaagaggaattgagttttggaggatatggaggg

SEQ ID NO: 1630 - DNA, 1645 bp, Glycine max
ccaatggattctcccttactagaaaacattgacaactctactacttatgttgaggagaagaagacactgaactctgttgttaagaaattcgggtttgagtcgaagaagctatggaaaatagcaggccctgctatcctcacctctatatgtcagtactcacttggtgcactcactcaaacatttgctggcctagttggtgaccttgaacttgcagcagtttctgttgaaaattctgttgttgctggcctcgcctttggagtcatgttgggaatggggagtgccttggagactctgtgtgggcaagcatatggtgcgggacagagcacgatgttgggtgtgtacatgcagagatcatgggtcatcttgttcgtcactgcccttattttgttacctctttatatttggtcacctcccatcttgaggctctttggacagacggctgagatctcagatgctgctgggaaatttgctctgtggatgatacctcagttgtttgcatacgctataaactttccaatggttaagttcctacaggcacagaggaaagtgctggtgatgttatggatatcagtagttgttttggtgctgcacacattttttagttggtttcttatatttaagcttggatggggcctaattggagcggcaattactctcaacacatcatggtgggtcattgtgattgcacaattgttgtacattttcatcactaagtcagatggagcttggaatgggtttacatggctagcattttcggacttgtttggttttgtaaagctttctctggcttcagctgttatgttatgcttggagttttggtatttgatgatactggtggtgataacagggcgtttgaaaaatcctctagtaccagttgatgccatatctatctgtatgaacataaacggttgggatgccatgattgcaattgggttcaatgctgctataagtgtgagagtatcaaatgagctgggggctggtgatttcaaggctgcaaagttttcagtgtgggtggtttccatcacatcagtgttcataggtgttgttgccatgatcggagtgctatcaaccaaggattactttccctacttgtttaccaccagcgttcctgttgccaatgaaacaactaggcttgctgctttgctcggtgtcacagtgcttctaaacagccttcaaccagtcctatcaggtgttgctgttggggctggctggcaatctctagtagcatgcatcaacattgtgtgctactatgttattggattaccggcagggataatattgggatttccacttggtcttggagcagagggtatttggtcagggatgattgctggcatagttttgcagactacaatccttataatcgtcacttcaatacgcaactggaaaaaagaggctgaagaagcagagagccgcgtgaaaaagtggggaggagcaattgcatatgatcaatgatgactttttatcatagttgagaattaggcagagattctattaagttgtatcaataatgattgaaaatttttaacatgtatttgaattttagattataggtcagcttgttatgatttctacatagataattcatatgattgagcactgattaaacaagtgttaaattaagttatttaaacaaaagaatctc

SEQ ID NO: 1631 - DNA, 1573 bp, Glycine max
tctgttgttaagaaattcgggtttgagtcgaagaagctatggaaaatagcaggccctgctatcctcacctctatatgtcagtactcacttggtgcactcactcaaacatttgctggcctagttggtgaccttgaacttgcagcagtttctgttgaaaattctgttgttgctggcctcgcctttggagtcatgttgggaatggggagtgccttggagactctgtgtgggcaagcatatggtgcgggacagagcacgatgttgggtgtgtacatgcagagatcatgggtcatcttgttcgtcactgcccttattttgttacctctttatatttggtcacctcccatcttgaggctctttggacagacggctgagatctcagatgctgctgggaaatttgctctgtggatgatacctcagttgtttgcatacgctataaactttccaatggttaagttcctacaggcacagaggaaagtgctggtgatgttatggatatcagtagttgttttggtgctgcacacattttttagttggtttcttatatttaagcttggatggggcctaattggagcggcaattactctcaacacatcatggtgggtcattgtgattgcacaattgttgtacattttcatcactaagtcagatggagcttggaatgggtttacatggctagcattttcggacttgtttggttttgtaaagctttctctggcttcagctgttatgttatgcttggagttttggtatttgatgatactggtggtgataacagggcgtttgaaaaatcctctagtaccagttgatgccatatctatctgtatgaacataaacggttgggatgccatgattgcaattgggttcaatgctgctataagtgtgagagtatcaaatgagctgggggctggtgatttcaaggctgcaaagttttcagtgtgggtggtttccatcacatcagtgttcataggtgttgttgccatgatcggagtgctatcaaccaaggattactttccctacttgtttaccaccagcgttcctgttgccaatgaaacaactaggcttgctgctttgctcggtgtcacagtgcttctaaacagccttcaaccagtcctatcaggtgttgctgttggggctggctggcaatctctagtagcatgcatcaacattgtgtgctactatgttattggattaccggcagggataatattgggatttccacttggtcttggagcagagggtatttggtcagggatgattgctggcatagttttgcagactacaatccttataatcgtcacttcaatacgcaactggaaaaaagaggctgaagaagcagagagccgcgtgaaaaagtggggaggagcaattgcatatgatcaatgatgactttttatcatagttgagaattaggcagagattctattaagttgtatcaataatgattgaaaatttttaacatgtatttgaattttagattataggtcagcttgttatgatttctacatagataattcatatgattgagcactgattaaacaagtgttaaattaagttatttaaacaaaagaatctc

SEQ ID NO: 1632 - DNA, 1768 bp, Glycine max
attgaataaataattaatcacaattaacaaatcctagacacaaaacaaaaagtggggcgggcacgcagagcagagggaggaagaaagggtcgaagagaatgtgggaatcaattgttttgacggtggttgccactgccggcaacaacatcggcaaaatccttcagaagaagggcactgtcattcttccccctctctctttcaagctcaaggcatgtcataagggcatatgctttgaacaaaacctggctcataggttttgtaatggatatatttggggcactgttgatgttaagggcattagctcttgctcctgtctccgtcatccaaccagtttctggctgtggattggcaattctctcagtcttttctcatttttatctcaaggaagttatgaatattgttgattgggtgggcattaccttggcaggttttggcacaataggagttggtgctggaggtgaggagcaagaggctgctgctctatctatatttcacataccgtggctggcatttgttgttttcatcttgtttataatgcttaatggatggcttcgcatattcaaacgcaatcgaagagaacaagagatgatggaatatgatgttgttgaggaaattatttacggcttagaatctggaattttgtttgggatggcatctgtaatatcaaagatggggtttctgttcttggagcaaggcttccccaagctgttggttcctatttgcatcatcataagtgtctgttcaagtggtacaggcttttactaccagacacgtggtctaaaacatgggcgggctattgtagtttctacatgtgccgcagtggcatcaattttgactggtgtacttgctgggatgcttgctttgggtgagcgactcccttcggccccaaaagctcgcttgttacttcttcttggatggctacttataattgttggcgtgattttacttgttggttctacaaagctagtgagattctttcgattttcttcacaccgctttaagaattatggccctagaagatctggaacttcccgtgttagggaacctagcccaactgctgtcattcaagcagcgaccttaaatcatttactctcatcatcttccaaagaaaaagcttgatttgacttgagctggaaaatgatccttcatccattctcaggaatcaccctcaccccttaaagaagaagaccccttttgtaaggttaggttgtttgtgtacagtggttgctttatcagagggcatgaatttttagggatcattccttctggctcacgtattttacgtgaaaaatcatcaccttttctgatgccacttgtataattcatgaacttccaatatttctcaatattgtatatgaagatggtatagccagatgcagaatgctagcatatcatggaaacaaattgcagggtgcagtggagaacgatttattcctaatttcttatgctaatgtagtagcagtgttctttgagattaggtttgacttccgttaccgggtaataggacaaggctgtactttatcctctggaaactatcatcgtggcaaaagtgctgattccatcaaaatttaggccacaaaccctccgttgaagggaattataatgatgatttgatcctgattgttagatgagggagagtttactatttgacatttctaaagtgagagggtatatttatttccttttaatttaaagttaagattgtgaggtattttaatcaaaatcaagaggtagatatattcttaccttttcactttacacattcttt

SEQ ID NO: 1633 - DNA, 1685 bp, Cajanus cajan
tacgggggacaattaatttcataattaagaaatcataaacacaaaaggaggggcagagcagagggaggaagaaaggatcgtagagaatgtgggaatcaattgttttgacggtggttgccaccgccggcaacaacatcggcaaaatccttcagaagaagggcacggtcattcttccccctctctctttcaagctcaaggtcataagggcatatgctttgaacacaacctgggtgataggttttctaatggatatatttggggcactgttgatgctaagggcattagctctggctcctgtctctgtcatccaaccagtttcgggctgtggactggcaattctttcggtcttttctcatttttatctgaaggaagtcatgaatattattgattgggtgggcattaccttggcaggttttggtacaataggagttggtgctggaggcgaggagcaagaggctgctgctctatctatttttcacataccgtggctggcatctgttgttttcatcttgtttttattgcttaatggatggcttcgtatatgcaaacgtcatcgaagagaacaagagatgatggaatatgatgttgttgaggaaattatttatggcttggagtctggaattttgtttgggatggcatctgtaatatctaaaatggggtttctgttcctggagcaaggcttcaataagctgttggttcctatttgcatcatgataagtgtgtgctcaagtggtacaggcttttattaccagacacgtggtctaaaacatgggagggctattgtagtttctacatgtgcagctgtggcatcaattttgaccggtgtacttgctgggatgcttgctttgggtgagcgactaccttcggccccaaatgctcgcctgttacttcttcttggatggctacttattatttttggtgtgattttacttgttggttcaacaaagatagtgaggatccttcgaaattcttcacaacgcctgaaaagcagtgtcgataagaattacggccctagaagatctggaacttcccgtattagggaacctagcccaactgctgtcattcaaacagcaaccttaaatcagttactttcatcatcttccaaagaaaaagcttgatttgacatgagctggaaaatgacccttgatccattctcaggattcaacctcatcccataagaaagaccccttttgtcaggctaggttatttgtatactgtggctgctttatcagagggcatgaatttttggggatcattccttctggttcacatattttacatgaaaatttattaactttctgacgccacttgtataaactattcatgaatttctaatatttctcaatactgtatatgaagatggtatagcaacatacacaatgctaacatagcatggaaacaacttgtaggctgcagtgcagaacatgtttcctagtttccaatgctaatttagtagcaatgttatttgagaacaggtctgacttcatcctctggaaattttcatcggggcataggggctgattctatcaaaaggttacaagccctttgtaggagggcaacataaagatgttttgatcctgacaattatatgagggagtttacttttgacttttctaaagtgagatggtgtaaagtgaaaaatatggtatatttcctttgatttaaagttgagattgtgaggtgtt

SEQ ID NO: 1634 - DNA, 1138 bp, Lotus japonicus
ggaatcctagaagagagagagagagagagagaggagggggaagaagaagaagaagcagcagaagaagaagcaagggatcggagagaatgtgggaatcaattgttttgacggttgttgcgactgccggaaacaacatcggcaagatccttcagaagaaaggcacagtcattcttccccctttctctttcaagttcaaggtattaaggtcatatgctatgaacaaaacatggttgacaggttttgtaatggatatatttggtgcattattgatgttaagggcattagctctggctcctgtatctgtcatccaaccagtttctggttgtggactggcaattctttcaatcttctctcacttttatctcaaggaagtcatgaatgctgttgattgggtgggcataactttggcaggttttggcacaataggagttggtgctggaggcgaggagcaagaggctgctgctctatctatttttcacataccatggctggcatttgctgttttcatcttgtttatcttgcttaatggatggcttcgtatacgcaaacgtcagcgaagagaacaagagatgatggaatatgatgttgttgaggaaataatttacggcttggaatcagggattttgtttgggatggcatctgttatatcaaagatgggatttctattccttgaacaagggttccccaagctgctggttcctttgtgcctcatcatcagtgtgtgctcaagtggtacaggtttttactaccagacacgcggtctgaagcatgggagggctatcgtggtttctacatgtgcagccgtggcatcaattttgactggtgtacttgccgggatgcttgctttgggagagcgactcccttcagccccgaaagctcgattggtacttcttcttggatggttactcattattttaggcgtgattttacttgttggttcaacaagagtagtgagattcctccgattaaattcacagcgctttaaaagaaccagtgttgataagaatcatggccctagaagatctgcggcatcccgtatcagggaaccaagtccaactgctgttattcaagcagcgaccttaaatcatctactggcatcatcttccaaagaaaaagcttgatttgactgagctggaaa

SEQ ID NO: 1635 - DNA, 1552 bp, Medicago truncatula
aattaacaattatagattttttctttgaaaaaaaaaattatagatttttatagacaaaaataaaattaacatgttaactttaccagcaatagatcgtgaatgaaaccaaaccaacaaatcatagaatcaaaaccaacgaattttttcaacattttctcacagtatcatgtgggaatcgattctattaacggtggctgcaaccgccggtaacaacatcggaaaaatccttcaaaaaaagggcactattattctccctcctctctccttcaagctcaaggttattagggcttatgctttgaacaaaacatggtcgataggtttcctgatggatatttttggggcgttattgatgttaagggcattgtctctggctcctgtctctgttattcaaccggtttctggctgtggactagcgattctgtcaattttttcccatttttatctccaagaagtcatgaatgttgttgattgggttggaattaccttggctggttttggcacaataggagttggtgctggtggtgaggagcagcaagagatggttgctctatctatttttcacataccatggctggcatttgttgtttccatcttgtttatactgcttaatggatggcttcgaatatacaagcgtcagcgaagagaacaagagatgatggagtatgatgttgtcgaggaaatcatttatggcttggaatctggtattttgtttgggatgtcatctgtaatatcaaagatgggatttctattccttgagcaaggttttcccaagattctggttcctatatgcctcttgatcagtgtatcttgtagtggtatcggcttttactatcagacacgtggcctaaagcatgggagggcaattatagtttctacatgtgcagctgtggcatcaattttgaccggtgtacttgctgggatgcttgctttgggtgagcgacttccttccgccccaaaagcccgtctagcacttcttcttggatggctacttataattactggtgtgattttgctcgttggctcaacacggctactgagattcatcacttcgcggcaaaaaagaagtaacatggagaagaattatggccctagaagatccactacttcccgtgtgagggagccaagtcctaatagtgctgtcattcaagcatcaacattaaatcatctgttatcatcgtcttccaaagaaaaagcttgactcaacacgatctagaaaatggtccttcaccccttcacaaaatttctaagcattaagctgctaaagccaaggtgtatgatgtatattgaatggctgcttcatcactcattagggggtgcgacatttgttctggaatcataccttctggctcatagtttggacatgaaatatctgtcaactttctcgtactatcttgtataaactattcctgaactttcaccatgttggcttttggagattgtatatgatagtgatagtgatagtgatagtgatggtggcataccaacataaatacctttatcttgtcagtaaacaaattttaataatgaacaatttattcctgtttactggtac

SEQ ID NO: 1636 - DNA, 1360 bp, Arachis hypogaea
ctgaagaagagagatgtgggaatctatcgttttgacggtggttgccaccgccggcaacaacgtcggcaagatccttcagaagaagggcacactcattctcccccctctctctttcaagctcaaggtcataaaggcatatgcttcaaacaaaacctggttgataggttttcttatggacataattggggcactgttgatgttaagggcactttctctagctcctgtctctgttatccaaccagtttctggcagtggactggccattctttcgatcttttcgcatttttatcttaaggaagtcatgaatgttgttgattgggttggcattaccttggcaggttttggcacaataggagttggtgctggaggtgaggagcaagaggcttctgctctatccattttacatataccgtggctggcatttgtcgttttcatcttgtttatactacttagtgcatggcttcgtatatgcaaacgtcatcgcagagaacaagagatgatggaatatgatgttgttgaggaaatcatatatggcttggaatctggaattctgttcgggatggcttctgtaatttcgaagatgggatttttattcctggagcaaggtttccccagcctgttggttcctatgtgcatcatcatcagtgtattctttagtggtgcaggcttattctaccagacacgcggcctaaagcatgggagggctattatagtttctacatgtgcagctgtggcatcaattttgactggtgtacttgctgggatgcttgctttaggcgagcgactcccttcggccccaaaagctcgtttcgcacttcttcttggatggctgcttatcattgttggcgtggttttactcgtgggttcaaaaaggctggtgagatttcttagagttccttcgcgccgctttaagaattatggcactcgaagagccgggacatcccgtatcaaggaaccaagcccaactgctgtcgttcaagcagcaaccttgaatcatttactatcatcagcttcaaaagaaaaagcttgatttgaagttagctggaaaatgatccttcatccattcccaacaagaaaaaaagaaagatgggaggttggggttggcttggtaggttgattttgtgtatagttggttctttcatcagagggcatgaattttcaaggatcattccttctagctaacgcaatttaaggtagagttgttcgttgattttctcatgtcaccttgtgttaattttactcaaatattgtatatgcatagccaagaaagccgtcacaactaatagcaatttaaagaaataaaaaagagaaaacaaacacgccattgagaaaagaagaaagaaaattccatcgtgctatg

SEQ ID NO: 1637 - DNA, 1804 bp, Glycine max
attgaataaataattaatcacaattaacaaatcctagacacaaaacaaaaagtggggcgggcacgcagagcagagggaggaagaaagggtcgaagagaatgtgggaatcaattgttttgacggtggttgccactgccggcaacaacatcggcaaaatccttcagaagaagggcactgtcattcttccccctctctctttcaagctcaaggtcataagggcatatgctttgaacaaaacctggctcataggttttgtaatggatatatttggggcactgttgatgttaagggcattagctcttgctcctgtctccgtcatccaaccagtttctggctgtggattggcaattctctcagtcttttctcatttttatctcaaggaagttatgaatattgttgattgggtgggcattaccttggcaggttttggcacaataggagttggtgctggaggtgaggagcaagaggctgctgctctatctatatttcacataccgtggctggcatttgttgttttcatcttgtttgtaggtaccctgtcttatgttttgttattgttcctaattgttagaaacaattgtacagataatgcttaatggatggcttcgcatattcaaacgcaatcgaagagaacaagagatggtaattcttgctttaatcatgataagaagcctttcttacatgatggcatctgtaatatcaaagatggggtttctgttcttggagcaaggcttccccaagctgttggttcctatttgcatcatcataagtgtctgttcaagtggtacaggcttttactaccagacacgtggtctaaaacatgggcgggctattgtagtttctacatgtgccgcagtggcatcaattttgactggtgtacttgctgggatgcttgctttgggtgagcgactcccttcggccccaaaagctcgcttgttacttcttcttggatggctacttataattgttggcgtgattttacttgttggttctacaaagctagtgagattctttcgattttcttcacaccgctttaagaattatggccctagaagatctggaacttcccgtgttagggaacctagcccaactgctgtcattcaagcagcgaccttaaatcatttactctcatcatcttccaaagaaaaagcttgatttgacttgagctggaaaatgatccttcatccattctcaggaatcaccctcaccccttaaagaagaagaccccttttgtaaggttaggttgtttgtgtacagtggttgctttatcagagggcatgaatttttagggatcattccttctggctcacgtattttacgtgaaaaatcatcaccttttctgatgccacttgtataattcatgaacttccaatatttctcaatattgtatatgaagatggtatagccagatgcagaatgctagcatatcatggaaacaaattgcagggtgcagtggagaacgatttattcctaatttcttatgctaatgtagtagcagtgttctttgagattaggtttgacttccgttaccgggtaataggacaaggctgtactttatcctctggaaactatcatcgtggcaaaagtgctgattccatcaaaatttaggccacaaaccctccgttgaagggaattataatgatgatttgatcctgattgttagatgagggagagtttactatttgacatttctaaagtgagagggtatatttatttccttttaatttaaagttaagattgtgaggtattttaatcaaaatcaagaggtagatatattcttaccttttcactttacacattcttt

SEQ ID NO: 1638 - DNA, 1400 bp, Glycine max
gcatgtgggaatctgttgtgttgacggtagctgccaccgccggcaacaacatcggaaagatccttcagaagaagggcactatcattcttccacctctctctttcaaactcaaggcattcattattagtttctatagctgtgtttatttggtcataaggtcttatgctttaaacaaaacctgggtggtaggttttctaatggatatattaggggcattattgatgttaagggcattgtctctggctccagtgtctgtcatccaaccagtttctggctgtggactagcaattctttcaatcttttctcatttttatctcaaggaagtcatgaatgctgttgattgggttggcattacattagcaggttttggcacaataggagttggtgctggaggtgaggagcaagaggtggttgctctatctatttttcacattccagggctggcatttgttgttttcatcttgtttatacttcttagtggatggcttcgaatatgcaagtgccaacgaagagaacaagagatggtggaatatgatgttgttgaggaagtcatttatggcttggaatctggaattttgtttggtatgtcatctgtaatatcgaagatgggatttctattcctagagcaaggttttcccaagctgttggttcctatgtgcatcatgattagtgtgtgttgtagtggcactggcttttactaccagacacgcggtctaaagcatggaagggctattgtagtttccacatgtgccgctgtggcatcaattttgactggtgttcttgctgggatgcttgctttgggtgaacgacttccttcggaaccaaaagctcgcttggcacttcttcttggatggctacttattatagttggtgtgattttacttgttggttcaacacggctagtgagattcctttcttgttcttcacagcgaaaaagaagcaatgtggataagaattttgaccttagaagagccacttcttcccgtgtgagggaaacaagtccaagtgctgtcattcaagcagcaacattaaatcatttactatcatcatcttccaaagaaaaagcttgagctggcatgagctggatcatgttccttcatccttcccaggatttctaagcattattaagttgctttctaatccatctgccaaggccagggagtattctgtatagcatagaggctgcttcatcagagggcatggcattttggtgatcattcattgcttctggctcacattttggatgaaatatttgttaacttctgatgcaacttgtaaaaactattcatgaacttacactactagtgagtgtacccgtgcactgcacgggttgataaagaaataaattttttgttaaaatgaattaatttgtataaaaaaatagacctttaatatccaca

SEQ ID NO: 1639 - DNA, 1592 bp, Glycine max
cgagtatccgaagttcttcatttctaattatgaaatttagtatttaagctcatcaaatccaaccactagtttatatactaattgatattagtgttaatatattacactaataagaaataattggtagcttcttaggtagcataacaattgaaacttgaaagtaacagtctaacaacagatcgttaaggagaccaaaccaacagaacagagtaacagagagttagcattgcaacaaagagaaagaaaagttgaaacattttcagacagtggcatgtgggaatctattctgttaacggtggctgccaccgctggcaacaacatcggaaagatccttcagaagaagggcactatcattcttccacctctctctttcaaactcaaggcattcattattactttctatagctgtgtttatttggtcataaggtcttatgctttaaacaaaacctgggtggtaggttttctaatagatatatttggggcattattgatgttaagggcattgtctctggctccagtctctgtcatccaaccagtttctggctgtggactagcaattctttcaatcttttctcatttttatctcaaggaagtcatgaatgctgttgattgggttggcattacattagcaggttttggcacaataggagttggtgctggaggtgaggagcaagaggtggttgctctatctatttttcacataccagggctggcatttattgttttcatcttgtttatacttcttagtggatggcttcgaatatgcaagcgccaacgaagagaacaagagatgatggaatatgacgtcgttgaggaagtcatctatggctttgaatctggtattttgtttgggatgtcatctgtaatatcaaagatgggatttctattcctagagcaaggctttcccaagctgttggttcctatgtgcatcatgatcagcgtgtgttgtagtggcacaggcatttactaccagacacgtggtctaaagcatgggagggctattgtagtttccacatgtgcagctgtggcctcaattttgactggtgttcttgctgggatgcttgctttgggtgaacgacttccttcggagccaaaagctcgcttggcacttcttcttggatggctacttattattgttggtgtgattttacttgttggttctacacggttagtaagattcctttcttgttcttcacgacaaaaaagaagcaatgtggagaagaattttggccttagaggagccacttcttcccgtgtgagagaaccaagtccaagtgctgtcattcaagcagcaacattaaatcatttactatcatcatcttccaaagaaaaagcttgagttgacatgagctggataatgttccttcatccccaggatttctaagcattaagttgctttctaatccgtctgccaaggccaattctgtatattatagtggcgcttcatcagagggcatgacattttggtgatcattcattgcttctggctcacacattttggatgaaatgtttgttaacttcagatgccaccttgtaaaaactattcatgaacttacactatttttgctttcaaggattgtatatgacagtga

SEQ ID NO: 1640 - DNA, 1751 bp, Arachis hypogaea
gggggggaaccacaccaagaaggaaacaacacacaacaaaataataaaaataataataaaaaagcattgattttgagagactggaatcatgtgggaatccattgtgttaacggtggctgccaccgccggaaacaacatcggaaaaatccttcagaagaagggcaccgtcattcttcctcctctctctttgaagttcaaggtgataagggcttatgcatttaacaaaatctgggttataggttttctaatggatataggtggtgcattattgatgttaagagcattatctttggccccggtatctgtgatccaaccggtttcgggagtcggactagcaattctttcaatcttctctcatttttatctgaaggaaatcatgaatgctgttgattgggttggcattgccttggcaggtgttggcacaataggagttggtgccggaggtgaagagcaagaggcggctactctgtccatttttcacataccatgtctggcatttgttgttgccatcttgtttgtattgcttaatggagggcttagaatatgcaggcgtcatcgaagagaacaagagatgatggaatacgatgttgttgaggaaattatttatggcttggaatctggaattttgtttgggatgtcttcggtaatttcgaagatgggatttctgttcctagagcaaggttttcaccaactgttggttcctctgtgcatcatattcagtgtgtgttgtagtggaacagggttttactaccagacacggggactaaagcacggtagggctattgtggtttctacatgtgcagccgtggcatcaattgtgagcggtgtactagctggaatgcttgcattgggtgaaagactgccttctgccccgaaagctcgcttggcacttcttcttggatggctacttataatcacgggtgtaattttactcgttggttcgacgcggctagtgaaattcctctcgtgttcttcaggacgcacgaaaagaagcaatgctgataagagttacggcgctagaagaccaagttctttgcgtataggggaaccgaatccaagcgccgtgataccagccacgacgttaaatcatctgctaccatcggcttccaaagaaaaagcttgagtcaacgttagccggaaaagaatgaatgttattcatcgatttggcgaattggcgaacttagggttaagggttgtatactgtataatgatctaacagtgttgctttcatcagaaggcatgaatgtttttaggatcattccttctggtttcaaatattttggattgatttagacaccaccttgtaaaactattaatgtacttttaaggattgtatatgagagtgctggtgacaatgacataacacattttatttatttttgatacaacacagaatttgttttatttttgcatgaaaatgaatttgtaatgcacaacaataatgatataatataattataattatttgtgtgcactggtgaagtagtgatacttgcatataaacaatagcaacatgcccagaaactatattaaagcttagttagcttttaacgtataagaataatttatatctttatatatatatgcccaggttaacaattctgagttgcaataaatctggagaaacaatatagattttggatgttatttttttaatgtacaaatcttttgttagtttattcttcttgttcccattagaaaagaccaattgagttaacattcttggtttgattaaaatattgttatgttag

SEQ ID NO: 1641 - DNA, 1436 bp, Prunus persica
atgtcagcacccaaaccaacagagtaacgtgaggccgcaagcaacaaaccccaagcacccagaaagcaacagccttttttgttccccaataatcaagatttcaacttttttgttttttgtttgataatttttaatttttgagagagagggatcatgtgggagtcgatctttctaacgctggcggcgacggccggaaacaatatcggaaaaattcttcagaagaagggcaccgtcattcttcctcctctctctttcaagctcaaggtgatcagggcgtatgctttgaacagagcttggttgataggttttctgatggatatatttggagccttgctcatgttgagagcattatctcttgctcctgtatctgtcatacaacccgtttctgggtgtggacttgccattctttcaatcttttcccatttttatctgaaggaaattatgaatgctgttgactggatggggattaccttagcaggcattggcactataggagttggtgccggaggtgaggagcaaaaggcttctgctatatctattttccatctaccatggttggcaattgtagtcgccatcttgtttgtactactgaatggatggctacgcatctacagacgtcaacgcaaagaacaggagttgatggaatatgacgttgttgaagaaattatatacggcttggaatctggcattttgtttgggatggcatctgtaatatcaaagatgggattcgtattcttggagcagggtttccccatcatgctggttcctatatgcctgatattcagcatatgttgtagtggtacagggtttttttaccagacttgggggttaaagcatgggagggcaattgtggtgtctacatgtgctgctgtggcatcaattgtgactggtgtgcttgctggaatgcttgctttgggtgaaagattgccttcagcgccaaccgctcgtctttcacttgtgcttggatggctatttataattattggcgtgattttacttgtgagttcgacacggctggtgcgaaaccttcctcggcctttacggcattttatccagagtggtgttgataagaacttcagccagagaaaatccgggtctatccgcactagggattcgagccctagcactgttattcaggcagcaactctgcatcatttgataccaacttcgtctaaagaaaaggcttgatttgattaaatcagggagattgttatatatgcacaaaatttctcatatcggcagacttgcaagtaagtaacgggaagcaactcctggtgatttaggcaaatctggtgtatagtagagtatgcttacagacttcatcagagggcatgaagtttttgaaatcattcttttagggaaaatctgtattctagtattttgtgaacattttgatgtctaacttttttctcgatttggtattcttatatctcatt

SEQ ID NO: 1642 - DNA, 1314 bp, Leymus cinereus x Leymus triticoides
  misc_feature (1175)..(1175): n is a, c, g, or t
  misc_feature (1274)..(1275): n is a, c, g, or t
ctacgctcagttccgaaattacgaccccaccagcagccagagtgaaggaaggaaggaaagggggagaaggagacgccgcggcgggcggaggcaatggcgacgacgacgtgcctgctggcggtctgggcgctggtcgccgccggtctgttcggcacgggcctcgcccggtcgtccgtggccccggccgtggggaaggagcagcgcgagttcgactacttcgcgctggcgctgcagtggccgggcaccatctgctcctccacccgccactgctgcgccgtcaacggctgctgccggaaggagccgctccacacattcacgatccacgggctgtggccggattacgatgacgggacctggccgtcgtgctgccgccacaccaacttcgacatggacaagataacgcctctgaagcccactctggacaagtactggccgtccctctactgttcgtcctcttccacttgcttcagtggcaggggccccttctgggctcatgagtgggagaagcatggaacatgctcggcccctgttgttcatgaagaattacagtacttcaccactgcccttgatctctacttcaaatataacgttacagaaatgctggcgactggagacatcctgatctccaacggtaaagaatatgcactgagtgatgtcattgatactatcaaacatgctttcgggggctcaccgcagatcatctgcaagaagggctcagttgaagaactaaggttatgcttcaccaaggatttgaagcctcgcgattgccttactacttcggcaatgtacaagaacctatcgaaatcaaagcattgccctcgaaaaatctccctgccaacatatgatcccatcgtactcacaaattcaacacttgagatcgtcccagaagccagcgacaatgggatgtacttttatacgtcctaagatactgagcatcgctgggctatgaggaaacagatgcctttcacggctctgactgcttgcaagacagtagccacatgtgctgggcactgagatcctgctaaaatgggtctctggtctatcccaactatttgtaaaggagaacattccactccacattagaacaactttgagtttgattatgttctggatatttgtaaagctactggaaatcaaatattccgatgactcgctgtacgaataatgaatgttanatgtacatattcacattctttagctgggcagggccctttgtggttcattggattgctgaaggatgtggcatgccagtatgccactgttctaaacgcatnnagttatgaacggtttatgttgcgtttgttccaaaaaaaa

SEQ ID NO: 1643 - DNA, 1307 bp, Triticum aestivum
  misc_feature (19)..(19): n is a, c, g, or t
tacgacccacgcttccgtncaattctgaaactacgacccacccagcagccagagggagggaaggaaagggggagaaggagacaccgcggcgggcggcgtgcaatggcgacggcgacggcgacgtgcctgctggcggtctgggcgctggtcgccgccggcctgttcggcacgggcctcgcccgggcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcgctccacaccttcacgatccacgggctgtggccggactacgatgacgggacctggccgtcgtgctgccgccacaccagcttcgacatggacaagataacgcctctgaagcccactctggacaagtactggccgtccctctactgttcgacctcttccacttgcttcagtggcaggggccccttctgggctcatgagtgggagaagcatggaacatgctcgtcccctgttgttcatgaagaattacagtacttcaccaccgccattgatctctacctcaaatataatgttacagaaatgctggcgactggagatatcctggtctccaacggtaaagaatatgcactgagtgatgtcattgataccatcaagcatgcttttgggggctcaccgcagatcatatgcaagaagggctcagttgaagaactaagattatgcttcaccaaggatttgaagcctcgcgattgccttactacttcggcaatgtacaagaacctatcgaaatcaaagcattgccctcgaaaaatctccctgccaacatatgatcccatcgtactcacaaattcgacactggagattgtcccagaagccagcgacaacgggttgtacttctttacatcctaagatacggagtattgctaggctatgaggaaacagatgccttcacggttctgactgcttgcaagacctgtagccacaggtgctgggcactgagatcctgctaaaacgggtctttggtttgtccatactatttgtaaaggacagcattccacattagaacaacttggttcgattatgttctggatatttgtaaaactgctggatatcaaactcagattactcattgtatgaataatggatgttaaatgtacatattagttcattggattgctgaaggatgtggcctgtctaaacgtttctaatagttatgaacggttcatgtcacatgcagtttgttccggccgcagagtttagacgtactagccagt

SEQ ID NO: 1644 - DNA, 1168 bp, Pseudoroegneria spicata
  misc_feature (6)..(6): n is a, c, g, or t
  misc_feature (8)..(9): n is a, c, g, or t
  misc_feature (89)..(89): n is a, c, g, or t
  misc_feature (94)..(94): n is a, c, g, or t
  misc_feature (98)..(98): n is a, c, g, or t
  misc_feature (140)..(140): n is a, c, g, or t
  misc_feature (160)..(160): n is a, c, g, or t
  misc_feature (163)..(163): n is a, c, g, or t
agcacncnnagagagggaaggaaagggggagaaggagacaccgcggcgggcggaggcaatggcgacgacgacgacgacgtgcctgctgncggtntggncgctggtcgccgccggcctgatcggcacgggcctcgcccggncgtccgtggccccggccgcngtngggaaggagcagcgcgagttcgactacttcgcgctggcgctgcagtggccgggcaccatctgctcctccacccgccactgctgcgccgtcaacggctgctgccggtcggagccgctccacacgttcacgatccacgggctgtggccggactacgatgacgggacctggccgtcgtgctgccgccacaccaacttcgacatggacaagataacgcctctgaagcccactctggacaagtactggccgtccctctactgttcgtcctcttccacttgtttcagtggcaaggggcccttctgggctcatgagtgggagaagcatgggacatgctcggcccctgctgttcaggaagaattacagtacttcagcactgcccttgatctctacttcaaatataacgttacagaaatgctggcgactggagatatcctggtctccaacggtaaagaatacgcactgagtgatgtcattgataccatcaaacatgcttttgggggctcaccacagatcatctgcaagaagggctcagttgaagaactaaggttatgcttcaccaaggatttgaagcctcgtgattgccttactacttcggcaatgtacaagaacctatcgaaatcaaagcattgccctaaaaaagtctccctgccaacatatgatcccatcgtactcacaaattcgacactggagattgtcccagaagccagcgacaatgggttgtacttctttacatcctaagataccgagtattgctaggctatgaggaaacagatgccttcacggttctgactgcttgcaagaccgtagccacaggtgctgggcactgagatcctcctaaaacgggtctctggtttgtccatactatttgtaaaggacaacattccacattagaacaacttggttcgattatgttctggatatttgtaaaactgctggatatcaaactcagattactcattgtatgaataatggatgttaaatgcacatattagttcattggattgctga

SEQ ID NO: 1645 - DNA, 1272 bp, Triticum aestivum
ctacgacccacccagcagccagagggagggaaggaaagggggagaaggagacaccgcggcgggcggcgtgcaatggcgacggcgacggcgacgtgcctgctggcggtctgggcgctggtcgccgccggcctgttcggcacgggcctcgcccgggcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcgctccacaccttcacgatccacgggctgtggccggactacgatgacgggacctggccgtcgtgctgccgccacaccagcttcgacatggacaagataacgcctctgaagcccactctggacaagtactggccgtccctctactgttcgacctcttccacttgcttcagtggcaggggccccttctgggctcatgagtgggagaagcatggaacatgctcgtcccctgttgttcatgaagaattacagtacttcaccaccgccattgatctctacctcaaatataatgttacagaaatgctggcgactggagatatcctggtctccaacggtaaagaatatgcactgagtgatgtcattgataccatcaagcatgcttttgggggctcaccgcagatcatatgcaagaagggctcagttgaagaactaaggttatgcttcaccaaggatttgaagcctcgcgattgccttactacttcggcaatgtacaagaacctatcgaagtcgaagcattgccctaaaaaaatctccctgccaacatatgatcccatcgtactcacaaattcgacactggagattgtcccagaagccagcgacaacgggttgtacttctttacatcctaagataccgagcattgctgggctatgaggaaacagatgccttcacggttctgactgcttgcaagaccgtagccacaggtgctgggcactggagatccggctaaaacgggtttctggtttgtccatactatttgtaaaggacaacattccacgtttgaacaacatggttcgattatgttctgatttgtaaaaccgctggatatcaaactcatgttactcattgcatgtatgaataatggatgttaaatgtacatattagttcattctattgctgaaggatgtggcctgtctaaacgtttctaagtcatgaacggttcatgtcacatgcagtttgttccagccgcagagtttagacgtactagc

SEQ ID NO: 1646 - DNA, 1195 bp, Triticum aestivum
ctacgacccacccagcagccagagggagggaaggaaagggggagaaggagacaccgcgccgggcggaggcaatggcgacggcgacggcgacgacggcgtgcctgctggcggtctggtcgctggtcgccgccggtctgttcggcacgggcctcgcccggtcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcactccacacgttcacgatccacgggctgtggccggactacgatgacgggacctggccgtcgtgctgccgccacaccagcttcgacatggacaagctaacgcccctgaagcccgctctggacaaatactggccgtccctctactgttcgtcctcttccacttgtttcagtggcaggggggccttctgggctcatgagtgggagaagcatggaacatgctcggcccctgttgttcatgaagaattacagtacttcaccgccgccattgatctctacctcaaatataacgtcacggaaatgctggcgactggagatatcctggtctccaacggtaaagaatatgcactgagtgatgtcattgataccatcaaacatgcttttgggggctcaccgcagatcatatgcaagaagggctcagttgaagaactaaggttatgcttcaccaaggatttgaagcctcgtgattgcctgactacttcggcaatgtacaagaacctatcgaaatcaaagcattgccctaaaaaaatctccctgccaacatatgatcccatcgtactcacaaattcgacactggagattgtcccagaagccagcgacaatgggttgtacttctatacatcctaagatgccgaatattgctaggctatgaggaaacagatgccttcacggttctgactgcttgcaagaccgtagccacaggtgctgggcactgagatcctgctaaaacgggtctctgatttgtccacactatttgtaaaggacaacattccacattagggcaacttggttcgattatgttctggatatttgtaaaactgctggatatcaaactcagcttactcatttgtatgaataatggatgttaaatgtacatattagctcattggattgctgaaggatgt

SEQ ID NO: 1647 - DNA, 1314 bp, Triticum aestivum
  misc_feature (1284)..(1284): n is a, c, g, or t
  misc_feature (1287)..(1287): n is a, c, g, or t
  misc_feature (1290)..(1290): n is a, c, g, or t
  misc_feature (1306)..(1306): n is a, c, g, or t
  misc_feature (1309)..(1309): n is a, c, g, or t
gaaactacgacccacccggcagccagagggagggaaggaaagggggagaaggagacaccgcggcgggcggaggcaatggcgacggcgacggcgacggcgacgtgcctgctggcggtctgggcgctggtcgccgccggcctgttcggcacgggcctcgcccgggcgtccgtggccccggccgcggtggggaaggagcagcgcgagttcgactacttcgcgctggcgctgcagtggccaggcaccatctgctcctccacccgccactgctgcgccgtcaacggctgctgccggtcggaggcgctccacaccttcacgatccacgggctgtggccggactacgatgacgggacctggccgtcgtgctgccgccacaccagcttcgacatggacaagttaacgcctctgaagcccactctggacaaatactggccgtccctctactgttcgacctcttccacctgcttcagtggcaggggccccttctgggctcatgagtgggagaagcatggaacatgctcggcccctgttgttcatgaagaattacagtacttcaccaccgcccttgatctctactacaaatataacgttacagaaatgctggcgactggagatatcctggtctccaacggtaaagaatatgcactgagtgatgtcattgataccatcaagcatgcttttgggggctcaccgcagatcatatgcaagaagggctcagttgaagaactaaggttatgcttcaccaaggatttgaagcctcgcgattgccttactacttcggcaatgtacaagaacctatcgaagtcgaagcattgccctaaaaaaatctccctgccaacatatgatcccatcgtactcacaaattcgacactggagattgtcccagaagccagcgacaacgggttgtacttctttacatcctaagataccgagcattgctgggctatgaggaaacagatgccttcacggttctgactgcttgcaagaccgtagccacaggtgctgggcactggagatccggctaaaacgggtttctggtttgtccatactatttgtaaaggacaacattccacgtttgaacaacatggttcgattatgttctgatttgtaaaaccgctggatatcaaactcatgttactcattgcatgtatgaataatggatgttaaatgtacatattagttcattctattgctgaaggatgtggcctgtctaaacgtttctagtcatgaacggttcatgtcgcatgcagtttgttccatccgcagagtttagacgtactagcagtnatnatnacaccgagacattctnaanaaaaa

SEQ ID NO: 1648 - DNA, 1154 bp, Avena sativa
tccacttgcgagggccacagggagtcagggaaggaaagggggagagcgagacaccgcggcggagggccaatggcgacgacgacgtacctgcttgtggcttgggcgctggtcgccgccgatctgttcggcacgggcctcgcccggccgtccgcgtccgtgcccgtggccgcggtggggaaggcgcagcgcgagttcgactacttcgcgctcgcgctgcagtggccgggcaccatctgctcctccacccgccactgctgcgccatcaacggatgctgccggtcggagccgctccagacgttcacgatccacgggctgtggccggactacgatgacgggacctggccgtcgtgctgccgccacactaacttcgacatggacaagatatcgactctgaagccgaagatggaccagtactggccgtctctctactgctcaacctcctccacttgcttcagtggcaagggccctttctgggctcatgagtgggagaagcacggaacgtgctcatcccctgctgtcgatgatgaattacagtacttctccactgcccttgatctctacttcaaatataacgttacagaaatgctggcaactggaaatatcttcacctcaaatggtaaagagtatgcgctgagtgatgtcgttgatactatcaaacatgcttttgggggctcaccacagatcatttgcaagaagggctcggttgaagaactaaggttatgcttcaccaaagacttgaagcctcgcgattgcctcactacttctttgatgtacaaaaacttgtccaaagcaaagcattgccctcgaagcatctccctgccagcatatgatcccaatgcattcttaaattcaaccttggagattctcccagaagccagcaacagtgggatgtatttttatacatcctaagatacccattacagcacccgagcattgtatgactatgatgaagcagatatcttctggactcttgactgctttgaagacatagccacaggtgctgtggtgagcactgcatgagatgctggcgaaaggtgtctcttgcttaccaaaccatttgtaaataaaaccattccacattacctcctcagaacaacagatgattcgattctgttctgcctacggtctatttctgtactcatggaaatcaaata

SEQ ID NO: 1649 - DNA, 1133 bp, Avena sativa
gaaagggggagagcgacacaccgcggcggagggcaatggcgacgatgacgtacctgcttgtggcttgggcgctggtcgccgccgatctgttcggcacgggcctcgcccggccgtccgtcgccgaggtggggaaggcgcagcgcgagttcgactacttcgcgctcgcgctgcagtggccgggcaccatctgctcctccacccgccactgctgcgccatcaacggatgctgccggtcggagccgctccagacgttcacgatccacgggctgtggccggactacgatgacgggacctggccgtcgtgctgccgccacactaacttcgacatggacaagatatcgactctgaagccgaagatggaccagtactggccgtctctctactgctcaacctcctccacttgcttcagtggcaagggccctttctgggctcatgagtgggagaagcacggaacgtgctcatcccctgctgtcgatgatgaattacagtacttctccactgcccttgatctctacttcaaatataacgttacagaaatgctggcaactggaaatatcttcacctcaaatggtaaagagtatgcgctgagtgatgtcgttgatactatcaaacatgcttttgggggctcgccgcagatcatttgcaagaagggctcggttgaagaactaaggttatgcttcaccaaagatttgaagcctcgcgattgcctcactacttctttgatgtacaaaaacttgtccaaagcaaagcattgccctcgaagcatctccctgccagcatatgatcccaatgcattcttaaattcaaccttggagattctcccagaagccagcaacagtgggatgtatttttatacatcctaagatacccattacagcacccgagcattgtatgactatgatgaagcagatatcttctggactcttgactgctttgaagacatagccacaggtgctgtggtgagcactgcatgagatgctggcgaaaggtgtctcttgcttaccaaaccatttgtaaataaaaccattccacattacctcctcagaacaacagatgattcgattctgttctgcctacggtctatttctgtactcatggaaatcaaatagccaatgaccgaagtatacatttac

SEQ ID NO: 1650 - DNA, 1206 bp, Triticum aestivum
caattctgaaactacgacccacccagcagccagagggagggaaggaaagggggagaaggagacaccgcgccgggcggaggcaatggcgacggcgacggcgacgacggcgtgcctgctggcggtctggtcgctggtcgccgccggtctgttcggcacgggcctcgcccggtcgtccgtggccccggccgccgtcgggaaggagcagcgcgagttcgactacttcgcgctggcgctgcagtggccgggcaccatctgctcctccacccgccactgctgcgccgtcaacggctgctgccggtcggaggcactccacacgttcacgatccacgggctgtggccggactacgatgacgggacctggccgtcgtgctgccgccacaccagcttcgacatggacaagctaacgcccctgaagcccgctctggacaaatactggccgtccctctactgttcgtcctcttccacttgtttcagtggcaggggggccttctgggctcatgagtgggagaagcatggaacatgctcggcccctgttgttcatgaagaattacagtacttcaccgccgccattgatctctacctcaaatataacgtcacggaaatgctggcgactggagatatcctggtctccaacggtaaagaatatgcactgagtgatgtcattgataccatcaaacatgcttttgggggctcaccgcagatcatatgcaagaagggctcagttgaagaactaaggttatgcttcaccaaggatttgaagcctcgtgattgcctgactacttcggcaatgtacaagaacctatcgaaatcaaagcattgccctaaaaaaatctccctgccaacatatgatcccatcgtactcacaaattcgacactggagattgtcccagaagccagcgacaatgggttgtacttctatacatcctaagatgccgaatattgctaggctatgaggaaacagatgccttcacggttctgactgcttgcaagaccgtagccacaggtgctgggcactgagatcctgctaaaacgggtctctgatttgtccacactatttgtaaaggacaacattccacattagggcaacttggttcgattatgttctggatatttgtaaaactgctggatatcaaactcagcttactcatttgtatgaataatggatgttaaatgtacatattagctcattggattgctgaaggatgt

SEQ ID NO: 1651 - DNA, 1171 bp, Festuca arundinacea
  misc_feature (941)..(941): n is a, c, g, or t
ggcacgaggtacgacccacccagcccagaggaaagggaaggaaagtgggagagcgagacaccggggcggagggcaatggcgacgacgaaggcgcgcgcgacgtgcctgctggttgtctgggcgctggtcgccgccgatctgttcggcacgggccacgcccgcgcgtccgtggccgcggtggggaaggagcagcgcgagttcgactacttcgcgctcgcgctgcagtggccgggcaccatctgcgcctccacccgctactgctgcgccatcaacggatgctgccggccggagccgctccagacgttcacgatccacgggctgtggccggactacgacgacgggacctggccgtcgtgctgccgcgaaaccaactacgacgcggacaagatatcgcctctgaagccgatgatggacaagtactggccctccttgtactgctcaacctcttccacttgcttcagtggcaagggccccttctgggctcatgagtgggagaagcatggaacgtgctcgtcccctgttgttgaggatgaactacagtacttctctactgcccttgatctctacttcaaatataacgttacagaaatgctggcaactggagatatcctgatctcaaatggtaaagaatatgcgctgactgacgtcatcaataccatcaaaaatgcttttggaggctcaccacagatcatttgcaagaagggctcggttgaagaactaaggctgtgcttcaccaaagatttgaagcctcgtgattgcctcactacttctgcattgtccaaaaacttgtcgaaatcaagttgccccaaaaacatctccctgccaacatatgatcccaatgcattcataaattcaaccttggcggttctcccagaagccagtaacagtaagatgtatttttatacatcctaagataccattacagcaaccgtgcattgtanggctatgatgaagcagatatcttctggactcttggctgctttgaagacatagccgcagatgctggtgaaaggtgttcctggtttgcaaaccatttgtaaataagacaattccacattaccatctgagaacagattattcgattatgttctggctattttctatttctgtacctgcccgggcggccgaccgggcaggtacaacaactgtttgttttcttcgcctgcttgta

SEQ ID NO: 1652 - DNA, 1727 bp, Gossypium hirsutum
accagccttcgtttctcactttcctctccattttctcggcgaaatcaagcatggggaaaggacctggtctctactccgatatcggaaaaaagcctagagatattctttacaaggattaccaggccgaccacaagttcactgtcactacttatacctccaatggagtcgcaatcacatcaactgggattaagaaaggtgaactgcttttggctgatgtaagtactgagctgaagaacaataacatcacaaccaatgtcaaagttgacactaagtctaatctttttgccactgttaccgttgatgaacctgcacctggattgaagacaatctttagttttattgtccctgatcaaaggtctggcaaggtggaactgcaataccagcatgaatatgccggcataagcactagcattggtttgaatgctaatccccttgttaacttctctggggtggttggaaacaattgtgtctcagtggggactgatctctcatttgacaccgccagtggaaactttaccaaattgaatgctgggctgaatttcacccattctgacctcattgcttccctaacattaaatgataaaggtgacactcttaatgcttcctactaccacattgttagcccattgacgaacacagcggttggtgcggagctgacccatagcttttcaagtaatgagaacactctcacgattggtacacagcatgctcttgacccgttgaccacagtgaaggctcgactgaacaactacggcagagcaagtggtcttatccagcatgagtggcgcccaaaatccctcttcactatctctggagacgtggacaccagagcaattgaaaagagtgctaaagtcgggctggccttggcactcaagccgtagggaaaggtaatatcattgtttgaatgaagggagggctttacttttgattggtgaaaccggaagtctggaagactggggagagtaataatgtgctttgacggatttttcatgatcttggattaaaaaaataattgtgattggcgaactgaaattggcaatttgttatgttaaattcgctagggcgtacgtttttttttttttttagaaaaacaaggcttcatgtagcctattcatctgtgaaatgcaaatgttgcttacatgctattacttaagttgtttcagtcattaaacttggcaggcagaggatgaggaaattataatatcttaagaaagaggatccaataggaaaaggaaggggcctttccagtcgtggcttaatcaaggagtagcaatgcaagagcctgatcactttgttagtgtaatagtataatgtaaattagtagcatacggaatggaattatgtgcttttgcttcagccctcgaggacctggaatttgggagaactacctaatattattagtggagtccattcctcgtcccaattaaacaaaatatagtgctgttgctaacggatgccaattgatttagtttaagaatagtgcaaatgtggtaaaaccaccatggagttagaagctaaattgcctttttatttttatcctttctactcataaaatagataaattagtttatgtacgttagattaaagagtaaattaattttttgttaaaaagtttatcaaattgtactgttaaaagttagcgttattgatggtataatcggccaatgatgtgacatgcaatgtgtattttatgttgatgtataaaaattaatttttatagtagcaaa

SEQ ID NO: 1653 - DNA, 1743 bp, Gossypium hirsutum
tccctgtctttcgcaaccagccttcgtttctctcactttcctctccattttctcggcgaaatcaagcatggggaaaggacctggtctctactccgatatcggaaaaaagcctagagatattctttacaaggattaccaggccgaccacaagttcactgtcactacttatacctccaatggagtcgcaatcacatcaactgggattaagaaaggtgaactgcttttggctgatgtaagtactgagctgaagaacaataacatcacaaccaatgtcaaagttgacactaagtctaatctttttgccactgttaccgttgatgaacctgcacctggattgaagacaatctttagttttattgtccctgatcaaaggtctggcaaggtggaactgcaataccagcatgaatatgccggcataagcactagcattggtttgaatgctaatccccttgttaacttctctggggtggttggaaacaattgtgtctcagtggggactgatctctcatttgacaccgccagtggaaactttaccaaattgaatgctgggctgaatttcacccattctgacctcattgcttccctaacattaaatgataaaggtgacactcttaatgcttcctactaccacattgttagcccattgacgaacacagcggttggtgcggagctgacccatagcttttcaagtaatgagaacactctcacaatcggtacacagcatgctcttgacccgttgaccacagtgaggactcgactgaacaactacggcagagcaagtgctcttatccagcatgagtggcgcccaaaatccctcttcactatctctggagaggtggacaccagagcaattgaaaagagtgctaaagtcgggctggcgttggcactcaagccgtagggaaaggtaatatcattgtttgaatgaagggaggcctttacttttgattggtgaaaccggaagtctggaagactcgggagagtaataatgttctttgacggatttttcatgatcttggattgaaaaaataattgtgattggcgaactgaaattggcaatttgttatgttaaatttgctagggcgtacgtttttttttttttttagaaaaacaaggcttcatgtagcctattcatctgtgaaatgcaaatgttgcttacatgctattacttaagttgtttcagtcattaaacttggcaggcagaggatgaggaaattataatatcttaagaaagaggatccaataggaaaaggaaggggcctttccagtcgtggcttaatcaaggagtagcaatgcaagagcctgatcactttgttagtgtaatagtataatgtaaattagtagcatacggaatggaattatgtgcttttgcttcagccctcgaggacctggaatttgggagaactacctaatattattagtggagtccattcctcgtcccaattaaacaaaatatagtgctgttgctaacggatgccaattgatttagtttaagaatagtgcaaatgtggtaaaaccaccatggagttagaagctaaattgcctttttatttttatcctttctactcataaaatagataaattagtttatgtacgttagattaaagagtaaattaattttttgttaaaaagtttatcaaattgtactgttaaaagttagcgttattgatggtataatcggccaatgatgtgacatgcaatgtgtattttatgttgatgtataaaaattaattttatagtagcaaa

SEQ ID NO: 1654 - DNA, 1080 bp, Gossypium hirsutum
accaaaagccagaaaaccagctctcgtttcctctccattttctcgggaaaaagaagcatgggaaaaggccctggtctctacaccgatatcggcaaaaaggcaagagatcttctttacaaggattaccaggccgaccacaaattcactctcactacttacacttccaatggcgtcgcaatcacatcaactggaactaagaaaggtgaattgctgttggctgatataagcaccgagctgaagaacaagaacatcacaaccaatgtcaaagttgacaccagttctaagcttttcgccactgttactgttgatgaacctgcaccgggtttgaagacaatctttagtttcattgcccctgatcaaaggtctggcaaggtggaactgcaataccaacatgaatatgctggcataagcactagcattggattgactgcaaatccccttgttaacttctctggcgtggttggaaacaatagtgtcactgttgggactgatctctcatttgacactgccagtggtaactttacaaaactgaatgctgggttgaatttcacccattctgatctcattgcttccttgacattgaatgataaaggcgacactcttaatgcttcctactaccacatagttagcccattgactaacacagcggttggtgcggagctgagccatagcttttcaagtaatgagaacactctcacaattggtacacaacatgctcttgacccattgacaacggtaaaggctcgactgaataactatggcagagcaagtgctctgatccagcatgaatggcgcccaaaatcgctcatcacaatatctggagaggtggacaccggagcaattgaaaaaagtgctaaagttgggctggccttggcactcaagccctaggcaatggcaaaactgtttttgttgtgtcagatggaaggtgggccttaattttgattggtttgaggactttggagaaaaataatgtactttcatggattataaaaataatgttattggcaaactgaaattagcaatttgctttgttgaacaagtgttgcttacatccaattagttcacttgtttacttctttc

SEQ ID NO: 1655 - DNA, 1026 bp, Gossypium hirsutum
cctctccattttttcgggaaaaagaagcatgggaaaaggtcctggtctctacaccgatatcggcaaaaaggctagagatcttctttacaaggattaccaggccgaccacaagttcactctcactacttacacttccaatggagtcgcaatcacatcaactggaactaagaaaggtgaattgctgttggctgatataagcaccgagctgaagaacaagaacatcacaaccaatgtcaaagttgacaccagttctaagcttttcgccactgttactgttgatgaacctgcaccgggtttgaagacaatctttagtttcattgcccctgatcaaaggtctggcaaggtggaactgcaataccaacatgaatatgctggcataagcactagcattggattgactgcaaatccccttgttaacttctctggtgtggttggaaacaatagtgtcactgttgggactgatctctcatttgacactgccagtggtaactttacaaaattgaatgctgggttgaatttcacccattctgatctcattgcttccttgacattgaatgataaaggcgacactcttaatgcttcctactaccacatagttagcccattgactaacacagcggttggtgcggagctgagccatagcttttcaagtaatgagaacactctcacaattggtacacagcatgctcttgacccattgacaacggtaaaggctcgactgaataactatggcagagcaagtgctctaatccagcatgaatggcgcccaaaatcgctcatcacaatatctggagaggtggacaccggagcaattgaaaaaagtgctaaagttgggctggccttggcactcaagccctaggcaaaggcaaaactgtttttgttgtgtcatatggaaggtgggccttaattttgattggttgaggacttggagaaaaatagtgtactttcatggattataaaaataatgttattggcaaaccgaaattagcaatttgctttgttgaacaagtgttgcttacatccaat

SEQ ID NO: 1656 - DNA, 1188 bp, Gossypium hirsutum
acgagcggccagtatcaacgcagagtacatgggaaacaaccaaaagccagaaaaccagctctcgtttctctcgttccctctccattttttcgggaaaaagaagcatgggaaaaggtcctggtctctacaccgatatcggcaaaaaggctagagatcttctttacaaggattaccaggccgaccacaagttcactctcactacttacacttccaatggagtcgcaatcacatcaactggaactaagaaaggtgaattgctgttggctgatataagcaccgagctgaagaacaagaacatcacaaccaatgtcaaagttgacaccagttctaagcttttcgccactgttactgttgatgaacctgcaccgggtttgaagacaatctttagtttcattgcccctgatcaaaggtctggcaaggtggaactgcaataccaacatgaatatgctggcataagcactagcattggattgactgcaaatccccttgttaacttctctggcgtggttggaaacaatagtgtcactgttgggactgatctctcatttgacactgccagtggtaactttacaaaattgaatgctgggttgaatttcacccattctgatctcattgcttccttgacattgaatgataaaggcgacactcttaatgcttcctactaccacatagttagcccattgactaacacagcggttggtgcggagctgagccatagcttttcaagtaatgagaacactctcacaattggtacacaacatgctcttgacccattgacaacggtaaaggctcgactgaataactatggcagagcaagtgctctgatccagcatgaatggcgcccaaaatcgctcatcacaatatctggagaggtggacaccggagcaattgaaaaaagtgctaaagttgggctggccttggcactcaagccctaggcaatggcaaaactgtttttgttgtgtcagatggaaggtgggccttaattttgattggttgaggacttggagaaaaatagtgtactttcatggattataaaaataatgttattggcaaaccgaaattagcaatttgctttgttgaacaagtgttgcttacatccaattagttcaacttgtttacttctttcagtcacaaatcttgcaggcagacatgggatttggtcatttgctattatttgcttgatttcag

SEQ ID NO: 1657 - DNA, 1390 bp, Theobroma cacao
agaaatatttattaattagggttttattgatttattcattttcttccctgtctttcgcaagcacagccaaaagtcagtaacccgaaccagccctcgtttctctcattttcctctccattttctcgggaaaaaacagaaagcatggggaaaggtcctggtctctactccgagatcggcaaaaaggctagagatcttctttacaaggattaccagggcgaccacaagttcactgtcactacttacacttccgatggagtcgcaatcacatcaactgggattaagaaaggtgaattgcttttggctgatgtaagcactcagctgaagaacaagaacatcacaactgatgtgaaagtcgacactagttcgaaacttttcaccactgtcactgttgatgagccggcacctgggttgaagactatctttagttttgttgtccctgatcaaaggtctggaaaggtggaactgcaataccagcatgagtatgctggaattagcactagcattggattgactgcaaatcctcttgttaacttctctggtgtggtgggaaacaattgtgtctctgttggaactgatctttcatttgacactgccagtgggaacttcaccaaattgaatgctggattgaattttacccattctgacctcattgcttccgtgactgtcaatgataaatgtgacaatcttacggcttcctactatcacattgttagcccattgactaacacagcagttggtgcggagcttacccatagcttttcaagcaatgagaataccctcacatttggtacgcagtacgaacttgacccattgaccacagtgaaggctcggtggaacaactttggccgagcaagtgcattgatccagcatgagttccgcccaaaatctctcttaactatctctggggaggtggacaccagagcaattgaaaagagtgctaaggttgggatggccttgctactcaagccataggcaaaactattacctttgtgtgaatgaaggcagaccttgattttgattggtggagactggagagaaataatgtagtttttacggatttgatggtcatggattgtaaaaaataattgcgattcgcgaactgaaatcagcaatttgttgaacaagtttcatgttgtctattcatctgtgaaatcaagtgttgcttacgtgctattagttcacttgctttacttaatttcagtcactaatattgcaggcagggtgttatcggtcagtatttgcttgattttcagatgaattgctgtttgaggtaattcagtccagagtgttggattttagatgagttctttcaactggattccagtgtttggtagtgactagtaaccgtgttggttatttttcacatacatcataaacagaatcatccaat

SEQ ID NO: 1658 - DNA, 1148 bp, Theobroma cacao
  misc_feature (856)..(856): n is a, c, g, or t
  misc_feature (973)..(973): n is a, c, g, or t
cggggatttttcttccgtctttcgcaagcacagccaaaagtcagtaacccgaaccagccctcgtttctctcattttcctctccattttctcgggaaaaaacagaaagcatggggaaaggtcctggtctctactccgagatcggcaaaaaggctagagatcttctttacaaggattaccagggcgaccacaagttcactgtcactacttacacttccgatggagtcgcaatcacatcaactgggattaagaaaggtgaattgcttttggctgatgtaagcactcagctgaagaacaagaacatcacaactgatgtgaaagtcgacactagttcgaaacttttcaccactgtcactgttgatgagccggcacctgggttgaagactatctttagttttgttgtccctgatcaaaggtctggaaaggtggaactgcaataccagcatgagtatgctggaattagcactagcattggattgactgcaaatcctcttgttaacttctctggtgtggtgggaaacaattgtgtctctgttggaactgatctttcatttgacactgccagtgggaacttcaccaaattgaatgctggattgaattttacccattctgacctcattgcttccgtgactgtcaatgataaatgtgacaatcttacggcttcctactatcacattgttagcccattgactaacacagcagttggtgcggagcttacccatagcttttcaagcaatgagaataccctcacatttggtacgcagtacgaacttgacccattgaccacagtgaaggctcggtggaacaactttggccgagcaagtgcattgatccagcatgagttccgcccaaaatctnttttaactatctctggggaggtggacaccagagcaattgaaaagagtgctaaggttgggatggccttgctactcaagccataggcaaaactattacctttgtgtgaatgaaggcagnccttgattttgattggtggagactggagagaaataatgtagtttttacggatttgatggtcatggattgtaaaaaataattgcgattcgcgaactgaaatcagcaatttgttgaacaagtttcatgttgtctattcatctgtgaaatcaagtgttgcttacgtgctattagtgca

SEQ ID NO: 1659 - DNA, 1259 bp, Castanea mollissima
aaacagtctctaccaaaccccttctctctccctcgttttctctctcattttctttctcaaattttctcgggaaaatcatggtgaaaggtccaggtctttactctgatattggcaagaaagccagagatcttctctacaaggattatcagagcgaccacaagttcactgtcactacctacacttccactggagttgcaatcacttcaactggaattaagaaaggtgagctttttttggccgatgtgagcactcagctgaagaacaagaacatcacgactgacattaaagtcgataccaactctaatcttctcacaacggttactattgatgaacctgcacctggactcaagactatctttagctttattgttcctgatcagaggtctggtaaggtagaactccaataccagcatgaatatgctggaattagcaccggcattggattgactgccaatccaattgtgaacttttctggtgtcattggaaacaatgttgtttcccttgggactgatcttgcatttgacactgcctctgggaacttcaacaaattgaatgctgggttgagttacacccaatccgatctcattgcttccctgacagtgaatgataaaggtgacacccttaatgcttcatactaccacatagtaagcccattgaccagcacagctgtcggtgcggagctgtcacatagcttttcaaccaatgaaaacactctcacaattggcacacagcatgcacttgaccccttaacctcggtgaaggccagagtgaacaactatggaagggccagtgctctcatccagcatgagtggcgcccaaaatccttgttcaccatctcaggagaggtggataccagggcaattgaaaagagtgcaaagatcgggctggccttggcgcttaagccttgagctaattaactacccttggtgtgagtggaaagatggacttgtttcgctgtggtggagggtaataaggtagatgaatgactttttgatccaatgaatttcggtctttcgatgctgttctattggtttctgcatattttggtggtccaagggttgtaaaaaataattttagctggtggcacgaaccagtgtcaatttcatttcgaattctcatacatccaaatgtttatggaaggtattctttgaggaaacagttatatggagttttagtcactctatgaatgctgtttcttgcactccaaatttctgtttttcattattcttccaatctcattaagcagagaaattgtagta

SEQ ID NO: 1660 - DNA, 1274 bp, Quercus alba
tcgggatttccttttttattttttcttctctcacacttacactctctctctctctctctctgtctctgaataaccaaacagtctctaccaaaccctctctctctctttctctctcattttctttctcaaattttctcgggaaaatcatggtgaaaggtccaggtctttactccgatatcggcaagaaagccagagatcttctctacaaagattatcagagcgaccacaagttcaccgtcactacctacacttccacgggagttgcaatcacttcaactggaattaagaaaggtgagctgtttttggccgatgtgagcactcagctgaagaacaagaacatcacgactgacattaaagtcgataccaactctaatcttctcacaacggttactgttgatgaacctgcacctggactcaagactatctttagctttattgttcctgatcagaggtctggtaaggtagaactccaataccagcatgaatatgctggaattagcaccagcattggattgactgccaatccaattgtgaacttttctggtgtcattggaaacaatgttgtttcccttgggactgatcttgcatttgacactgcctctgggaacttcaacaagttgaatgctgggttgagttacacccaatctgacctcattgcttccctgacagtgaatgataaaggtgacacccttaatgcttcatactaccacatagtaagcccattgaccagcacagctgtcggtgcggagctgtcacatagcttttcaagcaatgaaaacactctcacaattggcacacagcatgcacttgaccccttaacctcggtgaaggccagagtgaacaactatggtagggccagtgctctcatccagcatgagtggcgcccaaaatccttgttcaccatctcaggagaggtggataccagggcaattgaaaagagtgcaaagatcgggctggccttggcgcttaagccttgagctaattaactacccttggtgtgagtggaaagatggacttgtttcgttgtggtggagggtaataaggtagatgaatgactcttttgatccaattaatttcgatcttttgatgctgtgctattggtttctgcatattttggtggtcaagggttgtaaaaaataattttagctggtggcacgaaccaatgtcaattttcatttcgaattcttatccattcaaatgtttatggaaggtattctttgaggaaacagttatatggagttttttttcactcgatgaatgctgtttctcgcact

SEQ ID NO: 1661 - DNA, 1279 bp, Citrus clementina
gacacctctcgataagcgaacaaccaaacaagtaagcatagggttttgatttcataatcttcctccagctgaaataatcaaaactgatatttctcagcgtttcctttccattttctctggagaatcatggtgaaaggccccgggctctactctgaaatcggcaagaaagcccgagatcttctctacaaggactaccagagcgaccacaagttcactgtcactacttacacgtcagctggagtcgcgataacttcgagtggtgttaagaaaggtgagctttttttggctgatgtcagcactcagttgaagaacaagaacatcactactgatgttaaagttgatactaactctaatctttttacaaccatcactgtcgatgagcctgctcctggactcaagtcaatctttagctttatcgttcctgatcagagatctggcaaggtggaactccaatatcagcatgaatatgctggaataagcactggcattggattcactgcaaatcccattgttaacttttctggtgtggttggaaacaattctgttgctcttgggactgatctctcatttgatactgccactggcaacttcaccaagtgcaatgcggggctgagctatacacatactgacctcattgcttccctgacattgaatgacaaaggtgacacccttaatgcttcctactaccacattgtaagcccactgaccaataccgctgttggggcggagctgacccatagcttttcaagcaacgagaacactctgacaatcggaactcagcatgctcttgatcctttgacctcggtgaaggcccgtgtgaacaactatggcagggcaagtgctcttatccagcacgagtggcgtcccaaatctctatttactatctcaggagaggtagacaccagggccattgaaaagagtgctaaaattgggctggcgttagctctcaagccataggctaagcaattaatcttggcgtcgggggaaggagagaaacaatgtttttgagtggtggagtacaataattgttaggaaaaatgatgtgaaacctatattctttctttttttttcccctttcctaaaacttgtgatttcacgtggggtgcttttgggtttcacgaatgttgtggctgcgggttgtaaaaataattctggctgatgtcctaaatcaacattggctgtttcttctttagatttccgtccattcatccccaataagggcatacttgttttcagcgatataataatttaaatgtggagatctttattttgtctttca

SEQ ID NO: 1662 - DNA, 1281 bp, Citrus sinensis
gactcctctcgataagcgaacaaccaaacaagtaagcatagggttttgatttcataatcttcctccagctgaaataatcaaaactaatatttctcagcgtttcctttccattttctctggagaatcatggtgaaaggccccgggctctactctgaaatcggcaagaaagcccgagatcttctctacaaggactaccagagcgaccacaagttcactgtcactacttacacgtcagctggagtcgcgataacttcgagtggtgttaagaaaggtgagctttttttggctgatgtcagcactcagttgaagaacaagaacatcactactgatgttaaagttgatactaactctaatctttttacaaccatcactgtcgatgagcctgctcctggactcaagtcaatctttagctttatcgttcctgatcagagatctggcaaggtggaactccaatatcagcatgaatatgctggaataagcactggcattggattcactgcaaatcccattgttaacttttctggtgtggttggaaacaattctgttgctcttgggactgatctctcatttgatactgccactggcaacttcaccaagtgcaatgcggggctgagctatacacatattgacctcattgcttccctgacattgaatgacaaaggtgacacccttaatgcttcctactaccacattgtaagcccactgaccaataccgctgttggggcggagctgacccatagcttttcaagcaacgagaacactctgacaatcggaactcagcatgctcttgatcctttgacctcggtgaaggcccgtgtgaacaactatggcagggcaagtgctcttatccagcacgagtggcgtcccaaatctctatttactatctcaggagaggtagacaccagggccattgaaaagagtgctaaaattgggctggcgttagctctcaagccataggctaagcaattaatcttggcgtcggggggaaggagagaaacaatgtttttgagtggtggagtacaataattgttacgaaaaatgatgtgaaacctatattctttctttttttttcccctttcctaaaacttgtgatttcaccgtggggtgcttttgggtttcacgaatgttgtggctgcgggttgtaaaaataattctggctgatgtcctaaatcaacattggctgtttcttctttagatttccgtccattcatccccaacaagggcatacttgttttcagcgatataataatttaaatgtggagatctttattttgtctttca

SEQ ID NO: 1663 - DNA, 1243 bp, Citrus sinensis
ggggagggttttgatttcataatcttcctccagctgaaataatcaaaactgatatttctcagcgtttcctttccattttctctggagaatcatggtgaaaggccccgggctctactctgaaatcggcaagaaagcccgagatcttctctacaaggactaccagagcgaccacaagttcactgtcactacttacacgtcagctggagtcgcgataacttcgagtggtgttaagaaaggtgagctttttttggctgatgtcagcactcagttgaagaacaagaacatcactactgatgttaaagttgatactaactctaatctttttacaaccatcactgtcgatgagcctgctcctggactcaagtcaatctttagctttatcgttcctgatcagagatctggcaaggtggaactccaatatcagcatgaatatgctggaataagcactggcattggattcactgcaaatcccattgttaacttttctggtgtggttggaaacaattctgttgctcttgggactgatctctcatttgatactgccactggcaacttcaccaagtgcaatgcggggctgagctatacacatactgacctcattgcttccctgacattgaatgacaaaggtgacacccttaatgcttcctactaccacattgtaagcccactgaccaataccgctgttggggcggagctgacccatagcttttcaagcaacgagaacactctgacaatcggaactcagcatgctcttgatcctttgacctcggtgaaggcccgtgtgaacaactatggcagggcaagtgctcttatccagcacgagtggcgtcccaaatctctatttactatctcaggagaggtagacaccagggccattgaaaagagtgctaaaattgggctggcgttagctctcaagccataggctaagcaattaatcttggcgtcgggggaaggagagaaacaatgtttttgagtggtggagtacaataattgttacgaaaaatgatgtgaaacctatattctttctttttttttcccctttcctaaaacttgtgatttcaccgtggggtgcttttgggtttcacgaatgttgtggctgcgggttgtaaaaataattctggctgatgtcctaaatcaacattggctgtttcttctttagatttccgtccattcatccccaataagggcatacttgttttcagcgatataataatttaaatgtggagatctttattttgtcttt

SEQ ID NO: 1664 - DNA, 1002 bp, Momordica charantia
cggccggggaggtccagcctgcaccacgattttctcatttctcctccctccgccgctctccgccaagctcctctcctctcctcttctccaacgccacaagctcagatcatggggaagggccctggtctctactccgacatcggcaagaaagccagagatcttctctacaaggattaccagagcgaccacaaattcaccgtcactacttacacttccggcggagttgctatcagctcaactggagttaagaaaggtgagctatttttggcagatgttagcactcagctgaagaacaacaacatcacaactgatataaaagttgacaccaactccaatgttcacactactgttactattgatgaacctgctcctggattgaagacaatttttagctttcgtgttcctgatcagagatctggcaaggttgatctccaatatcaacatgaatatgctggaataagcactggcattggtctgacggccagccccattgtcaatttctccggcgttgttggaaatgataaactgtcacttggcacagatttgtcgttcgacactgcttcaggaaacattaccaagttgaatgcaggcttgagttacactcattctgatctcattgctgctcttaccttgaacgacaaaggtgatgctcttactgcttcctactaccacctagtgagcccattgagcaacacagccgttggtgcggagctgtctcacagcttttcgagcaacgagaatactctcacaataggcacacagcatgctcttgaccccctgacttcggtgaaggctcgggtgaacaactatggcagggcaagtgctctaattcagcacgaatggcgtccgaaatccttgttcaccatttcaggagaagtggacaccagggctatcgaaaagagtgcgaagatcggtctggccttggctcttaagccttagaaaatatgtgacctccttggatttactggagggtaataaggcttcacataacgtagacagtta

SEQ ID NO: 1665 - DNA, 1171 bp, Cucumis sativus
taaacacttcaagggccaccctacgccacgatttcctcttttctccctcaccgccgaagttcatcaatctcctcttcccggaaaagccatggggaaaggtccaggtctttactccgacattggcaagaaagctagagatcttctctataaggattaccagagcgaccataaattcaccgtcactacttacacttctggtggagttgctatcagttctactggaattaagaaaggtgagatatttttggcagatgtaagcactcagctaaagaacaacaacatcacaactgacgtaaaagttgacacccactccaatgttcacactactgttactattgatgaacctgctccagggttgaagacaatttttagctttcgtgttcctgaccagagatctggcaaggttgaactccaatatcagcatgaatatgctggaataagcactggcattggtctgactgccagccccattgttaacttcgctggtgttattggaaatgacaaactctcacttggaacagatttgtcatttgacactgcctcaggaaacattactaaattgaatgcaggcttgagttacactcactctgaccttattgcggcacttaccttgaacgacaaaggtgatgctcttactgcatcctactaccacctggttagcccattgagcaacacggccgttggtgcggagctttcacatagcttttctagcaatgaaaacactctcactataggcacacagcatgctctagaccccctgacttcagtgaaggcacgggtgaacaactatggtagggcaagtgctctaatccagcacgaatggcgcccgaaatccttgttcaccatttctggagaagttgacacacgagccattgataagagcgcaaagattggtctagccttggttctcaagccttagggggaaatctgttcatccttggagattaccgtggagggtaataagctggttttttcttcatctagtgtagactttttttttcttcatattatcaaaatttcccttccccaactggaacattgatgtttgttttcaattggttgcatctgttggagggtgttcgggtttgtgaaaataattgacttcaacaatcagttttcttttggctgaagtgaactttgcggtggtttttaaactcaattgaaatcattc

SEQ ID NO: 1666 - DNA, 1241 bp, Carica papaya
atttctctcgcggaagtacctagaaattactcgccaaagaaaaaacaccacaagcaagcccttgtttctctcatttttcatctccatttactcgggaaaatcatggggaaaggtccaggtctctactccgacatcggcaaaaaagctagagatctcctctacaaggattaccagagtgaccacaagttcactctcaccacctatacttccactggagtcgcaataacttcaaatgggattaagaagggtgagctctttcttgctgatgtgagcactcagcttaaaaacaagaacatcactactgatgtaaaagtggacacgaagtcaaatctcttcaccactattactgtcgatgagcctgcacctgggctgaagacaatctttagctttattgtacctgatcagagatctggcaaggtggaactccagtatcaacatgagtatgctggaataagcaccagcattgggctgactgcaaatcctattgttaacttctctggtgtgattggaaacaattctgtggctgttggaactgatctttcctttgacactgccactggaaacttcaccaaatgcaatactggattgagctataccacttccgacctcattgcttccctaacattgaatgagaaagcggacactctgaatgcatcctactaccatgttgtgagccctctgactaatacagctgttggtgcagagctgacccacaccttctcaagcaatgaaaatactttgacagttggcacacagcatgcacttgacccgttgaccaccgtgaaggctcgagtgaacaactatggaagagcgagtgctctaatccagcatgagtggcgtccaagatcactattcactatttctggagaagtcgacaccagggcaatagagaagagtgctaaggttggactggccttggcgattaagcaataggctgagctagtagtcttggaatgagttcaactgctttgagatttaaacttaataagctagggagaaggattctaaatcttttttgtttcagttatcttttggtatctgaatgttgtttcatccggtttcacttgttttggtggttattagttgtacaaaataattgtggtggtggcaggcaccaacgtcaaccatatctctaatatttgaaattcctttcccacccatgcccaatttgagggttaaattcaaatgtactgttgtggaatttttggtatgaatagagagactttattcagttggtctaa

SEQ ID NO: 1667 - DNA, 1210 bp, Quercus alba
tttgaccatcatccgcgtcattatcgtcaacatcattcccattttccatgtcatcttagcgattcccttttccacttcttcgttgtttttgtgcttttcggatctccattttcgcttagccatggccaagggtcctggtctttactctgaaatcggcaagaaaacccgagatcttctttacaaggattaccaaaccgaccacaagttcaccatcactacctactctcccactggagttgctatcacttcatcaggaataaagaaaggtgagctgtttctggctgatgttaacacccaactgaagaacaaaaacatcacaactgatgtcaaagtggacacaaactctaatcttttcacaactattacaattgatgaacctgctcctgggctgaagacaatctttagcttcagagttcctgatcaaaggtctggcaaggtggaactccagtacttgcatgactatgctggaattagcaccagcattggattgactgccaatccaattgtgaacttttctggtgtcattggaaacaatgttgttcccttgggactgatcttgcatttgacactgcctctgggaacttcaacaagttgaatgctgggttgagttacacccaatctgacctcattgcttccctgacagtgaatgataaaggtgacacccttaatgcttcatactaccacatagtaagcccattgaccagcacagctgtcggtgcggagctgtcacatagcttttcaagcaatgaaaacactctcacaattggcacgcagcatgcacttgaccccttaacctcggtgaaggccagagtgaacaactatggtagggccagtgctctcatccagcatgagtggcgcccaaaatccttgttcaccatctcaggagaggtggataccagggcaattgaaaagagtgcaaagatcgggctggccttggcgcttaagccttgagctaattaactacccttggtgtgagtggaaagatggacttgtttcgttgtggtggagggtaataaggtagatgaatgactcttttgatccaattaatttcgatcttttgatgctgtgctattggtttctgcatattttggtggtcaaggttgtaaaaataatttagctggtggcacgaaccaatgtcaattttcatttcgaattcttatccattcaaatgtttatggaaggtattctttgaggaaacagttatatggag

SEQ ID NO: 1668 - DNA, 1273 bp, Cucumis melo
atcgttaaacacttccaagggccagcctacaccacgatttcctcttttcttcctcaccatcgaacttcatcaatctcgtcttcccggaatacccatgggaaaaggtccaggtctttactccgacattggcaagaaagctagagatcttctctacaaggattaccagagcgaccataaattcaccgtcactacttacactgccggtggagttgctatcagttccactggagttaagaaaggtgacatatttttggcagatgtaagcactcagctaaagaacaacaatatcacaactgatgtaaaagttgacacccactccaatgttcacactactgttacaattgatgaaccagctccagggttgaagacaatttttagctttcgtgttcctgaccagagatctggcaaggttgaactccaatatcaacatgaatatgctggaataagcactggcattggtctgactgccagccccattgttaacttcgctggtgttattggaaatgagaaactctcacttggaacagatttgtcatttgacactgcttcaggaaacattactaaattgaatgcaggcttgagttacactcactctgaccttattgcggcacttaccttgaacgataaaggtgatgctcttactgcatcctactaccacctggttagcccattgagcaacacggccgttggtgcggagctgtcgcacagcttttctagcaatgaaaacactctcactataggcacacagcatgctcttgaccccctgacttcagtgaaggcacgagtgaacaactatggtcgggcaagcgctctaatccagcacgaatggcgcccaaaatctttgttcaccatttcaggagaagtcgacacacgggccattgataagagcgcaaagatcggtctagccctggctctcaagccttagggggagatctgggtcgtccctggagattaccgtggagggtaataagctgtttttttttaatctagcgtagacttttttttcttcatattttcaaattttcccttccccaactggatcattgatgtttgcggtatgttttcaattggttgcatctgttggagggtattagggttgtgaaaataatttgacttcaacaatcagttttcttttggctgatgtgaactttgcggtggtgttcaaattcatttgaaatcattctctttagttcggactacacacacttcggtgaaaaacgaggggtaattgattggtctttttatttgtttgatgttgaaaaaaaaaaaaaaa

SEQ ID NO: 1669 - DNA, 943 bp, Camellia sinensis
gacaacaaccaagaacaatctaatctctctttactctctctcctaatttgggtgcaacagagatggggaaaggtccaggtctctactccgacatcggcaagaaagccagagatcttctgtacagggactaccagagcgaccataagttcactgtcaccacttacacttccaccggagtcgccattaccacatcaggaaccaagaaaggtgagttgtatttggctgatgttactacccaactaaagaacaagaacatcacaactgacataaaagttgacacaaactctaatgttctcactaccattaccattgatgaacctgcacctggactcaagacaatctttagctttattgttcctgatcagagatctggcaaggtagaactccagtacctgcatgagtatgctggaatcagtactggtattggattaactgctagtcccatcgtcaacttctctggcgtggttgggaatgatgttgtttcccttgggactgatctatcttttgacactgtgactggaaactttaccaaatgcaatgcagggttgaatttctccaagtctgaccttattgcttccttggcactgaatgacaaaggtgataccgttaccgcttcctactatcacacagtgagcccattgaccaatacagctgttggtgcggagctgacacgtagcttttcaaagaatgagaacacactcactattggaacacagcatgcattggacccactaaccacggtgaaggctcgggtgaacagctatggcaaggcaagtgctctcatccagcatgcatggcggccaaaatccctcttcaccatctcgggggaagtggacaccacggcaattgaaaaaagtgctaagattggactggctttggcactgaagccatgattttagaattgtctttgcttgaaagggaagaaccggaattgtttttgtat

SEQ ID NO: 1670 - DNA, 1188 bp, Cucumis melo
  misc_feature (609)..(609): n is a, c, g, or t
  misc_feature (663)..(663): n is a, c, g, or t
  misc_feature (665)..(665): n is a, c, g, or t
  misc_feature (688)..(688): n is a, c, g, or t
  misc_feature (996)..(996): n is a, c, g, or t
  misc_feature (999)..(999): n is a, c, g, or t
  misc_feature (1034)..(1034): n is a, c, g, or t
  misc_feature (1070)..(1070): n is a, c, g, or t
  misc_feature (1072)..(1072): n is a, c, g, or t
  misc_feature (1080)..(1081): n is a, c, g, or t
atcgttaaacacttccaagggccagcctacaccacgatttcctcttttcttcctcaccatcgaacttcatcaatctcgtcttcccggaatacccatgggaaaaggtccaggtctttactccgacattggcaagaaagctagagatcttctctacaaggattaccagagcgaccataaattcaccgtcactacttacactgccggtggagttgctatcagttccactggagttaagaaaggtgacatatttttggcagatgtaagcactcagctaaagaacaacaatatcacaactgatgtaaaagttgacacccactccaatgttcacactactgttacaattgatgaaccagctccagggttgaagacaatttttagctttcgtgttcctgaccagagatctggcaaggttgaactccaatatcaacatgaatatgctggaataagcactggcattggtctgactgccagccccattgttaacttcgctggtgttattggaaatgagaaactctcacttggaacagatttgtcatttgacactgcttcaggaaacattactaaattgaatgcaggcttgagttacactcactctgaccttattgcggnacttaccttgaacgataaaggtgatgctcttactgcatcctactaccacctggntngcccattgagcaacacggccgtnggtgcggagctgtcgcacagcttttctagcaatgaaacactctcactataggcacacagcatgctcttgaccccctgacttcagtgaaggcacgagtgaacaactatggtcgggcaagcgctctaatccagcacgaatggcgcccaaaatctttgttcaccatttcaggagaagtcgacacacgggccattgataagagcgcaaagatcggtctagccctggctctcaagccttagggggagatctgggtcgtccctggagattaccgtggagggtaataagctgtttttttttaatctagcgtaganttnttttttcttcatattttcaaattttcccttccccnactggatcattgatgtttgcggtatgttttcaattngntgcatctnntggagggtattagggttgtgaaaataatttgacttcaacaatcagttttcttttggctgatgtgaactttgcggtggtgttcaaattcatttgaaatcattctctcc

SEQ ID NO: 1671 - DNA, 1501 bp, Eucalyptus grandis
aagccccgcgacattcaacgaccccctgtaccgtctccctctctctccatctccctcctgcctcgcatcgacggccgcggatcgcgaatctcttcatccgacgctccacatcgcacctcaccgtaaaaatcccgactattcccattcccccatttattattattttagggttcctttcgataaaacacccgcaccgaacggcctcccctttcgcagcgacacagagagagattcctcgtcgaggccgccttccattttcgcttcctccattttctcgggaaaggaagaaggaaaaaatccggcagctcgatcatggcgaagggccccggcctctactccgacatcggcaagaaggccagagatcttctctacaaggattaccagggcgaccacaagttcaccatcactacctacacctccaccggaatcgctctcacttctacgggaatcaagaaaggagagttttttttggctgatgtgagcactcaactgaagaacaagaacatcaccaccgatgtgaaagtggacaccaactccaacctccttaccaccattactgttgacgaacctgctcctgggctcaagacaatatttagctttattgttcctgaccagagatctggtaaggtggaactccaataccagcatgaatacgctgggataagcacaagtatagggttgactgcaaatcccattgttaatttctctggagtggttggaaacaaccttcttgcccttggaactgatctgtccttcgacactgccagtggaaactttactaagtgcaatgctgggcttagcttcactaattctgatcttattgcatccttgacattgaatgataagggcgataccctcagtgcttcctactaccacacggtcagcccgcttaccagcactgccgttggggcagagctgtctcacagcttttcgagcaacgagaacatgctcacgatcggcactcagcacgcactggacccattgaccaacgtgaaggctcgggtgaacaactatggcagggcgagcgctctcatccagcacgagtggcgcccaaaatccttgttcactatctcaggggaggtcgacacgagagccatcgagaagagcgccaaaattgggctggccttggctttgaagccatagagtggagtagcgtcacctcattttacgagtgaaaaactccgtttcagttattccttggaaaagaaaaaaaaaaagcaaaagaaaacgccgtttcagtcggtggagagataataaggtaggggttagaaccggacatgtgtatcttgtctttcctgatttaacttttcccataagtttggtttcatgtctggtggccatggactgtataaaataattcgagctggccacacaaatcctatgcggtcattttccttcttttttcccagttctcccattcatcccattttcaatgcctcggacgttggctgaactcctgatttatccttggaatgaacacgtttgtcacttctttttgtca

SEQ ID NO: 1672 - DNA, 1300 bp, Prunus persica
atggcaaataggtcatttgtgcccgacattcgccaggtgtcggacacgcacagggtccggctcgaattccaaagcggaatttggatcgggtcctgtcaccatacctttattgtcaagttgattaatggccgtaatcggagccaaacacaaattacccctcactttctctacaattttcctttcgaattttctcgagaaacaatcatggtgaagggccccggtctctacttggatatcggcaagaaagccagagatcttctctacaaggattaccaaagcgaccacaagttcaccgttaccacttacacttctactggagttgcaatcagttcaactggaattaggaagggtgacctctatctgggagatgtgagcactcagctgaagaacaagaacatcacaactgatgtaaaagttgacaccgactctaatcttcgtacaaccattaccattgatgagcctgcacctggtctaaaggcaatctttagctttattgtacctgaccagagatctggcaaggtggagctccaatatcagcatgagtatgctggaataagtactggcattgggttgactgccaatccgattgttaacttttctggtgttgttgggaacaatcttctctctcttggaacagatctttcctttgatacagcctctggaaacttcacaaaatggaatgcagggttgaatttcacccatactgatctcattgcttcccttatactgaatgataaagccgacactgttactgcctcctactaccacactgtaagtccactcaccaacactgctgttggtgcggagctctcccatagcttttcaagcaatgaaaacagtctcacaattggaactcagcatgcacttgaccccctaaccacagtgaagggtcgtgtgaataactatggcagggcaagtgctctcatccagcatgagtggcgtcccaaatctttcttcaccatctcaggagaggttgatacccgggcaattgaaaagagtgcaaagatcggtttggccttggcactcaagccataggcttaagcgggtatccgttgctaatgggaaggtgggttctgtttttgcatggtggagggcaataagggtagtagttagatagaagaagaattttctctgatgaacttgtggtcctattgtggtgctattcgtttttcatttcatatcttggtggtaatgggttgtataaaataattggcacggaccgatgtcatattccttccgaatttccgtccatcccaatatcaatggaggatgtacttcaaagtttaaacacaaagtttta

SEQ ID NO: 1673 - DNA, 1191 bp, Malus domestica
cttcttcagtttacaaccagaccacaaatccagctccgctttctctgaaattttccttccaaattttctcgagaaacaatcatggtgaagggcccaggactctacttcgatatcggcaagaaagccagagatcttctctacaaggattaccagagcgaccacaagttcaccgtcaccacttacacttccaccggagttgcaatcagttcaactggaatcaggaagggtgaactgtatcttggggatgtgagcactcagctgaagaacaagaacatcacgactgacgtgaaagttgacaccaactctaatcttctcacgaccattactattgatgaacctgcacctggtctcaaggcaatctttagctttattgcccctgaccagagatctggcaaggtggagctccaatatcagcatgagtatgccgggataagcactagcattgggttgactgccaatccgattgttaacttttctggtgttgtggggaacaatcttctctctctgggaactgatctttctttcgacactgcctctggcaactttaccaaagtgaatgcagggttgaatttcacccattctgacctcattgcttccctattactgaacgataaagctgatactattactgcttcctactaccacactgtaagcccgctcaccaacactgctgttggtgcggagctgtcccatagcttttcaagcaatgaaaacagcctcacaattggcacagcacatgcacttgaccccctaaccacagtgaaggctcgggtgaacaactatggcagggcgagcgctctcatccagcacgagtggcgtcccaagtcattcttcaccatctcaggagaggttgataccagggcaatagagaagagcgcaaagatcggtctagccttggccctcaagccctaggcgtatgcaggtattctgtgaaactggaatgtggattgtttctgtttttccatggtggaggggggaataagagtaggtagacagaaggggaattttctctgatgaacttgtggtcattttccggtggtggtattcgtttccttcatatctttggcggtaatcgggttgtataaaataattggcacgaaccgatgtcgtgtcatattcctttcgaatgtccttccaacccaaatgttgacggagggtgtacgttaaaatgctttatgtgggtttttgtta

SEQ ID NO: 1674 - DNA, 1229 bp, Populus trichocarpa
tttttctttatatttctttatagaatcctctgctggagcaatccaaagctctctctcaatatatttttgtttcataccatttattaaaaaaaaaaaatcatgggaaaaggcccaggtctctacgtcgatattggcaagaaagctagagatcttctctataaagattaccagagcgaccacaagttcactgtcactacttatacctcaactggagttgcactcacttcaactgggatcaagaaaggtgagctgtttttagcagatgtcagcggtcagctaaagaacaagaacatcacaactgatataaaagtggacacaaactccaatcttctcacaactattactattgacgaacctgctcctgggctcaagaccatctttagcttcaaagtccctgatcagagatctggcaaggtggaactccagtaccagcatgagtatgctgggataagcactagccttgggttgactgcaaatcccattgttaacttctcaggcgtgatcgggagtaatgttgtttctcttgggacggatctctcatttgatactgctactgggaacttcactaaatacaatgcagggttgagttatacaaatgctgacctgattgcttctctgacagtcaatgataagggagacacccttactgcttcctactaccacacagtgagaccattgaccagtacagccgttggtgcagagctgacccgtagtttttcaagcaatgaaaacacattgaccattggcacgcagcatgcactcgaccccctgactacagtgaaggctcggttgaacaactatgggaaagcgagtgcccttatccagcatgagtggcgccccaagtctctcttcacaatctcgggggaggttgatacgaaggcaattgaaaagagcgctaagattggattggccttggctctcaagccctagaccaggcaacttctggtggtgtgactgtatctcagttgttttgttcgttgcagagagcaataatacactgaaggatgacagactttccatcagtttctgtgatgtgtttgggtttcacatatttgagggttatggtctcttagaaaataattctaattggtgtcaggcaccaatttactcttcaaaattttgcatccgccctcaataagagggtatacatgttctggagcagagttgctgcatttggatatttttggtttgatcatattaattatttttcttttcctggttgttgagta

SEQ ID NO: 1675 - DNA, 973 bp, Eschscholzia californica
tccctctctccatctctctctctctacttactattattgtttagattctctttaatcggaaaaaaatggtgaaaggtccaggtctctacactgatattggaaagaaagctagagatcttctttaccgggattaccaaagtgaccacaaatttaccctaactacctatacttcttctggagttgcgattacttcatctggaacaaagaaaggtgagcttttcttggcagacgtcaacactcagctgaaacagaagaacattactaccgatgtcaaagtcgacacaaactctagactctttacaaccattactgtcgacgaacctgcgcctggaatcaagacaatttttagcttcattgttcctgatcagaggtctggcagggtggaactccagtatcagcatgaatatgcaggaatcagcagtagcatcgggttgacagcaaaccctgttgttaacttttctggtgtatttggaagcaacctttgtgcccttggaactgatgtcgcctttgacactgcttctgggaacttcaccaagtacaatgctggtttgagtttcacccactctgatctcattgcctccttgactttgaacgataaaggtgacactttgaatgcttcctactaccacatagtaagcccactgaccaacactgctgtcggtgcggagttgacccatagcttctctagcaatgaaaacacactcaccattggcacacaacacgcattggaccctctaaccacagtgaaggctcgtttgaacaacttcgggaaggcgagtgctcttatccaacatgaatggaggcccaagtcccttttcacaatctctggagaggtcgatactaaagccattgagaagagcgcaaaagttgggcttgctttggctctcaagccctagataggaagtagtagtatccaagttattcgtgtcttgagtgagaaaaagtgttccagagggtggtagtgttggtagtg

SEQ ID NO: 1676 - DNA, 1200 bp, Prunus persica
gccaaacacaaatacccctcactttctctacaattttcctttcgaattttctcgagaaacaatcatggtgaagggccccggtctctacttggatatcggcaagaaagccagagatcttctttacaaggattaccaaagcgaccacaagttcaccgttaccacttacacttctactggagttgcaatcagttcaactggaattaggaagggtgacctctatctgggagatgtgagcactcagctgaagaacaagaacatcacaactgatgtaaaagttgacaccgactctaatcttcgtacaaccattaccattgatgagcctgcacctggtctaaaggcaatctttagctttattgtacctgaccagagatctggcaaggtggagctccaatatcagcatgagtatgctggaataagtactagcattgggttgactgccaatccgattgttaacttttctggtgttgttgggaacaatcttctctctcttggaacagatctttcctttgatacagcctctggaaacttcacaaaatggaatgcagggttgaatttcacccatactgatctcattgcttcccttatactgaatgataaagccgacactgttactgcctcctactaccacactgtaagtccactcaccaacactgctgttggtgcggagctctcccatagcttttcaagcaatgaaaacagtctcacaattggaactcagcatgcacttgaccccctaaccacagtgaagggtcgtgtgaataactatggcagggcaagtgctctcatccagcatgagtggcgtcccaaatctttcttcaccatctcaggagaggttgatacccgggcaattgaaaagagtgcaaagatcggtttggccttggcactcaagccataaggcttaagcgggtatccgttgctaatgggaaggtgggttctgtttttgcatggtggagggcaataagggtagtagttagatagaagaagaattttctctgatgaacttgtggtcctattgtggtgctattcgtttttcatttcatatcttggtggtaatgggttgtataaaataattggcacggaccgatgtcatattccttccgaatttccgtccatcccaatatcaatggaggatgtacttcaaagtttaaacacaaagttttaatgtggagtttcgtcacctgatgttcacagtttcatgca

SEQ ID NO: 1677 - DNA, 1431 bp, Ricinus communis
aatgaataaataatataaaaaaacaaccgcaaagccggatatgcccaagcataccctgtcccgattctcaaggtcacaacaaacctccacctcttgtcaagtaagaatcaacggccagcaaagcgcatatcttcccttgacaagatccaacggtccaaaccacacctcacaatatagaatcgtcaaacaaaaattaatatttagggttttctctttcttcgctcaatttgaagactctggaatactccacaggcggaaatttccttcattttcctcttctcatttgctcgggaaacaatcatggggaaaggtcctggcctctacactgatattggcaagaaagccagagatcttctttacaaggattaccagggcgaccataagttcaccgtcactacctacacttcaactggagtcgcaatcacttcaactggaattaagaaaggtgagatttatttgggggatataaccagccagctgaagaacaagaatatcacaactgatattaaagttgatactagctctaatgtttccacaaccatcaccgtggatgagcctgctcctggactcaagacgatctttagcttcaaaattcctgatcagagatctggcaaggtggaactccagtaccagcatgagcatgcagggataagcactagcattgggttgactgcaaaccccattgttaacttctcaggtgtgattgggagcagtgctgttgctcttgggactgatctctcatttgatactgccagtgggaacttcaccaaattgaatgcaggattgagttatagcaacactgacctcattgcttccttgacattgaatgacaaaggggatactcttaatgcttcctattaccacattgtgagcccactgaccaacacagctgttggtgcagagctgacccatagtttctcaagcaatgagaatacactgacttttggcacacagcatgcacttgaccccttgaccacagtgaaggctcgggtgaacagctatggcaaagcaagtgctctcatccagcatgaatggcgccccaagtctcttttcaccatctctggagaagtagacacaagggcaattgaaaagagtgctaagattggcttggctttggcactgaagccatagattaagtaaactttcattttgggtgactggaagattgaggagagcaataatgtgaggaaaaatgacatcccttttttggttacatttttttctagttacatcctttggttttaaatgaatatcctatctgtttctgcggttatatttggtctcactactttggtgctgaagagtgtagaaaataattgtagttggtggaacgaaccatctttaatttgttctcttagattttgcttctggccttgatagagggtatacatgccttcagtaaattattgcacatgatatattttttcccca

SEQ ID NO: 1678 - DNA, 1185 bp, Coffea canephora
ccgcatttcagccaaaaacccaacgccccttaccaagcccttctctctctctctctctcgctctcttcgttgaatttagcggcggaaatggtggagggtcccggcctctactccgatatcggcaaaagagcccgagatcttttgtacaaggattatcagggcgaccacaaattcaccgttactacttatactgccaatggagtggccattacatcatctggtataaagaagggtgaattgtttttggctgatgtcaacacccagttgaagaacaaaaacattacgactgatgtaaaagttgacaccaactccaaagtttttacaaccatcactgttgacgagcctgcacctggtctgaagacaatcatcagctttgttgtcccagaccaaagatctggcaaggtggaactccagtacttgcacgaatatgctggaattagtactggcattggacttactgcaaatccaatcgtcaatttctctggtgtggctggaaatgacaagcttgctctaggtgctgacctctcttttgacactgccacagggaacttcactaagtacaatgctggttttagtttcaccaattctgacttaattgctgcgttgaccttgaatgataagggcgacactctcactgcttcctactaccacagtgttagcccattgactaatacagctgtcggagcagagttgagtcacggtttctctagcaacgagaacacactcaccattggaacacagcattcattagacccattgaccacattgaaggctcgtgtgaacaactatggcaaggcaagtgctcttatccagcacgagtggcgtcccaagtctctctttacaatatcaggtgaggttgacacccgagcaattgaaaaaagtgcaaagatcgggttggctgttgctctcaagccgtgaagcaaatgattaccattggcagccggctatgtttgtacgcagagagcaaataaagtaggacagcaagaatctagtgaaactttatttcctagagtatggttaatcattttatgtggtcgaattagtgttctgttctgttcacaatttgcctggtcggaacccgcctgggtgggtacgacttattttgactggtattacattttgatggtgatggtgaattgaactttcaagcaagtattatatatggtgctacaatagggttaacct

SEQ ID NO: 1679 - DNA, 1287 bp, Populus trichocarpa
attgttggttccttttctttctagaatacacgactgcagcaagcaaaagctctctcctttttgtggtttccttgattaccgtttattcgaaaaaaaatcatgggaaaaggcccaggtctctacttcgatattggcaagaaagccagagatcttctctacaaggattaccagagcgaccacaagttcactgtcactacttacacttccgctggagttgccattacttcaactgggatcaagaaaggggagctgtttttagcggatatcagcagtcagctaaagaacaagaacatcacaactgatgtaaaagtggacacaaactccaatcttctcacaactattactattgacgaacctgctcctgggctcaagacaatctttagcttcaaagttcctgatcagagatctggcaaggtggaactccagtaccagcatgagtatgctggaattagtactagccttgggttgactgccaatcccattgttaacttctcaggtgtggttgggagcaatgttgttgctctggggactgatctctcatttgatactgccactgggaacttcactaaatgcaacgcagggttgagttatacgaattctgacctaattgcttccctaacagttaatgataagggagacacccttagtgcttcctactaccacacagtgagtccattgactagtacagctgttggtgcggagctgacccatagcttttcaagcaatgaaaacatattgaccattggcacgcagcatgcacttgacccgctgactacagtgaaggctcggttgaacaactatgggaaagtgagtgctcttatccagaatgagtggcgccctaagtctctattcacaatctcaggggaggttgatacgaaggcaattgaaaagagtgctaaggttggattggccttgtctctcaagccctagaacaagcaacttctgttgggtgtgactggaactcggttcttttgttagtagcagagaacaataaagtacggaaggatccacgaaatctccttttcaagtggacgtttcatctgtttgtttgatatacttgggtttcacgtatttggtggttatggtttcttggaaaataattctagatggtgtcagtaacatcaccaatttgttctttttaattttgaaattagtgcgtttgtgtatttgcttaaccagattaattatttttttgatctagtttcaccgagcatcttttcctgtttatttatccccaaaaactgtgaacttattctttatgttggtcccttgataaatgattgttga

SEQ ID NO: 1680 - DNA, 1114 bp, Nicotiana tabacum
ttctctacaagtttctgaactcataagcagaaaaaatggtgaagggtccaggtctttattctaacatcggcaaaaaagccagagatcttttatacagggattatgtcagtgaccataagttcaccgttactacttacacttccaacggagtggccattacctcatctggtgtgaagaaaggcgagttccttttagctgatgtaaacactcagctgaagaacaaaaacttcacaactgatgttaaagtggacaccaattcaaatgtctacactaccattactgttgatgaacctgcacctggactgaagacgatcttcagctttgttgttccagatcagaaatctggaaaggtagagctccagtacctgcatgagtatgctggaatcagtactagcattggacttgcagcaagtcctttagtcaacttctctggtgttgccggcaacaataagattgctttgggcactgatctgtcatttgatacctcgtcaggaaatttcacgaaatgcaatgctggtttgaatttcaccacttccgatttgatcgcgtccttggcattgaatgacaagggtgatacgctctctgcatcctactaccacaccgtgaatccattgaccaatacagctgttggtgcagagttgactcacagcttctcaagcaacgagaacactatgaccatcggaacacatcattccttggacccactgaccacagtgaaggctcgggttaacagctatggtaaggcaagtgctctcatccagcacgagtggcgtccaaaatccctctttacaatctctggcgacgtggacaccagggcaattgaaaagagcgccaaggttggattggccgtagccctcaagccatgagctagttcctaccttatacaggaaagtaaatgaggctggtttgttttgtcttagcccgaatcaataaattaggtagaatttttttgagcacataatccttctcactaggtggacaatgatcttatgagtgttactgatatcctatacactttctgggctgtaaagaataatctttagctggtggtgcaaaccagtatgattttctgctttgacctatccaaaaggttaattgatggattgatttgtct

SEQ ID NO: 1681 - DNA, 1220 bp, Malus domestica
gcccagaacaggatccaacggcccacgcctctcctctcagtctcagcaatcacccttttttggggttctagattttatccatttcgcttcttcgtcttctaactagaacacaaatccagctctgatttctctgaaattttccttccaaattttctcgagaaacaatcatggtgaagggcccaggactctacctcgatatcggcaagaaagccagagatcttctttacaaggattaccagagcgaccacaagttcaccgtcaccacttacacttccaccggagttgcaatcagttcgaccggaatcaggaagggtgatctgtatttgggggatgtcagtactcagctgaagaacaagaacatcacaactgatgtgaaagttgacaccaactctaacgttatcacgaccattactgttgatgaaccttcacctggtctcaaggcaatctttagctttattgcacctgaccagagatctggcaaggtggaactccaatatcagcatgagtatgctgggataagtaccagcattggtttgactgccaatccgattgtgcacttttctggggttgtggggaacaatcttctctctctgggaaccgatctttctttcgacactgcctctgggaactttaccaaagtgaatgcagggttgaatttcacccattctgacctcattgcttccctgttactgaacgataaagctgatactattactgcttcctactaccacactgtaagcccactcaccaacactgctgttggtgcggagctgtcccatagcttttcaagcaatgaaaacagcctcacaatcggcacagcgcatgcacttgaccctctaaccacagtgaaggctcgggtgaataactacggcagggcaagcgctctcatccagcacgagtggcgtcccaagtcattcttcaccatctcaggagaggtcgataccagggcaatagagaagagcgcaaaggtcggtctagccttggcactcaagccctaggcgtaggcaggtatccggtgcaaacggagtgttgattgttctgtctttcgcatggagggggcagaaaggtaggtagacagcaggcgaattctctctgatgaacttggtcctttcgctatggtgatatttgattccggcatacgttgtataaaataattggcacgaaccatgtcatgtcattccttctgaatgtcgatccaacccaaatcttaacggagggtg

SEQ ID NO: 1682 - DNA, 1309 bp, Liriodendron tulipifera
  misc_feature (1062)..(1062): n is a, c, g, or t
  misc_feature (1128)..(1128): n is a, c, g, or t
  misc_feature (1161)..(1161): n is a, c, g, or t
  misc_feature (1200)..(1200): n is a, c, g, or t
  misc_feature (1205)..(1205): n is a, c, g, or t
caaacccagaccctctctaccaagaaagcggccagaactagggttttctgtcatcgtcatcccttctctctctctctgaaatttccatttctgcaagaagaaaaaaatggtaaagggtccgggactctactccgatatcgggaagaaagccagagatcttctgtataaggattaccagagcgatcacaaattcaatctcactacgtacactgccacaggagtcgcaatcactgcatcaggaacaaagaaaggcgagctgtttctggccgacgtgaatacgcaattgaagaacaagaacatcacaactgatgtcaaagtggacacaaactctaatctttttacaacaattacaatcgatgagcctgcaccgggactcaagacgatttttagcttcattattcctgaccaaagatctggcaaggtggaactacaatacgtccacgactatgcagggattagcacgagcattgggttgactgcaaaccccattgtcaacttttcaggtgtagttgggagcagtggtctctctgttgggaccgacttgtcttttgacactgccagtggcaacttcaccaagtataatgccggattgagcttcgccagtgatgacctcatagcttccttgatcttgaatgacaagggggatacactaaccgcttcctactatcacatggtgagccctctgtcgaacatggcggtgggtgcagagctgtcgcacagcttcgcgagcaatgacaacacactcaccatcggcacccagcacgcgttggaccccttgaccacggtgaaggcccggctcaacaactatggcaaagcaagcgccctcatccagcatgaatggaggccaaagtcactcttcaccatctctggggaggtggacacccgtgccatcgagaagaacgccaagatcggcctagccctggctctcaagccataggctgtgatgagatgttgagagcagggcagtgcagacaataaggtaacagaggattggaaccgacagctcttctttttgtgcatcgtcttcttaaaggcatgtgattggaattcttctgctttttnttttgtttttttgtttttttttggttatatgatggtgttgataccatgggcctgtaaaaataattntggccagcagtagggaccagagattattttatnttgagaaaatttccttttgcccctcaacctcccattttntcctntgagcataaaataactagctttttgaagcggagttttgacttgaatgttgtactccattaatgggtttctgccatttgctgtttttaatatcttttttattttt

SEQ ID NO: 1683 - DNA, 1120 bp, Nicotiana tabacum
ggataaacaccgattctctctctctctccaagtagattctctctctagaaccttctctttctcttttgcagaaacagtcacagaagatggtgaagggtcctggactttactccgatatcggcaaaaaagctagagatcttctgtacagggactatgtcagtgaccataagttcaccgtcactacctatagctcaaccggagtggctattacctcatctggtctgaagaaaggtgaattattcttagccgacgttaacactcagctgaagaacaaaaatgttaccactgatgtaaaagtggacaccaattccaatgtctacactaccatcactgttgatgaacctgcaccaggactcaagacaatcgtcagcttcgtattaccagatcagaaatctggaaaggtagagctccaatacttgcatgagtatgctgggatcagtactggcattggacttacagcaagtcctcttgtcaacttctccggcgttgctggcaacaatactgttgctttgggcactgatctatcatttaacactgcctcaggcaatttcacaaaatgcaatgctggtctgagtttttccacttctgatctgattgcttccttagcactgaatgacaagggtgatacccttagtgcttcctactaccacactgtgaagccggtgacaaatacagctgttggagcagagttgactcacagcttctcaagcaatgagaacacgctgaccatcgggacacagcatttgttggacccattgaccacggtgaaggctcgggttaacagctacggtaaggcatgtgctctcatccaacacgagtggcgaccaaaatcccttttcacaatatctggtgaagtggataccagggcaattgaaaagagcgccaagattgggttggctgtagccctcaagccatgagtctgttactaccttacagagaagtgagtgaagcagtgttgttttgtatggtccagagtaataaattagatagacttgtttcagcacattatccttctgcaccagtaagaataaaccttcaactggtaatgcaaactcatgaatttttgcttatatccatcccaaatgttcattgagggaccagtttttgagcggccgcatga

SEQ ID NO: 1684 - DNA, 1275 bp, Manihot esculenta
acaagatccaacggttattacaacaccaacaacagttgggttctcctgttgtttttactcttctcgttcggttctcgtattctagaaggctcttctaagtgaaacccttcgattcgttccgcttctcattttccttgcaattttatcgggaaaatcatggggaaaggccccggtctctactccgacatcggcaagaaagccagagaccttctttacaaggattaccaggccgaccaaaaagtcactcttactacctacacttccaccggagttgcaatcacttcaagtggaactaagaaaggcgagttgtttttggcagatgtaagcagtcaatttaagaacaagaatatcacaactgatgtaaaagtggacacaaactccaatctgttcacaaccatcactgtagatgagcctgctcctggactcaagtcgatcttcagcttcagagttgaactccagtaccagcatgagtatgctgggataagcactagcattggattgactgcaaagccaattgttaacttctctggcgtgatcgggaacaatgttatcgctcttgggaccgatctctcgtttgacactgccactgggaacttcaccaaattgaacgcagggttgagttataccaatgctgacattattacttccctcacattgaacgataaaggggatactcttaatgcttcctattaccacacggtgagcccattgaccaatacagctgttggtgcagagctgacccatagtttctcaagcaatgagaagacattgtctattggcacacagcatgcacttgaccccttgacaacagtgaaggctcgggtgaacaactatggcagagcaagtgccctcatccagcatgagtggcgccccaaatctcttttcaccatctctggagaggtagacacaagggcaattgaaaaaagcgctaagattggattggccttggctctgaagccctaggcaaagcaatttttttgggtgattggaaggctgtccttgccttctttctagcagtggagggcaacaatgcaaggaagaataacactcctttgtattttttttttataatcaaatgaacattccatctgtttatgttgtctcattgggtttgacattttggtgggtatggggtgtggaaaataatgtagttggtgtaaggaaccatcttcaatttgttcctttggattatgcatctgcccatagtatagggtatacatgctcttgagcaattatacttcacatgaaatttttgttacattgattggttttttc

SEQ ID NO: 1685 - DNA, 1251 bp, Vitis vinifera
aaacaactccttattttccctcactttctctctcgtcgatctccatttcctcgggaaaaaatatgggaaagggtccaggtctctactccgacatcggcaagatagccagagatcttctctacagggattaccagagtgaccacaagttcactgttactacttacacatcctctggagtcgccattacttcatcaggaactaagaaaggtgagctttttattgcggatgtgaatacccagttgaagaacaagaacataacaacagatgtgaaagtcgatacaaactctaatctttttacgacaattactgttgatgaacctgcacctggactcaagacgatatttagctttatcattcctgatcagagatctggtaaggtggaactccagtacttgcatgagtatgctggaataagcactagcattggattgactgcaaatccaattgtgaacttctctggtgtggttgggaacaatactctctctcttgggactgatctctcgtttgacactgccactgggaacttcaccaaatgcaatgcaggcctgggtttctccaatgctgacctcattgctgccttgactttgaatgacaagggtgacacacttaatgcttcatactaccacactgtaagcccactgactaacacagctgttggtgcggagctgagccattgcttttctaccaatgaaaacactcttaccattggcacacagcatgccctggaccccttaaccaaggtgaaggctcgggctaataacagtggaaaggtaagtgctctaatccagcatgagtggcgcccaaaatccctcttcactatatcaggagaagtggatgccagggcggttgagaaaagtgcaaagattggactggccttggctctaaagccatagattaagcccataacttggtgtatgtggaaggttggccttgtttatggcagagagcaataaggtaggtagaatgaaatgacctttagacagtttccctttttcccggtgaaactttttttggtctattaatggggccctatttatttctttggatttggtggttatgggttgtaaaaaataattgttgctggtggaatggaccaacgatcatcattttcgagttcaaagctcatcatcctccttcacaatgttaaaggaggatagtttactttcagcaaaaaaattcttatgaattttggttcaacagtgtgttgtttcctttttggcttgaatacttaaatgctgaaccttttattcc

SEQ ID NO: 1686 - DNA, 1268 bp, Euphorbia esula
  misc_feature (138)..(138): n is a, c, g, or t
  misc_feature (177)..(177): n is a, c, g, or t
  misc_feature (198)..(198): n is a, c, g, or t
  misc_feature (217)..(217): n is a, c, g, or t
  misc_feature (231)..(231): n is a, c, g, or t
ggcacgaggctcgattcttctctctggaactttcttttccattttctcggaaaaatcatggggaaaggtccaggtctctacactgatattggcaaaaaagctagggatcttctctacaaggattaccaaggcgaccanaaattcaccgtcactacttacgcttctaatggagtcgcnatcacatcaagtggaattaanaaaggtgagttgtttttgncagatgtaagcagncagcttaagaacaagaacatcactactgatgtaaaagtagacacagcttccaatcttttcacaaccatcaccattgatgagccagctcctgggttgaagacaatttttagcttcaaagttcccgatcaaagatctggcaagattgagctccagtaccagcatgattatgctgggataagcactgctattgggttgactgcaaatccaattgttaacttctccggtgtggttggaaagaactctattgctcttgggacagatctttcttttgatactgccagtggaaactttactaaagtgaatgctggtttgacttataaccatggtgatcttattgctgcgttgaccctgaatgacaaaggggactcccttaatgcttcttattaccatatagtgagcccattaaccaacacagcggttggtgcagactttacacacaacttttcgagcaatgagaacacattgactattggtacacaacatgcacttgatcccttgaccagtgttaaggctcgggtcaacagctttgggaaagcaagtgctcttatccagcatgagtggcgtcccaagtcactattcaccatctccggagaggtagacactagagctattgagaagagcgctaagattggattggccttggctctcaagccctagatacatacatcagctttttttgggggctcaccggaggattttttcctagcgatggagaacaataatgaggataaatgataggtcatcctttttttgaaaaaaagaaaaatgaaacattcatatctttttgttatcatattgggtcttgctgtggtggatgtgacttgtagaaaataattctagttggtgttaggaaccatcttggatttgtttaatttggatttttgtatcagcccttagtatggggggtatacatgactttatcaaattaccaatgtttctatgttcttgattctttgggccctggaacggtgttctagtgacctgcttgatgttgttaagatcacaagataataggaaccttgggatgagaaaatgtc

SEQ ID NO: 1687 - DNA, 1138 bp, Petunia hybrida
gcggggaactcattctctatatattttttttctctagaagtttttcttttcggtggctgaaatggtgaagggtccaggcctttacacagacattggcaaaaaagctagagatcttttatacagggattatgtgagtgaccataagttcacccttcctacttacacttccaatggagtggccatcacctcatccggtatgaagaaaggtgagttccttttagctgatgtaaacactcagctgaagaacaaaaatatcacaactgatgtaaaagtggacactaattcgaacgtctacactaccattactgttgatgaacctgcacctggactgaagacgatcttcagctttgttgttccagatcaaaaatctggaaaggtagagcttcagtacttgcatgagtatgctggaatcagtactagcattggacttgcagcaagtcctttggttaatttctctggtgttgccggcaacaataccattgcattgggcactgatctctcatttgacacctcgtcgggcagtttcacgaaatgcaatgttggtttgaattacactgcttccgatttgatcgcttctttagcagtgaatgacaagggtgataccctcactggatcctactaccacattgtgaatccgctgaccaatacagctgttggtgcagagttgactcacagcctctcaagcaatgagaacactcttactgttgggacacatcattccttggacccgctgaccacagtgaaggctcgggttaacaactatggtaaggcaagtgctctcatccagcatgagtggcgtccaaaatccctcttcacaatctctggtgaagtggacactagggcaattgaaaagagcgccaagattggattggctgtatccctcaaaccctgagctaggtactactaccttacaggaaagtaaatgcggcaggtttctttcgtttgccccagattaataaattaggtagaattacttgagcacataatcgttttcaccatgcagtctatgatcttatgtgttactgtttttttatatgtttttctggctgtaaaaaattatcttgagctggtggtttgaaccagtatgattacttgcttatccatcgtaaaacttaattgatggatttctttgtcttaa

SEQ ID NO: 1688 - DNA, 1173 bp, Solanum tuberosum
attctttctctctctgtaagtagactttctctctctagaagcttctctttctctcttttgcagttcgagtttttttttccttctgttgcagagatggtgaagggacctggactttactccgatatcggcaaaaaagctagagatcttctgtacagggactatgtcagtgaccataagttcaccgtcactacgtacagcacaacgggagtggctattaccgcatctggtctgaagaaaggtgaattattcttggcggatgttagcacccagctgaagaacaaaaacattaccactgatgtaaaagtggacaccaattccaatgtttacactaccatcactgttgatgaacctgcaccaggactcaagacaattttcagctttgtcgtaccagaccagaagtctggaaaggtagagctccagtacttgcatgagtatgctgggatcaacactagcattggacttacagcaagtcctcttgtcaacttctctggcgttgctggaaacaataccgttgctttgggcactgatctatcatttgacactgccacaggcaatttcacaaaatgcaatgctggtctgagtttttcttcgtctgatctgattgcttctttagcattgaatgacaagggtgataccgtcagtgcttcctactaccacaccgtgaagccagtgacaaacacagctgttggtgcagagttgactcacagcttctcaagcaatgagaacacactcaccattgggacacaacatttgttggacccattgaccacggtgaaggctcgtgttaacagctatggcaaggcaagtgctctcatccaacacgagtggcgaccaaaatccctcttcacaatatctggtgaagttgacaccagggcaattgaaaagagcgccaagatcgggttggctgtagccctcaagccatgagttcgttactaccttacagaaaagtgagtgaagcaatgtcattttgtatgatccagagtaataaattaggtagatttgtttcagcgcattatccttctgcgccggtgagaaaaaccttcagctggtaatgcaaactcatgattttcgctaatacccatcctaaatgttgattgaggggactggtttttaaccttttgcctgggcttctggcttcatcattcgcataattgattaatctttctttgatca

SEQ ID NO: 1689 - DNA, 1182 bp, Solanum phureja
gtctttcgatacacaccgattctttctctctctgtaagtagactttctctctctagaagcttctctctctcgttcgagtttttttttccttctgttgcagagatggtgaagggacctggactttactccgatatcggcaaaaaagctagagatcttctgtacagggactatgtcagtgaccataagttcaccgtcactacgtacagcacaacgggagtggctattaccgcatctggtctgaagaaaggtgaattattcttggcggatgttagcacccagctgaagaacaaaaacattaccactgatgtaaaagtggacaccaattccaatgtttacactaccatcactgttgatgaacctgcaccaggactcaagacaattttcagctttgtcgtaccagaccagaagtctggaaaggtagagctccagtacttgcatgagtatgctgggatcaacactagcattggacttacagcaagtcctcttgtcaacttctctggcgttgctggaaacaataccgttgctttgggcactgatctatcatttgacactgccacaggaaatttcacaaaatgcaatgctggtctgagtttttcttcgtctgatctgattgcttctttagcattgaatgacaagggtgataccgtcagtgcttcctactaccacaccgtgaagccagtgacaaacacagctgttggtgcagagttgactcacagcttctcaagcaatgagaacacactcaccattgggacacagcatttgttggacccattgaccacggtgaaggctcgtgttaacagctatggtaaggcaagtgctctcatccaacacgagtggcgaccaaaatccctcttcacaatatctggtgaagttgacaccagggcaattgaaaagagcgccaagatcgggttggctgtagccctcaagccatgagttcgttactaccttacagaaaagtgagtgaagcaatgtcattttgtatgatccagagtaataaattaggtagatttgtttcagcgcattatcctactgcaccggtgagaaaaaccttcagctggtaatgcaaactcatgatttttgctaatacccatcctaaatgttgattgaggggactggtttttaaccttttgcctgggcttctggcttcatcattcgcataattgattaatatttctttgatca

SEQ ID NO: 1690 - DNA, 1278 bp, Helianthus annuus
atagcatctccagttattgaaaaaacagttatttagaaaaagagagagataaattatttgtagaaattcagtgaaaaatcaacggctgagaagctccgattgagaagaaaaaacacgtacacaccaacaacccacaccgattcaatttaatcggctgcgtcgtctttgaaattcacgcaaacgatcatctctttctctctctctctaacatttctctcactagaacaaagatggtgaaaggtccaggtctctatcctgatatcggcaagaaagccagagatcttttgtataaggattaccagagcgaccacaagtttactctcactacctataccgccaacggagttgccattacctcatcaggagctaagaaaggtgagttatttttggctgatgtcagcactaaactgatcaacaaaaacatcacgactgatgtcaaagtggacaccaactcgaagctattcacaactatcacaatcgatgaacccgcacctggactgaaaacaatcttcagtttcgttgttcctgatcagagatctggcaaggttgaacttcaatacctgcacgagtatgcaggaatcagtactagtattggtttgaccgctagccccttggtcaacttttcaggggtggctggaaacaacacagtggcactcgggactgatgtctgcttcgatactgcttctggaaatttcactaaatataatgcagcattaagtttctcaacttctgaccttattgcatctttgatcctgaacgataaagcagacaccctaactgcttcctactaccataccgtcagcccattgactaacacagcggttggcgcagagttgagccatgggttctctagcaacgagaactctctaacaatcgggactcagcattcacttgaccctttgaccacggtgaaggctcgggtgaacaacgccggcatagcaagtgctcttttgcagcatgaatggcggccgaagtctgtgttgactatttcgggagaagtggacactagggcgattgagaagagcgcgaaggttggattggctctagctttgaagccttgaagcgctttatagtgatgttggcactggaataagtttggttaatgacttgatgttgattttccaattgaggacttactgccttgcaaaaaatatttccattgattttggtcttgttaacaatggatcagttgctgtttaagcagacatattttttaaatcgggttgattatcatcttagaaaccgttaaaagcgataaatccacagggtttgaatggg

SEQ ID NO: 1691 - DNA, 1170 bp, Helianthus annuus
  misc_feature (31)..(31): n is a, c, g, or t
gcggggagcaacgataatctctttctctctntctctctctctaacatttctctcactagaacaaacaaagatggtgaaaggtccaggtctctatcctgatatcggcaagaaagccagagatcttttgtataaggattaccagagcgaccacaagtttactctcactacctataccgccaacggagttgccattacctcatcaggagctaagaaaggtgagttatttttggctgatgtcagcactaaactgatcaacaaaaacatcacgactgatgtcaaagtggacaccaactcaaagctattcacaactatcacaatcgatgaacccgcacctggactgaaaaccatcttcagtttcgttgttcctgatcagagatctggcaaggttgaacttcaatacctgcacgagtatgcaggaatcagtaccagtattggtttgaccgctagccccttggtcaacttttcaggggtagctggaaacaacacagtggcactcgggactgatgtctgcttcgatactgcttctggaaatttcactaaatataatgcagcattaagtttctcaacttctgaccttattgcatctttgatcctgaacgataaagcagacaccctaactgcttcctactaccataccgtcagcccattgactaacacagcggttggcgcagagttgagccatgggttctctagcaacgagaactctctaacaatcgggactcagcattcacttgaccctttgaccacggtgaaggctcgggtgaacaacgccggcatagcaagtgctcttttgcagcatgaatggcggccgaagtctgtgttgactatttcgggagaagtggacactagggcgattgagaagagcgcgaaggttggattggctctagctttgaagccttgaagcgctttatagtgatgttggcaccggaataagtttggttaatgacttgatgttgattttccaattgaggacttaccgccttgcaaaaaatttccattgattttggtcttgttttcaatggatcagttgctgtttaagcagacatattttttaaatcgggttgattatcatcttaaaaactgttaaaaaagcgaaaaatccacaggtttgaatgagcattacctcacatctccccccttcggaaaaaccaaacagtactagcctgagtt

SEQ ID NO: 1692 - DNA, 1160 bp, Tragopogon dubius
aactccgattgagaagaaaaaccacaaaaggcaacaactcacctccgattcaatttaatcgcctgcgtcgtgtttaagatccacacaaacgatcatcttcgtctcatcactttctctctcacatttctcgaacaagaacagagatgggaaaaggtccaggtctctatcccgatatcggcaagaaagccagagatcttctgtacaaggattaccaaagcgaccataagttcactctcactacctatgccgccaacggagttgccattacctcatcaggagccaagaaaggtgagttgttcttggcagatgtcagcactaaactgatcaacaaaaacatcaccactgatgtcaaagtggacaccaactcaaaggtattcacaactatcaccattgatgatgcagcacctgggctgaagaccatcttcagctttgttgctcctgatcagcgatctggcaaggttgaacttcagtacttgcacgagtatgcaggaattagtaccgggattggtttgaccgctagcccaatagtcaacttctctggggtggctggaaacaacacagtgtcactcggaaccgatgtttcctttgacaccgcttccggaaacttcaccaagtacaatgcagccctaagtttcacaagctctgacctcattgcttccttgatactgaacgataaagcagacacgctcacggcttcctactaccacacagtgagtccattaaccaacacagtagtcggtgcagaattaagccacggcttctccagcaacgaaaactctttaaccatcggaacacaacattccctcgacccattgaccacggtcaaagcccgggtcaacaatgccgggatagcaagcgctctcttgcagcatgaatggcgccctaaatcattgtttaccatatcaggggaagttgacaccagggccattgaaaagagcgctaaggttggattggccctagctttgaagccttgaaaaatggcgggatatgattcagagggggagacagagaaataaggtgagtttatttttgtttttcatcatttgttatacatttatgaaattgagttggtgtaattgccttttcgtggactgctgactcgtttaaaaataaaaaaagaacttgcaaagggtttgtggatgaaatttaccaatcatgta

SEQ ID NO: 1693 - DNA, 1000 bp, Liriodendron tulipifera
agggttttctgctctcgccctctctcctctttttgtttcctcatttttgtgaaaaggaaggaagaaaatgtcgaagggtccgggtctctactcagatattggaaagaaggcgagagatcttctgtgtaaggattaccagagcgaccataaattcaccatcaccacctacacttctactggcgttgcgattacttccactggaataaagaaaggtgagctgtttttagctgacatcaatactcagctgaagaacaagaacatcacaactgacatcaaagtggacacaaactctaatctttttacaacgattacggtcaacgaacctgcgcccgggctcaagacaattgttagcttcattgttcctgatcaaaagtcaggcaaggtggaactgcaatacttgcacgactatgcagggatcgccacaagcattggcttgactgcaaaccctgtcgtcaacttttctggtgtggttgggagcaatgttcttgccgttggagctgacctctcttttgacactgcatcgggcaacttcaccaagtacaacgcagggttgagctactccaatgctgatctcattgcttctttgaccttgaatgacaagggagacaacctgaaggcatcctactaccacacagtgcgccccctgacgagcacggctgtaggtgcggagctgtcccacagcttcacgagcaatgagaacactctcacaatcggcacccagcatgccctggaccccttgaccagtgtcaaggcccgggtcaacaactacggcaaggcgagcgccctcatccagcacgagtggaggcccaagtcactcttcaccatctccggagaggtggacacccgggccattgagaagagcgcgaagatcggtctggccttggcactcaagccctaaagaaagactgactgtgggacacaaggagagagacctagcttagggagatagaagaaatgcccccgcccatttgcgatggtgcggaatgcaataaggtaagca

SEQ ID NO: 1694 - DNA, 1088 bp, Petunia hybrida
caaaactccatttctacacgctcttagaatcttctctttacagaaatgaagggtcctggactttattctgatattggcaagaaagcgagagatcttttgtacagggactatgtgagtgaccataagtttaccgtcacaacttatagcaccaccggagtggctattacctcatctggactgaagaaaggtgaattattcttagctgatgtcaacacacagctgaagaacaaaaacattaccactgatgtaaaagtagacaccctttctaatgtctacactaccatcactgtagatgagcctgctccaggactcaagacaatcttcagctttgttgtgccagatcagaaatctgggaaggtagagctccagtacttgcatgagtttgctgggatcaatactagcattggacttacagcaagtcctcttgtccacttctctggtgttgctggaaacaataccgttgcattgggcactgatgtatcatttaacaccgctacaggcaatttcactaaatgcaatgctgggctgagtttttccacttctgatctgattgcttccttagcattgaatgacaagggtgataccctcactgcttcctacttccacactgtgaagccattgacaaatacagctgttggtgcagagttgactcacagcttctcgagcaatgagaacactctgaccgttggaacacaacatttgttggacccattgaccacggtaaaagctcgggttaacaattatggtaaagcaagtgctctcatccaacatgagtggcgaccaagatctctcttcacgatatctggtgaagtggacacaagggcaattgaaaagagcgccaagattgggttggctgtagccctcaagccatgaaatagttacaaccttacagaaaagtgagtgtcgttttgtatggtctacactaataaatttgatatgtttcttcagcacattatgccttttgcaccaatgatgttcaactagtggtgcaaactcgtgggattttgctcttatgtgctagtagatgtttgatgtaaagacctgtttttgttttctcctgaaattcatttttcatttaaaaaaaaaaa

SEQ ID NO: 1695 - DNA, 1416 bp, Solanum lycopersicum
gtaacaaaccaagtctttcgataacacaccgattctttctctctgtaagtagactttctctctctagaagcttctctttctctcttttgcagttcgagttttttttttctctcttctgttgcagcgatggtgaagggacctggactttactccgatatcggcaaaaaagctagagatcttctgtacagggactatgtcagtgaccataagttcaccatcactacgttcagcacaacgggagtggctattacctcatctggtctgaagaaaggtgaactattcttggcggatgttagcacccagctgaaaaacaaaaacattacaactgatgtaaaagtggacacgaattccaatctttacaccaccatcactgttgatgaacctgcaccaggactcaagacaattttcagctttgttgtaccagaccagaagtctggaaaggtagagctccagtacttgcatgagtatgctgggatcaacactagcattggacttacagcaagtcctcttgtcaacttctctggcgttgctggaaacaacattgttgctttgggcactgatgtatcatttgacactgccacaggcaatttcacaaaatgcaatgctggtctgagtttttcttcgtctgatctgattgcttccttagcattgaatgacaagggtgatactgtcagtgcttcctactaccacaccgtgaagccagtgacaaacacagctgttggtgcagagttgactcacagcttctcaagcaatgagaacacactcaccattgggacacagcatttgttggacccattgaccacagtgaaggctcgcgttaacagctatggtaaggcaagtgctctcattcaacacgagtggcgaccaaaatccctcttcacaatatcaggtgaagttgacactagggcaattgaaaagagcgctaagatcgggttggctgtagccctcaagccatgagtgtgttactaccttacagtaaagtgagtgaagctgtgtcattttgtatgatccagagtaataaattagatagatttgtttcagcacattatccttctgcgccggtgagaataaccttaagctggtaatgcaaactcatgaatttttgctaagatccatcctaaatgttgattttgaggggactggtttttaacctttcgcctgggcttcatcattcgcctaagtaattaatctttcttccaattgatactttgtagtcataattaagatgaatcggaaagtctctctgcatagtaggatactttatgatctttgaagtttttaagtacaaaacgaaccataatgatgttcagcatcatagcctaaatatgttcacttgatgtgaactgtttgttacctctgtacagaagacgcatcctctggctcatgaggaatgaaaacagcagatgtattagatga

SEQ ID NO: 1696 - DNA, 985 bp, Lactuca sativa
gcggggatccaatttctcaagcacgaagaacagaagagatggggaaaggtccaggtctctacccctgatatcgggaaaaaaaccagagatcttctttacagggattaccagagcgatcataagttttctctcacaacatataccgccaacggagtttcaatcacttcatcaggagctaagaaaggcgagttgtttttggctgatgtgaacacaaaactcatcaacaaaaacatcacaaccgatgtcaaagtggacacaaactctaaggttttcacaactatcaccattgatgaacctgcacctggactcaaaacaatcttcagctttgttgttcccgatcagagatctggcaaggtggaacttcaatacttgcacgaacatgcgggaatcagtacaagcatcggtttgaccgcaagtccaatagtcaacttctctggtgtggcgggaaacaacacagttgcagtcgggaccgatatttcattcgacactgcttccggaaacttcaccaaatacaatgcgggcctcagtttctccacttctgacctcattgcatccttgactctgaatgataaaggtgacacgcttactggttcctactaccacactgtaagtccgttgaccaatacggctgtgggtgcggagttgactcatgggttctcgagtaatgaaaactcgttgacttttgggacacagcattcgtttgaccctttgactatggtcaaggctcgggtcaataattttggtatagcaagtgctcttattcagcatgaatggcgcccgaaatcggtttttactatctcgggagaagtggatacaagggctattgaaaagagtgctaaggttggtttggctcttgctttaaagccttgaattttggaaatgaagtgaaaggattcaccctgaacatacatgtgtcgtgttttgatgatatttgatatgttggttttgtatgggtgaagagaaatatgtaggtaggtaggtaggt

SEQ ID NO: 1697 - DNA, 1099 bp, Centaurea maculosa
  misc_feature (842)..(842): n is a, c, g, or t
  misc_feature (845)..(845): n is a, c, g, or t
  misc_feature (850)..(850): n is a, c, g, or t
  misc_feature (899)..(899): n is a, c, g, or t
  misc_feature (930)..(930): n is a, c, g, or t
  misc_feature (942)..(942): n is a, c, g, or t
  misc_feature (954)..(954): n is a, c, g, or t
gagaagccactacctctgattcatttaatcgccataaaaccgatctcttatcactttttctctcacatttcttcaacaaccaacacacagatatggggaaaggtccaggtctctatcccgatatcggcaaaaaagccagagatcttttgtacaaggattaccaaggcgaccataagttcaccatcaccacctataccgctaacggagttgccattactgcatcaggagccaagaaaggtgagttgattttggcagatgtcaacactaaactgatcaacaaaaacatcactactgatgtcaaagtggacacaaactcaaagctattcacaactgtcaccatcgatgaagctgcacctggattgaagaccatcttcagctttgttgctcctgatcagagatctggaaaggttgaacttcagtacttacacgagtacgcaggaatcagtaccagcatcggtttgaccgctagccccattgtcaacttctctggagtagccggaaacaacactgtggcacttgggactgatgtttcttttgatactgcatctggaaacttcaccaaatataacgcagctctaagtttctcgacttctgacctcattgcatccttgacagtgaacgataaggcggatagcgttactgcttcctactaccacatagtaaggccattgaccaacacagcagttggcgcagaactgagccacggtttctcgagcaacgagaactctctgaccatcggaacacagcattcgttagacccattgaccacggtcaagacccgggtgaacaattcggggatagcaagcgctctcctgcagcacgaatggcggccaaagtccctnttnaccanctcaggagaagtggacaccagggcaattgagaagagtgcaaaggttggnctggctctagctctaaagccttgatttgagngacccaacacanaacacttttgantgaagcagagaaataaggttgggttgatgcagattttttaccattgcaaaatgttgcactattttgaatacatgacttgaggaccatggtttattttgtgttttcataaattctccattcatttgtttaaggagacatgttatcc

SEQ ID NO: 1698 - DNA, 1194 bp, Cichorium intybus
gattgagaagaaaaacacgaaacccaacaactctccttcgattaatttaatcggctgtgttgtgcttgaaatccacagaaacgatcatctccgtctcatcactttctctctcacatttctcgaacaacaacagagatggggaaaggtccaggtctctatcccgatatcggcaaaaaagccagagatcttctgtacagggattaccaaagcgaccacaagttcactctcactacctatgccgctaacggagttgcaattacctcatcaggatccaagaaaggtgagttgttcttggcagatgtaagcactaaactagtcaacaaaaacatcacaaccgatgtcaaagttgacacaaactcaaagctattcgcaaccatcaccattgatgaagctgcacctggactcaaaaccatcttcagctttgttgcccctgatcaaaaatccggaaaggtggaacttcagtacttacatgagtatgcaggaatcagtaccagcattggtttgaccgctagccccatggtcaacttttcaggagtggctggaaacaacacagtgtcactcgggactgatgtgtcattcgacactgcttccggaaacttcaccaaatataatgcagctttaagtttcacaacttctgacctcattgcatccttgatactaaatgataaagcggatacgcttacggcttcatactaccacactgtgagcccgttgaccaacacggtggttggtgcagagttaagccacgggttctcaagcaatgagaactcgttgactattgggacacagcatttgcttgaccccttaaccatggttaaggctcgggttaataatgcgggtatagcaagtgctgttttgcagcatgaatggcggcctaaatcattgtttaccatttcgggtgaagtggataccagggccattgaaaagagtgccaaggttggattggctcttgctttgaagccttgaaaagaaagcatggttttatatgattatgatgcaagagaaataaggtgagaaaagaatgtgtcagctttttgaatgaggataccgtgtttatttttttgtttcatgatttgtttggtctcattgttgacaatggagatacatttatgaaattgatcattgctctgtctctgagtaataaacttgcctaaaaataaaaataatagacttccccaaaaaaaaaaaacaaag

SEQ ID NO: 1699 - DNA, 1207 bp, Coffea canephora
cggccgggggatccagcctcatattctctgtctctattttccccgtcaaactccccgtcgcagcttacaacccaacgccgccaaccaaacccttctttctccctcctcagtcgaaatttagcggcggaaaatggtgaagggtcccggcctctactccgatatcggcaaaagagcccgagatcttttgtacaaggattatcagggcgaccacaaattcagcgttaccacttatagtcccaatggagtggccattacagcatctggactaaagaagggtgaattgtttctgggtgatgtcaacacgcagttgaagaataaaaacattacgactgactttaaagtcgacaccaactccaaagttttcacaacaatcactgttgatgaacctgcacccggtctgaagacaatctttagctttgttgtcccagaccaaagatctggcaaggtggaactccagtacttgcacgaatatgctggaattagttctagcattggacttactgcaaatccaattgtcaatttctctggtgtggctggaaatgacaagcttgctctaggtactgacgtctcttttgacactgccacagggaacttcactaagtacaatgctggtcttagttttaccaattctgacctaattgctgcattgaccttgaatgataagggcgacaccctcactgcttcctactaccacagtgttagcccattgactaatacagcagttggagcagagttgagtcacagtttctctaccaacgaaaattctctcaccctcggaacacagcatttattagacccattaaccacagtgaaggctcgcgtgaacaactacggcaaggcaagtgctcttatccagcatgagtggcgcccgaagtctctcttaaccatatcaggtgaggttgacacccgggcaattgaaaaaagtgcaaagattgggttggctgttgctctcaagccatgaagcaaatgattaccattggtttgggtagcaccccggcaatgtttgcatgggcagagcaaataaatagggcaacaagagtctagtgaaactttgtttcctaaatccaattaatctttttatgtggtagaattggttttctgatctattcatagtttggctggtcggaacctgtctggcttggtatgacttattttgacttggtgatggtgaattgaactttcaagcaaagttttgtatgagatgcta

SEQ ID NO: 1700 - DNA, 1171 bp, Solanum melongena
agtctctcgataaacaccgagtctctctctgtgtaagtagactttctctctctagaaatttctgtttctctctcctttgcggttcgacttttttctgttgcagagatggtgaagggtcctggactttactccgatatcggcaaaaaagctagagatcttctgtacagggactatgtcagtgaccacaagtttaccatcactacgtacagctcaacgggagtggctattacctcatctggtctgaagaaaggtgaattattcttggcagatgttagcacccagctgaagaacaaaaacattactactgatgtaaaagtggacaccaattccaatgtctacactaccatcactgttgatgaacctgcaccaggactcaagacaatcttcagctttgttgtaccagatcagaaatctggaaaggtagagctccagtacttgcatgagtatgctgggatcaacactaacattggacttgcagcaagtcctcttgtgaacttctctggcgttgctggaaacaataccgtggcattgggcaccgatgtatcatttgacactgccacaggcaatttcacaaaatgcaatgctggtctgagtttttctacttctgatctgattgcttccttagcattgaatgacaagggtgataccgtcaatgcttcctacttccacactgtgaagccattgacaaatacagctgttggtgcagagttgactcacagcttctcaagcaatgagaacacactgaccattgggactcagcatttgttggacccattgaccatggtgaaggctcgcgttaacagctacggtaaggcaagtgctctcatccaacatgagtggcgaccaaaatccctcttcacaatatctggtgaagtggacactagggcaattgaaaaaagtgctaagatcgggttggctgtagccctcaagccttgagtttgttactaccttacaggaaagtgagtgaagcagtgtcattttgtatgatccagagtaataaattagatagaattgtttcagcgcattatccttcggtgttggtgagaataacttcagctggtaatgcaaactcatgaacttttgcttatatccatcctaaatgttgattgagaaaggcctttgacctttcatctgggcttcatcattcacatcattgattaatctttctttg

SEQ ID NO: 1701 - DNA, 1338 bp, Lotus japonicus
aacggctagagttcatcctctccctcccgaatattagggtttgtttttcactctcctcctaccactcccacacatttcctccgcttcagttttctccagaaaatcatggtgaagggtccaggtctctactccgacatcggcaagaaagctcgagatcttctgttcaaagattatcagaatgaccacaagttcaccatcaccacttacacttctgctggagtggaaatcacttcaaccggtgtcaagaagggcgagatatatttggcggatgttagcactaagctaaagaacaagaacatcactacagatgtcaaagtggacactaactcaaatctacatacaaccatcactgtggatgaacctgcacctggactgaagacaatttttagctttatttttccagatcagaaatctggcaaggtggaactccaataccaacatgaatatgctggaatcagcactagcattggattgacagcaagccctattgttaacttctctggtatcattggaaataatttggtcgctgttgggacagatctttcatttgatactgcctctggcaactttaccaagtacaatgcaggattgaacgtcacgcatgctgaccttattgcatctcttactctaaatgataaaggtgactctcttaacgcctcatattaccatgttgttagtccgctgactaacactgctgttggtgcggagctttcacatagcttttctagcaatgaaaatatactgactattggcacccagcatgctcttgacccaataactttactgaaagctcgggtgaacaattatggcagagcaagtgctctgatccagcatgaatggaatccaaggacccgcgtatctcttgttggcgaggtggatactggggcaattgaaaaaagtgcaaaggttggtcttgctttggctttgaagccgtagacttgatgattttgaattgataggctgcgtggcaataagttttagagctagggtttcactttcctcatgaacctttggtccttcatattggagctgttaatttcttgctgggtagggtgtaaaattaataagcacagaaccaattttaaagtacattcattcaacaaatccagccaaacctcattgatttagatgcacatttgactaagttttttgagcatggaaggtgatggtcatgcaatattattgttgggtgtatatcaaagctttgacttttgtttggtaaatatgtggttccgtttatttggtagtaacagttagtttttcttttgtttaccactgaatgtatagttttctttaaatagtgttgacacatgattttctattcaaattgagttggag

SEQ ID NO: 1702 - DNA, 1079 bp, Parthenium argentatum
gaaagaagaacaagagagatggtgaaaggtccaggtctttatcccgatatcggcaagaaagccagagatcttctgtataaggattaccagagcgaccacaagttctctctcactacctataccgctaacggagctgccattacctcatcaggagctaagaaaggtgagctctttttggctgatgtcagcactaaactgatcaacaaaaacatcacgactgatgttaaagtagacaccaattcaaagctatacacaactatcacaattgatgaacctgcacctggactgaaaaccatcttcagttttgttgttcctgatcagagatctggcaaggttgaacttcagtacctgcacgagtatgcaggaatcagtaccagtatcggtttgaccgctagccccttggtcaacttttcaggggtagccggaaacaacacagtggcacttgggactgatgtttgctttgataccgctactggaaatttcactaaatataatgcagccctaagtttctcaacttctgacctcattgcatcgttgatactgaatgataaagcagacaccctaactgcttcctactaccatactgttagtccattgaccaacacagcggttggcgcagagttgagccatgggttctctagcaacgagaactctttaacaatcgggactcagcattcacttgaccctttgaccacggtcaaggctcgggtgaacaatgctggcatagcaagtgctcttttgcagcatgaatggcggccgaaatctttgttgaccatctcaggagaagtggacactagggcaattgagaagagcgctaaggttggattggctctagcattgaagccttgaaaaactttaccatgatcttggcacagaaataagtttggttaaagacttaatgttgattttccaattgaggacttactgccatgcaaaaaatttccattggttttggtcttgttaacaatggataagttgctgtttaagcagacttattttttaatcgggttgattattatcttgaaaacttttaaaagcgaagaatctacgggtataaatgagacaggaatgtgtttgat

SEQ ID NO: 1703 - DNA, 1061 bp, Cajanus cajan
ttttccttcttcttctctcgctttttccgcttcagttttctccgaataatcatggtgaaaggtccaggtctctacactgatatcggcaagagagctcgagatcttttgttcaaggattaccagaatgaccacaagttcaccatcaccacttacacttctaccggagtggaaattacttcgactggagtcaggaagggtgagatatatttggctgatgtcagcactaagctgaagaacaagaacatcacaactgatgtcaaagttgacactaactctaacctacgtacaactgttactgtggatgaacctgcacctggactgaagacaatttttagctttatttttccggatcagaaatctggcaaggtggaactccagtaccagcatgagtatgctggaatcagcaccagcattggattgacagcaaatccaattgttaacttctctggtgttgttggaaataatttggtctctgttgggacagatctttcatttgatactgcctctggcaactttaccaaatacaatgcagggcttaacattagtcatgctgacctcattgcttctctaactctaaatgataaaggtgacaccctaaatgcctcgtattaccacattgtaagcccgctgactaacactgctgttggtgcggagctttcacatagcttttctagcaatgaaaatcttctcaccattggtacacagcatgctctggacccactaacactcttgaaagctcgggtgaacagctatggtagggcaagtgctctgatccagcatgactggactccaagagctcgtttctctcttgttggcgaggtggataccggggccattggaaagagtgcaaaggttggtcttgctgtggccttgaaaccttaggccgggtggcattgtgagtgatataggccacacctcatgtggtggagttaataagtttagttgtagggtttcactttcccaaagaacctttgtccttcattttgatgctacatttatttcttcatctcttggtggctcgagtgtaaaatcaataagcgcaaacaattataaatctgtac

SEQ ID NO: 1704 - DNA, 1252 bp, Capsicum annuum
gcacgaggccaagtctttgataaacaccgattctctttctctctctaaaaccttctctttcctcttctgcagtttgattttttgtgtgcagaaatggtgaagggtcctggactttactccgatatcggcaaaaaagctagagatcttctgtacagggactatgtcagtgaccacaagttcaccgttactacgtacagcacaaccggagtggctatcacctcatctggtctgaagaagggtgaattattcttggcagatgttagcacccagttgaagaacaagaacattaccactgatgtaaaagtggacaccaattccaatgtctacactaccatcactgttgatgaacctgcaccagggctcaagacaattgtcagctttgtcataccagatcagaaatctggaaaggtagagctccagtacttgcatgagtatgccgggatcaacactagcattggactcacagcaagtcctcttgtcaacttctcaggcgttgctggcaacaataccgttgctttgggcactgatctatcatttgacactgccacaggcaatttcacaaaatgcaatgctggtctgagtttttgtactgctgatctgattgcttccttagcattgaatgacaagggtgataccatcagtgcttcctactaccacacggtgaagccagtgacaaatacagctgttggtgcagagttgactcacagcttctcaggcaacgagaacacactgaccattggaacacagcatttgttggacccattgaccacggtgaaggctcgcgttaacagctatggtaaggcaagtgctctcatccaacacgagtggcgaccaaaatccctcttcacaatatctggtgaagtggacaccagggcaattgaaaagagcgccaagattgggttggctgtagccctcaagccatgagtctgttagtaccttacagaaatgtgagtgaaacggtgtctgttttgtatgatccagagtaataaattagatagatttgcttcagcgcattatccttttgcgccagggagaataatcttcagctggtaatgcaaactcatgattttttgcttatatgcatccttagtgttcattgaggcacaggttttaaccttttacccgagcttcctcattcacgtaattgattaatctttctttgatcattatttattgtatgaatattctgacattgtgttgttagatgagtataaaaggctcttgaaagagagctgcctgcctttcttctaaa

SEQ ID NO: 1705 - DNA, 1329 bp, Quercus alba
attcccgggatacagtgtagaaagaaataaagagagagcgattcccttttccacttcttcgttgtttttgtgcttttcggatccccattttcgcttagccatggccaagggtcctggtctctactctgaaatcggcaagaaaacccgagatcttctctacaaggattaccaagccgaccacaagttcaccatcactacctactcccccactggagttgctatcacttcatcaggaacaaagaaaggtgagctgtttctagctgatgttaacacccaactgaagaacaaaaacatcacaactgatgtcaaagtggacacaaactccaatcttttcacaactattacaattgatgaacctgctcctgggctgaagacaatctttagcttcagagttcctgatcaaaggtctggcaaggtggaactccagtacttgcatgactatgcagcgataagcaccagtgttggtttgactgcaaaccctgttgttaacttctcaggtgttataggaactaatcttgttggacttggcaccgatctctcttttgacacaaagactgggaatttcactaaagtcaatactggattgagcttctccaatgcagacctaattgctgccttgaccgtgaatgacaaaggtgataccctgaatgcgtcctattaccacacagtgaaccctttgacaaagacagctgttggtgctgaggtatcccatagtttttcaaccaatgagaataccatcactgttggcacccagcatgcgttagatccattgaccacagtgaaggcacgagttaacaactttggcaaggctagtgctctcatccagcatgagtggcgtcctaagtcattgttcaccatttctggagaggtagacacccgagccattgagaagagtgctaaggttggactggctttggctctcaagccatgagtatccttccctttatgttgcggagcattaaggtaggtattaagagcttagtttagttgtctttttggaaaaagagtgcttatgatggtgacatcaactttatattttggtggtttgtaaaataaattttagatggttcacaaacccatgttacaattttattgagttcccacattctcgccatgctcttggtaaaactggggatgaatagcccatgaagaggtggacttctgagattttgttctaattccttgatggttttttcttggctatttccttttttcctttacggtatttctggctcttatggatgtcttggtaattgaagtttgtttcaattttcatgggcttaaaaaaaaaaaaaagttaattaatcgcgatctagaacctcgcgatat

SEQ ID NO: 1706 - DNA, 1488 bp, Arachis hypogaea
gaacactttacacgctacacagattttccctcattttttttctttttctcataaatcttagtttctatttttccggggaaaaacatggtgaatggtccaggtctctactccgatatcggaaagaaagctcgagagcttctgttcaaggattatcagaacgaccacaagttcactatcaccacttacacttccactggagtggaaatcacttcaactggaatcaggaagggtgagatatatttggcagatgtcaacactaagctgaagaacaagaacatcacaaccgatattaaagttgactcgaattcaaatctgcttactactgttaccgtggatgaacccgcacctggactcaaatccatttttagcttcattttcccagatcagaaatctggcaaggttgaactccagtaccggcacgagtatgctggaataagcaccagccttggattgacagcaactcccattgttaacttctctggtgtggtcggaaatgatttggttgctgttgggactgatctttcattcgatactgcctctggaaactttatcaaatataatgcagggctaaacttcactcatgctgaccttattgcgtccctaaccgtaaatgataagggtgacaccgtcaatgcatcatactatcatgttgtaagcccgttgacaaacactgctgttggtgccgagctttctcacagcttttctagcaatgaaaacatgctgactattggcacacagcatgcacttgaccccctaacattggtgaaagctcgggtgaacaactatggcagggccaatgctgtgatccagcatgattggaatccaagaacccgggtctctctctcaggtgaagtggataccggggcaattgagaagagtgcaaaggttggtcttgccgtggccttgaagccttagagcctagtttggttctgcgatttcatcgattgtgtctctcattgtggaggcaataagtttagtggtagggattcactttcccaatgaacatttagtccttcattttggagttcttgattatcgttacatatcttggtgggcttgggatgtaaaaataattataaacaaattttaaatttgcctgtattttattcaacgaatcaacacggaaggcattgattgattcacctttgagttgtttttgaacttgaaaggtgatagtttctgtaaatcagattcttgttcagtgtatatcgaaaatttaacgcagaggacagtagtaaatgcatctagtttttggttatattgacaatcataatactcgtgacaaaagcttgtaacaccccagctttgttgaatctctgtttgctcgctaactggatacctaatattgtagatttagtaacaacgatggtctaaaaccataatagaatttataccattagattatcttgataaataatccaattaattgaattaacaatgcaagatcttgcccataataatctgcattttaaaagggaaactcctttt

SEQ ID NO: 1707 - DNA, 1143 bp, Persea americana
aaaaaacttcttctgctcgtccttccttttgctgtgttttaccccacaagcagaaagaaagatggcaaagggtccaggcctctacttcgatatcggaaaaaaggcgagagatcttctttacaaggactaccagtgcgatcagaagttcaccctcaccacctacacatctactggcgtcgcaattacttcaacgggcattaagaaaggtgaattgtttttggctgacatcaatacacagctgaagaacaagaacatcacgaccgacatcaaagtagatactaattccaatctttttacaaccatcacggttgatgaacctgcgcctggactcaagacaatttttagcttcattgttccagaccaaaggtctggtaaggttgaactccagtacttgcatgactatgcagggatcaatacaagcattggtttgactgcaaaccctgtcgttaatttctctggtgtaattggtagcggtgctgtcgccctaggagctgatgtcgcttttgatactgcaaccggaaatttcaccaagtataatgcggggtttaacttcaccaatgccgacctcattacttccttgactctgaatgacaagggggacaccttgcgtgcttcctactaccatacagttagccccctgacgaacagtgcagtagtgcagagctgtcccacagcttctcaagtaatgacaataccctcaccatcgggacccagcatgcattggatccattgacattggtgaaggcccgcctcaacaactatggcaaggttagtgccctcattcagcacgcatggaggcccaagtcccttatcaccatctcgggagaggtagacaccagggccattgagaagagcgctaaggttggcttggccttggctctgaagccttagattttacgaggtgagtggacagtggagacatagaactgcttccatccattctacaatggtgtggaatgcaataaggtaagactagactggaaaccagtagcttgtctatttttgatttttgagtaatcattaggattctccttgttttggttgatggcggtctgtaaaaataattctggcctctggctgggaccagagaactattattcaaaaacaattcatccccattttccctgaggatcaattatggtt

SEQ ID NO: 1708 - DNA, 1179 bp, Ipomoea nil
ggcctcccctctctctctctctctctctctagaatcgaagaacttttctcctccgtcgcttctctctctacagctccggtgttaactgccagaaggcgagatggtgaagggtcccggtctctactccgacatcggcaaaaaagccaaagatcttctctacagggactacgtcgccgaccacaagtttaccatcaccacttactccgccaccggagtggccattacttcgtctggtgttaagaaaggcgaattacttgtagctgatgtcaacacacagctgaagaataaaaatatcacaacagacctaaaagtggacaccaattccaaactttacacaacaatcactgttgatgaaccagcaccagggctgaagacaatcattagtttcgttgctccagaccagaaatctggcaaggtagagctccagtacttgcatgagtatgctggaatcagtactagcattggactaactgccagtccccttgtcagcttctctggtgttgctgggaacaatactcttgccctcgggactgatgtctcatttgacactgccaccgggaagttcaccaaatacaatgctggattgagtttctctacctctgacttgatagcttctttaacattgaatgacaagggtgacttcctcggtgcttcctactaccacactgtacgaccgttgacaaatacagctgttggtgcggagttgactcacagcttctcaagcaatgagaatactcttaccattgggacacaacacaaattggatccagcaaccacggtgaaggccaaggttaacaactttggcaaggcacacgctctcatccaacatgagtggcgtccaaaatcactcttcaccatctccggtgaagtggacaccagggcaatcgagaagagtgccaagattgggctggctgttgccctcaagccatgattagtttacgcacactaccatgtggtgaagttagtggagatggtgatattttgtttggtgcagagcaataaatttaggtagaaccttcctccaattacctttttgttcaccggaaaaaaacccgagttttatcttgcaatgatggttttcgtacatgatactgtagaaaataatctttcattcgctggtgtcaatgccagtgtgagaacttcccaattctttttgatctatctatccagatgtcacac

SEQ ID NO: 1709 - DNA, 1100 bp, Lactuca sativa
ccaatttctcgagcacgaagaacagaagagatggggaaaggtccaggtctctaccccgatatcgggaaaaaagccagagatcttctttacagggattaccagggcgaccataagttttctctcacaacatataccgccaacggagtttcaatcacctcatcaggagctaagaaaggcgagttgtttttggctgatgtgaacacaaaactcatcaacaaaaacatcacaaccgatgtcaaagtggacacaaactctaaggttttcaccaccatcaccattgatgaagctgcacctggactcaaaacaatcttcagctttgttgttcctgatcagagatctggcaaggtggaacttcaatacttgcacgaacatgcaggaatcagtacaagcatcggtttgaccgcaagtcccatagtcaacttctctggcgtggctggaaacaacacggttgcagtcgggaccgatatttccttcgacactgcttccggaaacttcaccaaatacaatgcgggactcagtttctcaacttctgacctcattgcatctttgacactgaatgataaaggggacacgattactgcttcctactaccacactgtaagtccgttgactaatacggctgtgggtggtgagttgactcatgggttttcgagtaatgaaaactcgttgacttttgggacacagcactcgttggacccgttgactatggtcaaggctcgggtcaataattttggaattgcaagtggtcttcttcagcatgaatggcgcccgaaatcggtttttactatctcgggggaagtggatacaagggctattgaaaagagtgctaaggttggtttggctcttgctttcaagccttgaattttggaaatgaagatgggattcacccgaaacaatacttgtgtctagttttcatgatattttggtatgttggtttttgtatgggtgaagataaataatgtaggtaggtaggtaggtgacttttgaaaactgttttttttttttggggactatgccaaagtctaaattcaaaaactcgatttggtccgataggttggaccgaataatcatgttattcatgacgtggtaccataatttta

SEQ ID NO: 1710 - DNA, 1174 bp, Tropaeolum majus
cggccgggttatttacggccggggggaaaagtagttgggaagaataagaactctcattttctatcattttctcgggaaaaaatcatgggaaaaggccctggtctatactccgacatcgggaagatagctagagatcttctctacagggattaccaaaatgaccataagtttacgctcacaacttacactagcaacggagttggcataactaccaacgggattaagaagggtgagctgttattggctgatttgagcactcagttgaaaacaaaaatatcactactgatgtgaaagtggacactaactctaatctttttaccacttttactatcgatgaacctgctcctggattaaaaacaatatttagctttattgttccggatcagagatctggaaaggtagaacttcagtaccaacatgagtatgctggaataagcactagcattgggttgaccgcaagtcctttagttaacttctctggtgttgttggaaacaatgttctctctgttgggactgatctttcctttgatacagcatctggaaactttaccaaatacaatgctgggttgagttacattaatgctgacctcataacatccttggcactgaacgataaggcagacacccttacggcttcatactaccacattgtaagcccattgagcggcaccgctgttggtgctgagctgagtcatagcttttcaagcaatgaaaacattatgacaatcggtacccaacattcacttgaccacaagaccaacgtgaaagctcgggtgaacaactttggtagagctagtgcgctcatccaacatgcttggcgtccgaggtcacttataaccttttcgggagaagtggacaccagagcaattgaaaagagcgctaagtttggacttgctgtggcacttaagccatagattagcaagtagtgctgattttgaattgcggggagcaataatgtagatagaatgatgtcaattctattttttttccattgaacttttcattcttccgatgttgtttcaccggtttaccatattttggtggtggctacaggctgtaaaaataattaaaggtggtggcatgaacaaggccattgattactctgtttggaacctttcttgcttagccttgccctgtaaatgggtctaatttaaatatattgcatttggatttt

SEQ ID NO: 1711 - DNA, 1295 bp, Fragaria vesca
ctccttcttctctctctgcagctctaaaccctctccccctccccagtttctctttcattttcctcagacaaacatggtgaagggtcccggtctctactccgatatcggcaagaaagccagagatcttctttacagggattaccagaccgaccacaagttcaccgtcaccactctcaccgcttctggagttgcgattacctcgagtggaattaagaaaggtgatcttcttttgggggacgtcagcactcagctcaagaacaagaacatcactactgatgttaaagttgataccaattcaaatcttctcgcaactattactgttgacgagcctgcacctggtctcaaggcaatcttgagtttcattgtacctgatcagaaatctgcgagggtagaacttcaataccagcatgagtatgctggaataagcactagccttggattgactgcgaatcctgttattaacttttctggtgttgttgggaacgctgccctatctcttggaacagatgtttcatttgacactgcctctgggaacttgaccaaactcaatgctgggttgaatttcatccataccgacctcattgcctccttgcttgtgaatgacaagggtgataccctcactgcttcctactaccagactgtcagccctattacttgcactgccgttggtgcggagctgtctcacagcttttccagcaacgagaacaccttcaccattggcactcagcatgcacttgaccccctaacctcagtgaaggctcgggtgaacaactatggcagggcaagcgctctcatccagcacgagtggcgtcccaagtctttgtttactatctcaggagaggttgacacaagggcaatcgagaagagtgcaaagatcggtctggccttggcactgaagccatgagctaagcaactatcaggtgcaaatggaaaggtgggttttgattttgcatggtagagggcaataagctaggttgtagaataggagggaatttgtcatgaactcgtggtcctttactgtggtgctattggtttctcatatcttggtggtaatgggttgtaaaaaataattggcacgaacctgatgtcaaattcctttcgtattttccacccacctcaatgctagtggggggtgtagccttaaaccgagtttaaatgagtttctttccatctaatgtattcccatggttctgccgtatatctggatatctgatatttcgaacagggaggcgatgataatacatttactcaaaggcctattgtattccacaaaacaattctaaacgaatcaaaag

SEQ ID NO: 1712 - DNA, 1184 bp, Fragaria vesca
acgaggaaaccctctccccctccccagtttctctttcattttcctcagacaaacatggtgaagggtcccggtctctactccgatatcggcaagaaagccagagatcttctttacagggattaccagaccgaccacaagttcaccgtcaccactctcaccgcttctggagttgcgattacctcgagtggaattaagaaaggtgatcttcttttgggggacgtcagcactcagctcaagaacaagaacatcactactgatgttaaagttgataccaattcaaatcttctcgcaactattactgttgacgagcctgcacctggtctcaaggcaatcttgagtttcattgtacctgatcagaaatctgcgagggtagaacttcaataccagcatgagtatgctggaataagcactagccttggattgactgcgaatcctgttattaacttttctggtgttgttgggaacgctgccctatctcttggaacagatgtttcatttgacactgcctctgggaacttgaccaaactcaatgctgggttgaatttcatccataccgacctcattgcctccttgcttgtgaatgacaagggtgataccctcactgcttcctactaccagactgtcagccctattacttgcactgccgttggtgcggagctgtctcacagcttttccagcaacgagaacaccttcaccattggcactcagcatgcacttgaccccctaacctcagtgaaggctcgggtgaacaactatggcagggcaagcgctctcatccagcacgagtggcgtcccaagtctttgtttactatctcaggagaggttgacacaagggcaatcgagaagagtgcaaagatcggtctggccttggcactgaagccatgagctaagcaactatcaggtgcaaatggaaaggtgggttttgattttgcatggtagagggcaataagctaggttgtagaataggagggaatttgtcatgaactcgtggtcctttactgtggtgctattggtttctcatatcttggtggtaatgggttgtaaaaaataattggcacgaacctgatgtcaaattcctttcgtattttccacccacctcaatgctagtggggggtgtagccttaaaccgagtttaaatgagtttctttccatctaatgtattcccatggttctgccctcgtgcc

SEQ ID NO: 1713 - DNA, 1090 bp, Senecio madagascariensis
cgattcagttcaaaaaacacacacacacacacacacagcgatggcgaaaggaccaggtctctatcctgatatcggcaaaaaagccagagatcttctatacagagattaccagagcgatcataagttttctctcacaacctttaccgctaacggagtttcaattacttcttcaggagctaagaaaggtgactttttcttggctgatgtcaacacaaaactagtcaacaaaaacatcacaactgatgtccgagtggacacaagctcgaaggttttcacaaccatcactgttgatgagccagcacctggactgaagaccatcttcagctttgttgttcctgatcagaaatcgggcaaggttgaacttcaatacttgcacgagaatgcaggaatcagcaccagcattggtttgaccgctagcccaatagtcaacttctctggtgtggctgggaacaacgcagttgcacttgggaccgacatttcctttgatactgctactgggaacttcaccaagtataatgcaggcctcagtttctcgacatctgatctcattgcatccttgacactgaacgataaagccgacacccttgttgcttcctactaccacacagtaagcccactaaccaacaccgcagtaggtgcagagttgacccacggtttttcaagcaacgagaactctttgaccattggaacacagcactctctagacccattgaccacagtcaaggcccgagtgaacaactttggcatagcaagcgctcttcttcagcacgaatggcgcccaaaatccctcttcactatctcaggagaagttgacaccagggcaattgaaaagagtgcaaaagttggtctcgctcttgccctcaagccttgaataaaactcgccaaaaatgttcttttttcttttgtgacatttgacgttttatcgtttgtatcgatgaagagaaataaggtaggtagttgactttggagtttggaaagagtatttgctctttgattttcccattttaatggtggttgcggtttttgtgcatggtttacttacacttttcgaaaaaaaaaaaaccaaaagttggtaggtcatcatcatttt

SEQ ID NO: 1714 - DNA, 1165 bp, Helianthus annuus
cgcagactacgcggggactcagaaacacgcacatgctaaccactcccctccgactcgatttatcatctctgaaatccacacataagacgatcatctctctcggaagcttctcgaacatacgctgagatggtgaaaggtccaggtctctacaccgatatcggcaagaaagccagagatcttctgtacaaggattaccagagcgaccataagtttactctcactacctatgcagccaatggagttgccattacctcatcaggagctaagaaaggcgagttgtttttggcagatgtcagcactaaactgatcaacaaaaacatcacaactgatgtcaaagttgacacaaactcaaaattattcacaactatcacaattgatgaacccgcacctggagtgaaatccatcttcagctttgttgttcctgatcagagatctggcaaggttgaacttcaatacttgcaagagtatgcaggaatcagtaccagcattggtttgaccgctagccctgtggtcaacttctccggggtagccggaaacgacacattggcactcgggaccgatgtttcatttgatactgctactggcaatttcactaagtataatggagccctaagtttcaccacttctgacctcattgcttctttgatactgagcgataaagcggacaccctaactgcttcctactaccacacagttagcccattgaccaacaccgcagtcggtgcagagttaagccatggattttcaagcaacgagaacactttaacaatcgggacacaacattcacttgacccattgaccacagtgaaggctcgggtcaacaacgctggcatagcaagtgctcttttgcagcatgaatggcggccgaaatcgttggttactatatcaggagaggtggacactagggcaattgataagagtgcgaaggttgggctggctctagcgttaaagccttgaacggtaaaacaaattttctatgattttgacacaagaaaaataaggtgggttgatgttcccattgacattgttgtgagtttttaaatgatgtgaaggctgttaaggacttacctgccatgtttattttgtcttgcaaaagttttcattgctggttaagcagatgcttattgagatcatttgtataatgcaacacaaattatataggttt

SEQ ID NO: 1715 - DNA, 1115 bp, Helianthus annuus
  misc_feature (920)..(920): n is a, c, g, or t
  misc_feature (924)..(924): n is a, c, g, or t
  misc_feature (931)..(931): n is a, c, g, or t
  misc_feature (935)..(935): n is a, c, g, or t
  misc_feature (959)..(959): n is a, c, g, or t
  misc_feature (983)..(983): n is a, c, g, or t
  misc_feature (992)..(992): n is a, c, g, or t
  misc_feature (1049)..(1049): n is a, c, g, or t
cgggggatcgatttatcatctctgaatccacacagaagacgatcatctctctcggaagcttctcgaacatacgcagagatggtgaaaggtccaggtctctacaccgatatcggcaagaaagccagagatcttctgtacaaggattaccagagcgaccataagtttactctcactacctatgcagccaatggagttgccattacctcatcaggagctaagaaaggcgagttgtttttggcagatgtcagcactaaactgatcaacaaaaacatcacaactgatgtcaaagttgacacaaactcaaaattattcacaactatcacaattgatgaacccgcacctggagtgaaatccatcttcagctttgttgttcctgatcagagatctggcaaggttgaacttcaatacttgcaagagtatgcaggaatcagtaccagcattggtttgaccgctagccctgtggtcaacttctccggggtagccggaaacgacacattggcactcgggaccgatgtttcatttgatactgctactggcaatttcaccaagtataatggagccctaagtttcaccacttctgacctcattgcttctttgatactgagcgataaagcagacaccctaactgcttcctactaccacacagttagcccattgaccaacacagcagtcggtgcagagttaagccatggattttcaagcaacgagaacactttaacaatcgggacacaacattcacttgacccattgaccacagtgaaggctcgggtcaacaacgctggcatagcaagtgctcttttgcagcatgaatggcgcccgaaatcgttggttactatatcaggagaggtggacactagggcaattgataagagtgcgaaggttgggctggctctagcgttaaagccttgaacggtaaaacnaatnttctatnattntgacacaagaaaaataaggtgggntgatgttcccattgacattgttgngagtttttnaatgatgtgaaggacttacctgccatgtttattttgtcttgcaaaagttttcattgntggttaagcagatgcttattgaattggctttataaattttcaagggttttccaaattcataggttc

SEQ ID NO: 1716 - DNA, 1259 bp, Solanum phureja
tgtttctacttaaagggtagccttttcacttattcccatactcactcatctttctagatctttaagacagaagaatggctcaagcaacacctaatcacacacaaactgttgctggttgggcagctcatgattcttctggaaaaatcacaccttttaacttcaagagaagagaaaatggtgagaatgatgtgaccattgagatcttgtattgtggaatctgtcatacggatattcatcatgtcaaggatgactggggcattactaagtaccctgttgtgcctgggcatgaaattactgggattataacaaaggtgggtagcaatgtgagtaaattcaagatgggagacagagtaggggtaggttgcttggccgcaacatgtttgaaatgtgagtattgcgaggagtctcaagagaactactgtgaccaagtagaattcacttacaatggcatcttttgggatggtagcattacttatggtggctactcaaaaatgcttgttgctgatcataggtacgtggtacgtataccagataacatggcaatggacagagcagcaccattattatgtgcaggaataacagtttttactcctttgaaagacaataatttggtggatacaaaaggtaaaaaaataggaataataggtcttggtggacttggacatgtagctgtcaaatttggaaaagcatttggacatcatgtgactgtcattagcacctctccaatcaaagaacaagaagccaaagacaacttaggtgctgatgattttataataagcactaatcccaaacaaatgctggaaaagaaaagaaccctagactttattttggatacagtgtcagccaaacactcacttgggagttacttagagctcttaaaagtgaatggaactctagtgattgttggagcaccagataagccaattgatttgcccgctttccctatgatatttggaaaaagaacagtgaaaggaagcatgataggaagtatagaagagacacaagaaatgatggacttatgtggaaaacataacatattgagtgatatagagattatcactactgatcaaattaatgaaggacttgaaaggcttgctaaaaatgatgttaagtaccgttttgtcattgacattgctggtccatcttctcatctttaaaatttatttatttatttttgtatgtgtaatttacttttcatttcatttcaataacctgaatttgtatttcttaatattatgatgttgtttatttacactttg

SEQ ID NO: 1717 - DNA, 1339 bp, Capsicum annuum
gcacgaggcccaactcccataataaaggccaaacattattctggatctcttagacggatcaatggctcaaacagcacctaatcacacgcaaactgtttatggttgggcagctcatgattcttctggaaaaatcacaccttttatcttcaagagaagagaaaatggtgagaatgatgtgaccattgagatcttgtattgtgggatgtgtcatacggatgttcatcatgtcaaggatgattggggcattacggtgtaccctgttgtgcctgggcatgaaattactggcattataacaaaggtgggaagcaaggtgaggaaattccagataggggacaaagtaggggtaggtggcttagcggcaacatgtttgaagtgcgaatattgcgagaactctcaagagaactattgtgatcaagtccaatgcacttacaacggcatcttttgggatggcagcatcacttatggtggctactctaaaatgcttgtggctgatcataggtacgtggtacgcataccagataacatggcaatggatagagcagccccattgttgtgtgcaggaataacagtatatactcctttgaaagacaataacttggtggatacaaaaggtaaaaaaataggagtgataggtcttggtggacttgggcatgtggccgtgaaatttgggaaagcatttggacatcatgttactgtcattagcacctctccatccaaagaacaagaagccaaagaaaccttaggtgctgatgattttatattaagcactaatcccaaacgaatgcaggcaaagaaaaggacactagacttcattttggatacagtgtcagccaaacactcacttgggagttacttagagctgctaaaagtaaatggaactctagtgattgttggagcaccacataagcctattgatttgcccgctttcccaatgatttttgggaagagaatagtgaaaggaagtatgataggaagcatagaagagacgcaagaaatgatggacttatgtgggaaacataacattttgagtgacattgagattatcactactgatcaaattaatgaaggacttgataggctcgtaaacaatgatgttaagtaccgctttgtcatcgacattgctggcggtcaatcttctcaactttaaattatggaaaaatccttctggccacataaattatattgcttctatatatatctattgttttaattctcgctgttttcttttttttttttcgtgattcacatttcatttaaatccaatttcctgaacttgtattcattactactatgaaattgcttatttatttacctaaataatatacaagttgcatttttc

SEQ ID NO: 1718 - DNA, 1287 bp, Nicotiana tabacum
  misc_feature (314)..(314): n is a, c, g, or t
  misc_feature (320)..(320): n is a, c, g, or t
  misc_feature (359)..(359): n is a, c, g, or t
  misc_feature (368)..(368): n is a, c, g, or t
  misc_feature (380)..(380): n is a, c, g, or t
  misc_feature (383)..(383): n is a, c, g, or t
  misc_feature (401)..(401): n is a, c, g, or t
  misc_feature (481)..(481): n is a, c, g, or t
  misc_feature (564)..(564): n is a, c, g, or t
  misc_feature (589)..(589): n is a, c, g, or t
  misc_feature (591)..(592): n is a, c, g, or t
  misc_feature (596)..(596): n is a, c, g, or t
  misc_feature (610)..(610): n is a, c, g, or t
  misc_feature (855)..(855): n is a, c, g, or t
atgcggccgctcacacacaaagtgtttctggttgggcagctcatgattcttctggcaagatcacaccttttaccttcaagaggagagaaaatggtgagaatgatgtgagcattaggatcttgtattgtggcatgtgtcatacggatcttcatcatgtgaagaacgattggggcattactatgtaccctgtcgtgcctgggcatgagataactgggattataacaaaagtgggaagcaatgtgacaaaattcaagaatggagatagagtaggggtaggttgtttggcagcaacatgtttgaagtgtgagtattgnaaggantcccaagagaactattgtgaccaagtccaattcacttanaatggcatnttttgggatggnacnatcacttatggtggctantccaatatgttagttgctgatcacaggtacgtggtacgtataccagataatttggcaatggatagagcagcaccattacnttgcgcaggaataacagtttatactccactgaaagacaataatttggtggaaacacaaggtaaaaaaataggagttattggtntaggtggacttggacatgtcgctgngnnattngggaaagcatttgnacatcatgttactgtcattagtacatctccctcaaaagaacaagaagctaaacataacttaggtgctgatgattttatactgagcactaatcctaaacaaatccaggcaaggaaaaggtctctagacttcattttggatacagtggcagccaaacactcacttgggatttacttagagcttctaaaagtaaaaggaactctagtgattgttggagcaccagataagccaattgatttgcctgctnttcctatgatttttgggaagagaactgtgaaaggaagcatgataggaagcatagaagagacacaagaaatgatggatttatgtggaaagtataacatcttgagtgacatagagattatcaccactgatcaaatcaatgaaggacttgatagacttgcacaaaatgatgttaaataccgttttgtcattgacattgctggccaatcatctaatcgttagggtcatttaagacatattttcgctacataattacatcattttcatagttttttaacccgatttttaatccaattccgtgaacttgtatttcttattatgagaagtatttcttattgataacagctttgttagatggttgttacgtatcgtttcataatgtatcgtatcttattgtatagtattgtactgtattgtttgataaatataatgtttg

SEQ ID NO: 1719 - DNA, 2217 bp, Mimulus guttatus
atattggctccataagcaataagagagctctcatctttatttaaattcgatcccacatttgtttttgttatgcatatgaaacacacgggcataaagaaattggatgtaatgcattattgtgcaaaataaaataaaatgaagagcaaattacaaagatcagtaaggcctaattacgaaagaaagaaaaaaaattgtccatgtttgtaaaatcaggagcaccacccgtaaaatattctacgtctaacgaatttaccctcacagagttaacaatcatagaatcaaatagattccatggaatatccattttttaatgaccaaaatacccttccgagtctaattagaatttttttgcggcacgtagtttcagagaggtgctcgtaattatgcaaccaaggacgaatggaatcatttagtaattaggcaattacccgaggaatctttgtaatttgccctaaaaaaaaaaaaagagtataaaagttgtacaaaatgtggggccatttatagtaaatttcccggagggatgaagcggttggtaggtatgaataataactatattcacagttgaattgctgggaaattaaatcgaatatcaccaaaccctagcaactccagcgattaattgctagcagattaagtaacggtttccgttataaatttattttcaattttcattgttatttcgacgaaagttttcaaagtcttcgacgattttgttagtcaatgtgaataatttgaatttgccaaaaaaaaaaaaaaggaaaaaaaactttaatttaacctccgacccccactcccactagagcacctctagctagtgctataaatacagtgtgtgtattcaattgtttccatcatttctatcactactccattagcttttacattccaactttccctatttgaagagagagagagatctagagagagaaagagagagagatctagagagagagagagagatggctcagacaacaccgaaccacacacagacggtttccggctgggcagctcacgacacttccggcaacattactccttacaccttcaaacgcagagaaaacggggtcgatgacgtcaccataaaaatcctgtactgcgggatctgccacaccgatctccaccaggccaaaaacgattggggaatcaccatgtaccccgtagttcccgggcacgaaatcgtcgggataataacgaaagtggggagcaacgtgaagaatttcacggtgggagatcgcgccggagttgggtgcttggccgccacctgcttgaaatgcgagcactgcatacaaggacaagagaattactgcgacgccgttcagttcgtgtataacggcgttttctgggacggcagcatcacttacggcggctattctgaatccctagttgcagatcacaggtatgtggtacgagttccggagaatttaccgatggatgcggcggcgccgctgctctgtgccggaataacggtgtttgctccgatgaaggacaacaacttgttggattcgccgggaaagaggatcgggatagttgggcttggaggattgggacacgtggcggtcaaattcgcgaaggcgtttgggcaccacgtcaccattattagcacctctccatctaaagagaaggaagccaaggataatttgggggctgatgattttattctcagcactgatcctaaacaaatgctgttgaagaaaaggaatctggattttatattggatacagtatcggcccatcactctcttgggcctattctcgagctgttgaaagtcaacggtactctggtgattgtcggtgcgccggataaacccatagacctcccatctttcccgttgatctttgggaagagagttgtgaaggggagtatgattggaagcataaaggagacgcaggatatgatggatttgtgtgggaagcacaacataacatgcgatattgaggttgttaaacccgataaaattaacgaagcgcttcttcgtctcgcgaaaaacgacgttaagtaccgttttgtgatcgacattgcaggcgaatcttcaaagctctagaaaacttcagatgatttttaatttattgctcctattgtctacattgagttataagtaatgttgtaacatttgtgtaatatcttgtttatttgtactctctgattatgtacttttgatcatattattattaataagctttaaattatatttgaaagagaagaaaaaatcaagagtt

SEQ ID NO: 1720 - DNA, 3314 bp, Zea mays
catcaccatacctcttcatctcgctcgctgtcactccgctctgcgcgcttgggtcatgcgtgactcacacctacgcattctgtgagttcggaatcagatccgatagagttcccagagttagagttagctcgggtacagtccgtcggttgcctcaaagcttatcccggcatcccgcggaatctcgctttgcgatgaaaccatagctccacccaattcttgcggcttcagagaaccagcgctccctgccgtcgctgtccctcgttctcccagcgcctctcattcagtcatccctcctctccgaactgaccgatgcggttggtgccaaggttccggccctctaatgctgcttgaactccagccttctaatgggcgcggctcagttggtgattctgttcttggcccttgccactgcggtgggggcgccgccgagcgaggtggccgtgggcgctctcttcacgtacgactccacgattggccgcgcagcgaagctcgccatcgagctcgccgtcgatgacgtcaactcggacggcaaggtcctcccgagaacccaactcaatttggtgccccaggataccaactgcagcggatttcttgggaccatcgaagcgttgcagctaatggaaaaaaatgttgttgcgctgattggcccacaatcctctgggataggccatgtcatctcccatgttgttaatgagctacatgtacctcttctatcatttgcggctacagatccaactctttctgcatcagagtatccgtacttcatcaggacaaccataagtgactacttccaaatgaatgctattgctagcattgttgattattatcaatggaaaagggtgactgctatattcgttgatgatgattatgggcgaggtggtgtagaagccctcggtgatgcgcttgcattaaagagggcaaagatttcatataaagcagctattcctccaaattcaaatacagacgtgatcaacgatgtactatttaaagcaaatatgatggaatcaagggtcatgattgtgcatgtcaatcctgacacagggatgaggattttttctgtagctaagaacctgcaaatgatggccagtggctatgtctggatagtaactgattggctagctgctgtccttgattcctcagcaaatagaggtcttaaagatatgagtcatattcagggactaattgttctgcgtcagcacattcctgaatctgaagccaaggataagttcatatctaaatggaataatgtggctcataacagaaatattacttctggcttgaactcgtatggtttttatgcttatgactcggtttgggctgttgctcgtgctgtcgataaatttctcagtaatgggcaacagatcaacttctcaacagatcccaggttagaagattcaaatggcagcacgttgcacctatcaagtctcaagatatttgacggtggtgagcagatgctgcatcaacttctcctcacaaactttacgggtgtaacaggtccagtccagtttgattcagagcacaatttggtacgcccagcgtatgatatccttaatgttgttggttctggctcccgcttgattggctattggtctaactattctgggctttccgtggctgctcctgaaactttgtatcagatgccacgaaatacatctacaagtgcccagcagctgcatgatgtggtatggcctggcgattccactacgaagcctaagggctgggtattcccaaacactggccttcctctgagagttggggttccaattaaagcaagctttaaggaattagtgtcaggcagaggagataacatgagtggttactgcatcgagatattcaacgcagcaattaaacttcttccttacccagttccttgccaatttataactattggtgatggcacaaaaaaccctagctatattgacataattagaatggttgctgccaattcacttgatgcagctgtaggcgactttgctatagtgagaaatggcacacagcttgcagaatacacacagccttatattgagtcagggcttgtgatagtagcgccggtgaaacatgtaacttcaagtgcgtgggctttccttgaacctttcacattggagatgtggtgtgtcacagttgctctttttattttggtgggcatagtagtgtggcttcttgaacatcgtactaatgaggaatttcgagggtctccaaggcgacaagtcataacaatgttatggtttagcttctcaacaatgttcttttcacacagagagaacactgtaagcacacttgggcggttcgtgctgataatatggttgttcgttgtgctgatcatcacttcaagttacactgctagcttgacgtcaatcctcacagtccaacagctctcaactggaattacagggattgatagtttggtttcaagttctttacctattggataccaggctggaaaatttaccaaaagatacctgactgaaaacttcaatgttcccctctctcgactggtaccactgaattcgatccaggaatatgctgatgcccttaaccgcggaccaaaaaatggcggtgttgctgcaattgttgatgagaagccatacattgatatcttcctgtcaaactactgcagcttcagaatagtgggggaggaattcacaaaggaagggtggggctttgcattccagagagactcccccctcgctgcggatttatcgacggcaatccttcaactttcagagagtgggcaacttcagaggatccacgacgagtggttctcacggtctagttgctcctcagatgacagcgaagtgggagcaaccaggcttggcctcggaagcttttggggccttttccttgtgtgtgccctgatatgcctcttcgctctgctggtgttcttcatacgagtctgccggcagtataaccagtactccagttctgaagctgccggcgagcccagcacagctgctgcggatcctgtcctaagacagcggcgaccatcacgccttggcagcttcaaagacctgatccagttcgtcgacaagaaggaggaggagattaagaaaacgatgaaacgaagatcaggcgagaaagatagccaagctgcaggattctcatacgctcagtcagtggcttcagcataggacattgctccaaccatattgaattaggttatctccaaaagcataggacattgctccaaccatattgtaaatagtagtggtgtactgtgatcagaacgaagatcagggttctcatacgctgtttgtatttgacaactgttttcggtgattggtcattgctccaagctgtgcgaagtggcttatttt

SEQ ID NO: 1721 - DNA, 2936 bp, Zea mays
gggctgggttacgtatgccaatgggcgcgcttcaggtgatgctcctccgcttggtgctgctcgccgcgtccgccgcgacgacggctgtcacggtcacggccgcgccgccgcccagtgaggtggcagtgggcgcactcttcacctacgactccaccattggccgcgccgcgcgcctcgccattgagctcgccgtcgacgacgtcaacgccgaccgcaccgtcctcgccgggacccgcctcaacttgctcgcccaggacaccaactgcagcggctttcttggcgccgtcgaagcattgcagctaatggaaagaaatgtggttgctgttattggcccacaatcctccgggataggccatgtcatctcccatgttgttaatgagctacatgtacctcttctgtcatttgcggccacagatccaactctttctgcatcggagtatccttacttcataaggacaaccataagtgactacttccaaatgaatgccgttgctagcattgttgattactatcagtggaaagaggtgacggctatattcgttgatgatgattatgggcgaggtggtgtgtcggcccttggtgatgcgcttgcagcaaaaagggcgaggatttcatataaagcagctatccctcccaattcaaatacagatgtgatcaatgatgtactgtttaaagcaaatatgatggaatcaagggtcatggttgtgcatgtcaatcctgacacagggacgagaatattttctgttgctaacaagctccagatgatggccactggctatgtctggatagtaactgattggctagctgctgtcttggattcctcgacgtcaagagatcgtaaagaaatgagtcatattcagggactaattgttctgcgccagcacactcctgaatctgttgccaagaataagttcatatcaaaatggaataatgctgctcgtaatagaagtattacttcgggcttgaactcgtatggtttctatgcttatgactcagtttgggccattgctcgtggtgtcgatcaatttctcaataatgggcagcagatcaacttttctacagatccagtattgcacgatactaatggtagtagtttgcatctatcaactctcaagatatttgatggcggtgagcagatgctacagcaacttctgctcacaaattttacaggcctaactggtcgagtccaatttaattcagatcgcaatttggtgcacccagcatatgacatccttaacatcggtggttctggctcccggttgattggctattggtccaattactcaggcctctctgttgctgcacctgaaatattgtatcagaagccaccagatacttcttcaattgctcagcggctccacaatgtggtttggccgggtgattccacaaccactcctaaagggtgggttttcccgaacaatggccagccgctgcgggttggtgtcccaatcaagccaagctttaaggaattagtggcagctggaaaaggccctgataatgtgactggttattgcattgatatattcaacgcagcaattagactgcttccttaccccgttccatgtcaattcatagcaattggggatggtagaaagaaccctaactacgacgacattattagtatggttgctgccaattcccttgatgcagctgtaggcgactttgctattgtgagaaacagaacaaagattgcagaattcacacagccttatattgagtcagggcttgtgatagtagcgccagtgaaacaagcaacttcaagtgcctgggctttcctcaaaccgttcacattggagatgtggtgtgtaactggtgctctttttatttttgtggggatagttgtctggattcttgaacatcggagtaatgaggagtttcgaggatctccacgacgacaacttataacaatattttggtttagtttctcaacaatgttcttttcacacagacagaacactgtaagcgcgctagggcggtttgtgttgatcatatggctcttcgttgtgctgatcatcaattcaagttatactgccagcttgacgtcaatcctcacagtccaacagctcgcaacaggaataactgggatcgatagtttgatttcaagtggtttacctattggatatcaggctggaaaatttaccagaaattacctgattgaagagctcaatattcctgagtctcgattggtaccactaaatacaatccaggagtatgctgatgcccttaagcgtggaccaaaagatggtggtgttgttgcaattgttgatgagatgccctatgttgagatcttcctgtcataccactgcaatttcagaatagtgggacaggagttcaccaaggagggatggggttttgcattcaagagagacttcccccttgctgcggacttgtcgacagccatccttcaactctcagagagtggtcagcttcagagaattcatgacgagtggttcacccggcctagttgctcctctgatgacagcgaagtgggggcaaccaggcttggcctcggaagcttttggggccttttcctcgtgtgtgccctgatatgcctcttggctttgctggtgtttttcatacggatatgctggcagtataacaagtactccaattctgaagctgctggtgagcccagtgcagcagcagctgctgctgcagcagtagatgctgctgctgccgccgccgatgctgtcgaaagacagaggaggccatcacgtcttggcagcttcaaagatattatacagtttgtcgacaaaaaggaggaggaaattaagaagacgatgaaacgaagagtaagtgagaaagacaataaccaagctgcaggatcctcagaagctcattcagtggcttcagcatagaacattctttccaactcctgtccttcacaaggcaaaacaaggaagcacatatacgataggaaaaagtcaaaattactt

SEQ ID NO: 1722 - DNA, 2915 bp, Zea mays
atgggcgcgcttcaggtgatgctcctccgcttggtgctgctcgccgcgtccgccgcgacgacggctgtcacggtcacggccgcgccgccgcccagtgaggtggcagtgggcgcactcttcacctacgactccaccattggccgcgccgcgcgcctcgccattgagctcgccgtcgacgacgtcaacgccgaccgcaccgtcctcgccgggacccgcctcaacttgctcgcccaggacaccaactgcagcggctttcttggcgccgtcgaagcattgcagctaatggaaagaaatgtggttgctgttattggcccacaatcctccgggataggccatgtcatctcccatgttgttaatgagctacatgtacctcttctgtcatttgcggccacagatccaactctttctgcatcggagtatccttacttcataaggacaaccataagtgactacttccaaatgaatgccgttgctagcattgttgattactatcagtggaaagaggtgacggctatattcgttgatgatgattatgggcgaggtggtgtgtcggcccttggtgatgcgcttgcagcaaaaagggcgaggatttcatataaagcagctatccctcccaattcaaatacagatgtgatcaatgatgtactgtttaaagcaaatatgatggaatcaagggtcatggttgtgcatgtcaatcctgacacagggacgagaatattttctgttgctaacaagctccagatgatggccactggctatgtctggatagtaactgattggctagctgctgtcttggattcctcgacgtcaagagatcgtaaagaaatgagtcatattcagggactaattgttctgcgccagcacactcctgaatctgttgccaagaataagttcatatcaaaatggaataatgctgctcgtaatagaagtattacttcgggcttgaactcgtatggtttctatgcttatgactcagtttgggccattgctcgtggtgtcgatcaatttctcaataatgggcagcagatcaacttttctacagatccagtattgcacgatactaatggtagtagtttgcatctatcaactctcaagatatttgatggcggtgagcagatgctacagcaacttctgctcacaaattttacaggcctaactggtcgagtccaatttaattcagatcgcaatttggtgcacccagcatatgacatccttaacatcggtggttctggctcccggttgattggctattggtccaattactcaggcctctctgttgctgcacctgaaatattgtatcagaagccaccagatacttcttcaattgctcagcggctccacaatgtggtttggccgggtgattccacaaccactcctaaagggtgggttttcccgaacaatggccagccgctgcgggttggtgtcccaatcaagccaagctttaaggaattagtggcagctggaaaaggccctgataatgtgactggttattgcattgatatattcaacgcagcaattagactgcttccttaccccgttccatgtcaattcatagcaattggggatggtagaaagaaccctaactacgacgacattattagtatggttgctgccaattcccttgatgcagctgtaggcgactttgctattgtgagaaacagaacaaagattgcagaattcacacagccttatattgagtcagggcttgtgatagtagcgccagtgaaacaagcaacttcaagtgcctgggctttcctcaaaccgttcacattggagatgtggtgtgtaactggtgctctttttatttttgtggggatagttgtctggattcttgaacatcggagtaatgaggagtttcgaggatctccacgacgacaacttataacaatattttggtttagtttctcaacaatgttcttttcacacagacagaacactgtaagcgcgctagggcggtttgtgttgatcatatggctcttcgttgtgctgatcatcaattcaagttatactgccagcttgacgtcaatcctcacagtccaacagctcgcaacaggaataactgggatcgatagtttgatttcaagtggtttacctattggatatcaggctggaaaatttaccagaaattacctgattgaagagctcaatattcctgagtctcgattggtaccactaaatacaatccaggagtatgctgatgcccttaagcgtggaccaaaagatggtggtgttgttgcaattgttgatgagatgccctatgttgagatcttcctgtcataccactgcaatttcagaatagtgggacaggagttcaccaaggagggatggggttttgcattcaagagagacttcccccttgctgcggacttgtcgacagccatccttcaactctcagagagtggtcagcttcagagaattcatgacgagtggttcacccggcctagttgctcctctgatgacagcgaagtgggggcaaccaggcttggcctcggaagcttttggggccttttcctcgtgtgtgccctgatatgcctcttggctttgctggtgtttttcatacggatatgctggcagtataacaagtactccaattctgaagctgctggtgagcccagtgcagcagcagctgctgctgcagcagtagatgctgctgctgccgccgccgatgctgtcgaaagacagaggaggccatcacgtcttggcagcttcaaagatattatacagtttgtcgacaaaaaggaggaggaaattaagaagacgatgaaacgaagagtaagtgagaaagacaataaccaagctgcaggatcctcagaagctcattcagtggcttcagcatagaacattctttccaactcctgtcctcacaaggcaaaacaaggaagcacatatacgataggaaaaagtcaaaattactt

SEQ ID NO: 1723 - DNA, 3268 bp, Panicum virgatum
caagcatcctcccggcctcccctcctggggagagggagagagctcggctcctccccagttgtccttttcactatcctccttccttgctcacctcgaaaccggaatcttgctttacgatgaaatgattatatagctccaggcctccacccgctccaaggtctcggctttcggcggccccggtgttctagtgccgcttggattcgggccaatgggcgcggctcagctggtggcttggttcttggcgttcgccgccgccgcgggggcggtgtcggcggcgggggcgcggccgagcgaggtggccgtgggcgccctcttcacgtacgactccactattggccacgcggcgcggctcgccatcgagctcgccgtcgacgacgtcaacgcggacggcacggtgctctcggggacgaagctcagtctgaagagccgcaacaccaactgcagcgcctttattgggaccgtcgaagcattgcagcttatggaggaaaatgtggttgcggtgattgggccgcaatcctcagggataggccatgtaatctctcatgttgctaatgagctacacgttcctcttctgtcatttgcggccacagatccaactctttctgcattagagtatccctacttcttaagaacaacaataagtgactacttccaaatgaatgctgttgctagcattgttgattactatcaatggaaaagggtgactgctatatatgtcgatgatgattatgggcgaggtggtgtgtccgcccttggtgatgcacttgcatctaaagggcaatgatatcatataaagcagctattcctccaaattcaaattcagacgtgataagtgatatactgtttacagcaaacatgatggaatcaagggtcatggttgtgcatgtcaatcctgacaccgggatgagaatattttctgcagctaacgagctccggatgatggccactggttatgtctggatagtaactgattggctagctgctgtccttgattcctcggcgtctagagatcttaaagatatgagtcatattcagggactaattgttcttcgtcagcacactcctgaatctgatgtcaagaataagttcatatccaaatggaatactgcggctcataacagaagtattacttctggcttgaactcatacagcttttatgcttatgacagtgtttggactgttgctcgtgcaatcgatcaattcctcaacagtgggcaacagatcaacttctcaacagatcccaagttgcacgattcaaatggcagcactttgcgtctatcaactctcaagatatttgatggtggtgagcagatgctacaacaacttctactcacaaactttacaggtgtgacaggtccagtccagtttggttcagacggccatttagtacgcccagcgtatgatatacttaatgttggtggttctggctaccgcttgattggctattggtctaaccattctggcctttctgttgctgctccagaaattttgtatcagaagccaccaaatacaagtgcccagcagctgtacaatgtgctatggccaggtgactccacaactacgcctaagggttgggtattccgaaacaatggccaggctctgagagttggggttcctaataaagcaagctttaaggatttagtgtcaagcagaggccctggtaatgtgacgggttattgcattgatgtattcaacgcggcaattaaactgctcccttacccaactcctgtccaatttgttactattggggatggcacaaagaacccaagctatattggcatcgttcaaatggttgctgccaatatccttgatgcagctgtaggtgactttgctatagtgagaaatggaacagcgatttcagaatatacacagccttatgttgaggcagggctcgtgatagtagcgccggtgaaacaaataaatccaagtgcctgggctttccttaaacccttcacattggagatgtggtgtgtcacaggtgctctttttatcttggtggggatagtagtttggcttcttgaacatcggattaatgaggagtttcgaggctctccacggcgacaagttataacaatattctggttcagcttctcaacaatgttcacctcacacagagaaaacgtcttaagcacgcttgggcggttcgtgttgataatatggttatttgttgtgctgatcatcaattcaagttatactgctagcttgacgtcaatcctcacagtccaacagctcgacacaggaattacagggcttgatagtttgatttccagttctttacctattggataccagaatggaaaatttaccaaaaagtacctgattcaagaactcaatattccagtgtctcgattggtagcactaaatacgatccaggaatatgctgatgccctcaaccgtggaccaaaatacggcggtgttgccgcgattgtggatgagaagccgtatattgatatcttcctgtcatactactgcaacttcagaatagtgggacagcaattcacaagggaaggatggggctttgcattccagagggactcccctcttgctgcagacatgtcgacagccatacttcaactttcagagagtggccaacttcagagaattcatgacgagtggttcacgcggcctgagtgcgcctctgatgatgagagccaggtgggagcaaccaggcttggcgtcggaagcttttcaggccttttcctcatgtgtgccctgacatgtatcttcgctctggtggtgttcttcatacggatctgctggcaatacaaccagtactccagttctgaagctgccagtgagcccagtgcacccgatgctgatgctatccagcggaggccatcaggccgcagcttcaaagagctgttacagtttgtcgacaagaaggaggaagaaatccggatgaagatgaaacgaagatcaagcgacaaagataaccaagctgcaggttcctcagatgcgctgtcagtgacttcagcatactaacgttctttcaggcttcagtccttcagatggccgagcatggaaatacgttagtacattaccaagacaacatatcgaacagattcatgtatatagtagtggtgatatatcttgatccaagcatccacttttcattaggatctttaggattgtcttgtctatgaaatacactgtttgtattccacgactgtagtttctttcagttgcttttctaacaagcatatttctggcttccctctgactgattattggttccatatagcattatagcacatgttgtttaacctgt

SEQ ID NO: 1724 - DNA, 763 bp, Solanum tuberosum
ctcaatcaagttcaagatggtaaagaatgaagtgatggtggatgaaattccttttccttctcaattcatggtgaataataagcctttacctttgatgggccatggaataacagacatagagatacattttctccaaattaaattcacagcaattggagtttacttggatccagaaattgtgactcatttgcaacaatggaagggaaaaacaggggaagaactaactgaaaatgatgaattctttgaggctattgttaatgctccagttgacaagttcttgagagtagtagtgattaaagagatcaaaggttcacagtatggtgtgcagctagagagtgccatacgcgatcgcttagcagaagtcgataaatatgaagaagatgaggaagaagcactcgaaaaaatcgttgaatttttccagtctaagtatttcaagaaagattcagtaataacatattatttcccagctacttctgggagtgcaaagatatcgtgcacgatagaaggtaaggaaaacttggaaattgaagttgaaaatgcaaatgttgtagagatgatgaagaaatggtacttaggtggaactaggggagtgtcacctacaactatttcttctttggctaacaacatttgtgttgaattgtctaaataaaagacatcatgtgttgtgttgtttgtattgatttttgttgttttggtcatgttggctattgtatttggcctatggagaccttttgtttcaagatttgtgtttgaaattaataaa

SEQ ID NO: 1725 - DNA, 957 bp, Solanum phureja
attccacataaacttaaacaaacaacaaacttactttcaattattttttttaagtccactttcaaactctctaagttttctcaatcaagttcaagatggtaaagaatgaagtgatggtggatgaaattccttttccttctcaattcatggtgaataataagcctttacctttgatgggccatggaataacagacatagagatacattttctccaaattaaattcacagcaattggagtttacttggatccagaaattgtgactcatttgcaacaatggaagggaaaaacaggggaagaactaactgaaaatgatgaattctttgaggctattgttaatgctccagttgacaagttcttgagagtagtagtgattaaagagatcaaaggttcacagtatggtgtgcagctagagagtgccatacgcgatcgcttagcagaagtcgataaatatgaagaagatgaggaagaagcactcgaaaaaatcgttgaatttttccagtctaagtatttcaagaaagattcagtaataacatattatttcccagctacttctgggagtgcaaagatatcgtgcacgatagaaggtaaggaaaacttggaaattgaagttgaaaatgcaaatgttgtagagatgatgaagaaatggtacttaggtggaactaggggagtgtcacctacaactatttcttctttggctaacaacatttgtgttgaattgtctaaataaaattaaagacatcatgtgttgtgttgtttgtattgatttttgttgttttggtcatgttggctattgtatttggcctatggagacctttaataaattagaagttcattttagcttgtttgcaacatcttttatcatattttcctttttagtctctagaaattgtttaagcaaagggagtgtgtgtgttggtaataacttggtattcttagggctagtttagacatgattt

SEQ ID NO: 1726 - DNA, 778 bp, Nicotiana tabacum
  misc_feature (687)..(687): n is a, c, g, or t
tctcagtcaacataaagatgggaaagaatgaagtgatggttgatgaattcccttttccttctcagtttatgatcaacactaagcctttatctttgatgggtcatggaataactgacattgagatacacttcctccaaattaaattcactgcaattggagtttacttggatccagaaattgtaactcatttgcagcagtggaagggcaagacaggagctgaattaactgaaaatgatgacttctttgaggctattgttaatgctccagttgataaattcttgagagtagttgtgattaaagaaatcaaaggctcgcaatatggagtgcagctagagagtgctgtacgcgaccgtttagcagaagttgataaatatgaagaagaggaagaagaagcacttgagaaaattgttgaatttttccagtctaagtatttcaagaaaagttcagttataacatattctttcccatctacttctggcattgcaaagatttctttcgcaacagaaggtaaagaagactcagaaattgaagtgaagaatgcaaatgttgtagagatgatgaagaaatggtacttaggtggaaatagaggagtgtctcctacaactatttcttccttggccgataacctctctgctgaattgtctaactaaagaaaagatgttatgtttatgctgtcctcatttgttntttggtcttgttggcttttgtataacctaatggagacttgtctttcatgatttgtgtttgaaattaataaaaaagttcattttgcttgttt

SEQ ID NO: 1727 - DNA, 826 bp, Nicotiana benthamiana
tcatatttttaagtctactctcaaactcaatctagttttctcctaagttttctcagtcaacataaagatgggaaagaatgaagtgatggtggatgagtttccttttccttctcaattcatgatcaacactaagcctttatctttgattggtcatggaataactgatatagagatacattttctccaaattaaattcaccgcaattggagtttacttggatccagaaattgtaactcatttgcagcagtggaagggcagaacaggagctgaactaactgaaaatgatgacttctttgaggctattgttaatgctccagtggataaattgttgagaatagttgtgattaaagaaatcaaaggttcacaatatggagtgcagctagagagtgctgtacgtgaccgtttagcagaagttgataaatatgaagaagaggaagaagaagcacttgagaaaattgttgaatttttccagtctaagtatttcaagaagagttctgtaattacatattcttttccagctacttctggcattgcaaagatttctttcgcaacagaaggtaaagaagactcagaaattgaagtggaaaatgcaaatgttgtaaaaatgatgaagaaatggtacttggggggaagtagaggagtatcccctacaactacttcttctctggccaacaacctctctgctgaattatctaagtgaagaaagaatgttatgtttttgttgtcctcatttgttatttggttatgttggcttttgcataacctctggagactgtctttcaatatctgtgttggaaattaataatttagaattacttttggatta

SEQ ID NO: 1728 - DNA, 884 bp, Petunia hybrida
tccatttttttgtttagtccagtgtatcaactctcctagtagtctatcgcctaagtttttcaatcaagatcaacatgggaaagaacgaagtgatggtggatgaaattccttttccttctcagttcatgatgactactaagcctttaccattgatgggccatggaataactgacattgagatacactttctccaaattaaattcactgccattggagtttacttggatccagaaattgtaactcatttgcagcagtggaagggtaaatcaggagctgagctaattgaaaatgatgagtttttcgaggctattgttaatgctccagttgataaattcttgagagtagttgtgattaaagaaatcaaaggttcacaatatggagtgcagctagagagtgctgtaagagatcgtttagcagaagtcgataaatatgaagaggaagaagaagaagcacttgagaaaattgttgaatttttccagtctaagtatttcaagaaagattctgtcgtaacatattcttttccagctacttccggcaatgttaagatttcgttcgctacagaaggaaaagaagattcagaaattgaagtgcaaaatgcaaatgttgcaggggagatcaagaaatggtacttaggtggaagtaggggattgtctcctacaactatatcttctttggccaacaccctctctgctgaattatctaaatgaagggaccatgtttatgttaatgttgccttgatttgttatttggtcatgttggtttagcctagagggacatgtctttcaagatttgtgtctgaagtttataacataaaacttcatttattgttttcaaatgttttcttgtttccttttttatctcaagaaattgttcaagggtgctta

SEQ ID NO: 1729 - DNA, 959 bp, Triticum aestivum
  misc_feature (909)..(909): n is a, c, g, or t
gcacggaagcacgacgataaaacgcccacgctcttccatctctgccataacaaacgcaaagctgctccatcatcttcctctatttctctttcatctcttgacctctgcaagaaaacaatgggatcggagcaggagaagaaggccgccgccacggtggaagtggaaggcatcccgttcccgcgggaaatcgccgccgccaagacgctctcgctcgtcggccatggcgtcacggacattgagatccacttccttcagatcaagttcaacgccatcggggtctacctcgacgtcgacggcgccatggagcatctgcagggctggaaggggaagagccagctgatggaggacgaggctttcttcgacgcattggtctccgctccggtggagaaggtgctgagggtggtggtgatcaaggaaatcaaggggtcgcagtacggcgtgcagctcgagagctccgtcagggaccgcctcgtggcggcggacaaatacgaggacgaggaggaggaggcgctcgagaaggtctcggacttcttccagtccaagtacttcaggcccggctccgtcgtcaccttccacttcccggccacggccaccgccgcgccagagatatcgttcgtgacagaaggcaaggaggaggccaaggtggcggtggagaacgcggccgtggcggagatgatccaaaggtggtacctcggcggcgattcggcggtgtcgcagaccaccgtcaggagcatcgctgatagtttcgcggcaatgctctcctcaccatgattctttttttacaagtgctgcttacttgcttttgcaataaatcgataagtcatgataaaaaaacacttggtggcggaagccttaccggtcctttggcaactcgatccaacgctgtacatcaaatcatttccaaatttntggataaagggcactttattatataaaagatttaagtattaaaaaaaaaa

SEQ ID NO: 1730 - DNA, 843 bp, Triticum aestivum
caacttcctctttgtttctctttcatctgttgacctctgcaagaaaacaatgggatcggagcaggagaagaaggccgccgccacggtggaagtggaaggcatcccgttcccgcgggaaatcgccggcgccaagacgctctcgctcgtcggccatggcgtcacggacattgagatccacttccttcagatcaagttcaacgccatcggggtctacctcgacgtcgacggcgccatggagcatctgcagggctggaaggggaagagccagctgatggaggacgaggctttcttcgacgccctggtctccgctccggtggagaaggtgctgagggtggtggtgatcaaggagatcaaggggtcgcagtacggcgtgcagctcgagagctccgtcagggaccgcctcgtggcggcggacaaatacgaggacgacgaggaggaggcgctcgagaaggtctccgacttcttccagtccaagtacttcaggcccggctccgtcgtcaccttccacttcccggccacggccaccgccgcgccagagatatcgttcgtgacagaaggcaaggaggaggccaaggtggcggtggagaacgcggccgtggcggagatgatccaaaggtggtacctcggcggcgattcggcggtgtcgcagaccaccgtcaggagcatcgctgatagtttcgcggcaatgctctcctcaccatgattctttttttacaagtgctgcttacttgcttttgcaataaatcgataagtcatgataaaaaaacacttggtggcggaagccttaccggtcctttggcaactcgatccaacgctgtacatcaaatcatttccaaattttgg

SEQ ID NO: 1731 - DNA, 899 bp, Pseudoroegneria spicata
  misc_feature (891)..(892): n is a, c, g, or t
tcctcgtttcttccgttgacgtatctctgccctaaaacaatgggatcggagcaggagaagaaggccgccgccacggtggaagtggaaggcatctcgttcccgcgggaaatcgccggcgccaagacgctctcgctcgtcggccatggcgtcacggacattgagatccacttccttcagatcaagttcaacgccatcggggtctacctggacgtcgacggcgccatggagcatctgcagggctggaaggggaagagccagctgatggaggacgaggctttcttcgacgcactggtctccgctccggtggagaaggtgctgagggtggtggtgatcaaggagatcaaggggtcgcagtacggcgtgcagctcgagagctccgtcagggaccgcctagtggcggcggacaaatacgacgaggaggaggaggaggcgctcgagaaggtctcggacttcttccagtccaagtacttcaggcccggctccgtcgtcaccttccacttcccggccacggccaccgccgcgccagagatatcgttcgtgacagaaggcaaggaggaggccaaggtggcggtggagaacgcggccgtcgcggagatgatccagaggtggtacctcggcggcgagtcggcggtgtcgcagaccaccgtcaggagcatcgcggatcgtttcggggcaatcctctcctcaccatgattctttttacaagtgctgcctacttgcttttgcaataaatcgataagtcatgatgaaatatttcgaaaaacagagcctacccggtccttcaggcaactccaatgcttacatcaaatcatttctaaatgtctggactgggactgttcggacactttggggcatccaacatgatatcaaatcatttcaaaaaaaaaaagnnaaaatgc

SEQ ID NO: 1732 - DNA, 983 bp, Triticum aestivum
ctactccacccccatcgcacggaagcacgacgataaaacgcccacactcttccatctctgccataacaaacgcaaagctgctccatcaacttcctctttgtttctctttcatctgttgacctctgcaagaaaacaatgggatcggagcaggagaagaaggccgccgccacggtggaagtggaaggcatcccgttcccgcgggaaatcgccggcgccaaggcgctctcgctcgtcggccatggcgtcacggacattgagatccacttccttcagatcaagttcaacgccgtcggggtctacctcgacgtcgacggcgccatggagcatctgcagggctggaaggggaagagccagctgatggaggacgaggctttcttcgacgccctggtctccgctccggtggagaaggtgctgagggtggtggtgatcaaggagatcaaggggtcgcagtacggcgtgcagctcgagagctccgtcagggaccgcctcgtggcggcggacaaatacgaggacgacgaggaggaggcgctcgagaaggtctccgacttcttccagtccaagtacttcaggcccggctccgtcgtcaccttccacttcccggccacgcccaccgccgcgccagagataacgttcgtgacagaaggcaaggaggaggccaaggtggcggtggagaacgcggccgtggcggagatgatccagaggtggtacctcggcggcgagtcggcggtgtcgcagaccaccgtcaggagcatcgctgatagtttcgcggcaatgctctcctcaccatgattcttttttttgagggcaccatgattctttttttacaagtgctgcttacctgcttttgcaataaatcgataagtcacgatgaaatatttcaaaaaacacttgctggcgaagccttaccggaactttggcaagtcgatccaacgctgtacatccaaccatttctaattttttcgataaagagcactttattatat

SEQ ID NO: 1733 - DNA, 829 bp, Triticum aestivum
agctgctccatcatcttcctctttgtttctctttcatctgttgacctctgcaagaaaacaatgggatcggagcaggagaagaaggccgccgccacggtggaagtggaaggcatcccgttcccgcgggaaatcgccggcgccaagacgctctcgctcgtcggccatggcgtcacagacattgagatccatttccttcagatcaagttcaacgccatcggggtctacctcgacgtcgacggcgccatggagcatctgcagggctggaaggggaagagccagctgatggaggacgaggctttcttcgacgccctggtctccgctccggtggagaaggtgctgagggtggtggtgatcaaggagatcaaggggtcgcagtacggcgtgcagctcgagagctccgtcagggaccgcctcgtggcagcggacaaatacgaggacgacgaggaggaggcgctcgagaaggtctccgacttcttccagtccaagtacttccggcccggctccgtcgtcaccttccacttcccggccacggtcaccgccgcgccagagatatcgttcgtgacggaaggcaaggaggaggccaaggtggcggtggagaacgcggccgtggcggagatgatccagaggtggtaccttggcggcgattcggcggtgtcgcagaccaccgtcaggagcatcgctgatagtttcgcggcaatgctcacctcaccatgattctttttttacaagtgctgcttacctgcttttgcaataaatcgataagtcacgatgaaatatttcaaaaaacacttgctggcgaagccctaccggtcctttggcaactcgatcc

SEQ ID NO: 1734 - DNA, 1271 bp, Brachypodium distachyon
gactaacaattcagctaattttatttagtagatacttaacagcaccatttgcaaacatgagcaaatttttattacctaataccatcatatacatggacacttccaagatgcaattttggatgcatctaacagcatcacttgtcaaccacaggatgcaccaacctccccccctcttgaagttcagcccttttgttggtttggaagcttacttcagcgtggtagctgcatctgacagtctcggttccaccacttgtccattcctactcccactcacctaacccctccaacattgcatccacgataaaacacccgcccacgccctttagctcctccagacaccacaaagcacacaagcttctccatcatcttctagctagctcttggctcctccgttgatcgattcgcctcgactgcgaaaataaagaacaatgggatcggagcacgagaaggctgctgtcgacaccgccaccgtagaggtggaaggtatcccgttcccgcaggagattgccggcgccaagaccctctcgctcgttggccatggtgtcacggacatcgagatccatttcctgcagatcaagttcaatgccattggagtctacctcgacgagggcggcatcatggagcacctgcagagctggaaggggaaggaccagctgcaggtggaagatgatgctttcttcagcgccctggtctcagctccggtggagaaagtgctgagggtggtggtgatcaaggagatcaaggggtcacagtacggggtgcagctggagagctccgtcagggaccgccttgtcgcggcagacaggtatgatgacgacgaagaggaggcgctcgagaaggtggcagagttcttccagtcgaagtacttcaggcccggctccgtcgtcaccttccactttccagccacggccaccgctgcagagatatctttcgcgacggagggcaaggacgaggcgaaggtggcggtggagaacgcggccgtggcggagatgatccagaggtggtacctcggcggagcgtcggcggtgtcacagaccaccgtcaggagcctcgccgaccatttcacggccttgctctcctctccatgatttttttttacaagtcctgctctgcttggtagctttgcctctgtaataaggaagtagtgaaatagtcatgttggaaaaatttcaactatctgaaacgtgaggattgaattcaatgttgctgcttggttttctgtctgttaatttgctccagaggaaataaacaaaatactgcggttgatgtgc

SEQ ID NO: 1735 - DNA, 4424 bp, Solanum lycopersicum
taaatggagggtggtggagatatattgaaggtgagtagtgcgcgtttgggtagttcaactgtatggagaaatagtggtgtggatgtgttttcaaggtcatcaagagaagattacgatgatgaagaggcgttaaaatgggctgctcttgagaaacttccaacgtatcttcgtataaggagaggcattcttagtgaagaagaaggacaatatagagaagttgatataacaaagctcgatttggtggaaaggaggaatctcttagagagacttgttaagattgctgatgaagataatgagaagttcttgttgaagctcaaaaaaaggattgatagagttggtctggatcttcctacaattgaagtacgattcgagcatttgaatgtagatgcagaagctcgcgttggtagtagagctttaccaacaatattcaacttcacagttaacatcatagaggatttcttgaattatcttcacattcttccaagtagaaagaaaccattaccaatccttcatgagatcagtggaatcatcaagccaggaagaatgacactgcttttaggaccaccaagttcggggaaaacaacgttgctgttaggtttggctgggaaacttgataaagatctcaaagtttcagggagagttacatataatggtcatgggatggatgagtttgtgccacaaagaacatctgcttatataagccaaaatgatcttcatattggagaaatgacagtcagggaaacattggcattttctgctagatgtcaaggagttggagccaaatatgaaattttggcagagttgtctaggagagagaaggaagcaaatattaagccagatcctgatgttgatatctttatgaagtcagcgtggaatgacgggcaggaggctaatgttgtaacagattatactctcaagatattgggacttgaaatttgtgctgataccattgttggagacgaaatgattcgaggaatttctggggggcagagaaagaggctaacaacaggggagatgatggttggaccagcaagagcactttttatggatgagatatcgactggtttagatagttcaacgacttatcagattgtcaattcaattaggcagtcaatccacattcttcaaggaactgctgtaatatcacttctgcagcctgcaccagaaacttatgacttgttcgatgatattattctcttatcagatgggcagattgtgtaccaaggtccccgggagaatgtccttgagttcttcgagtacataggcttcaaatgcccccagaggaaaggagttgctgacttcttacaagaagtgacatcaaggaaggatcaagagcaatactgggcacgtcgtgatgaaccttataagtttatcacagtgcgcgaattttctgaagcatttcagtcatttcatgttggaaggaagcttggtgatgagcttgctgttccctttgataaatcgaagagccaccctgctgctctaaccactgagaggtatggtgttagcaagaaagaactcttgaaagcctgcacagctagagaataccttcttatgaagaggaattcgttcgtctatatattcaagatgatacaactaacattgatggctactataacaatgacactcttcctacgaactgagatgcacagagatacaatgatagatggtgcagtattcttgggtgcactgtattatgcagttatcatgattatgttcaatgggttttcagagcttgccctcagtattatgaagcttccttccttttacaaacatcgcgatcttcttttctttcctgcttggacatatgctttgcctacttggatcctcaagattccgatcacacttgtagaagttgctatttgggtgtgtatgacttattacgtaattggatttgaggcagacgttggaaggttcttcaaacagctatttctgctcatatgtcttaaccagatggcctcagggctgtttcgattcttagctgctcttggaaggaatgtcattgttgcaaatacatttggatcatgtgcactactcatagttcttgtaatgggtggattcattctgtcaagagataatgtgaagcaatggctgatatggggttactggatttcccctatgatgtatgcacagaatgctatagcagtgaacgaatttctagggaagagttgggcacatgttcctcctaactccacgggcacggatacattaggggtgtcatttttgaaatcgcgtggaatctttccagaagcaagatggtactggattggagtaggagctcttcttggatatgttttgctattcaatttcttgttcacagtggccttagcttatctcaacccatttggtaaacctcaggcagttctttctgaagaaactgtggctgagaggaatgcaagcaaaagggaaagaggaaacgatgttcggcgaagtgcatcttccaggtccatgtcctcaagagtaggcaacatagctgagggtgatttaaacaagagaaagggaatgattcttcctttcgaaccactttcaattacttttgatgatatcagatatgcagtagatatgccacaggaaatgaaagctcaaggttttaccgaggaccgacttgaactcttgaaaggggtgagtggtgcttttaggccaggagttttgacagctctaatgggtgttagtggagctggtaagaccactcttatggatgtcttagctggtaggaaaaccggtggctacattgaaggaaccatcagtatatcaggatacccaaagcagcaagcaacgtttgctcggatagctggatactgtgagcaaactgacattcattcacctcatgttacagtatacgaatcattgcagtattctgcttggcttcgactgcctcgtgaagttgacaccgaaactcgaaagaggttcatagaggaggtcatggaacttgtagagctaaaacctcttagagaagcacttgttggattacctggagtgaatggtctttcaactgaacaacgaaaacgacttacagttgcagttgaactagttgccaatccttctataatattcatggatgagccaacctctggattagatgctagagcagctgcaatagtgatgagaacagtcagaaacactgtagatacaggtcgaacagtagtatgcaccattcatcagcctagcattgacatatttgacgctttcgatgagctcctactcctgaaacgaggaggcgaagaaatatttgtcggcccattaggacgccattcttctcaccttattaagtattttgaggtaagggaactgttaggtaaagaaactggaattcctattatgttggtccagtgcacaaagtaatggttctgtttccatatgcctcagggaatcgacggagttctgaaaatcaaagatggttacaatccagcaacatggatgttggacataacttcagtagcacaagaagcagctcttggaattgactttactgaattgtacaggaactcagaattgtataggagaaacaaagctttaatccaggaactaagtgtgccagccccaggttcaaaagacctctactttgaaaccaagtattctcagtctttcttcacacaatccatggcttgcttctggaaacagcactggtcatactggcgaaatcctccttacacagcagtcaggctcatgtttacattcttcattgctctcatgtttggaaccatattttgggatcttggctccaaaaggagaaggcaacaagatattttgaatgcaataggttcaatgtatgctgctgtcttgtttcttggtgtacaaaatgctacgtcagtgcagccagtggttgctattgagaggacagttttctacagggaaagagctgctgggatgtattcagctctgccttatgcatttggacagattatgattgagctgccatacattttcatccagacaatcatctatggtgttatagtctatgcgatgatcggatttgaatggacagttgccaagttcatttggtatctgttcttcatgtacttcaccttgttatacttcacattatacgggatgatgactgtagccgttactcctaatcacagcattgcagccatcatttcatctgcattttatgcagtatggaatcttttcagtggattcattgttccaaaaacaagaatgccagtgtggtggagatggtacttttatatttgcccaatttcgtggacattatacggactagttgcctcacaatttggagacttacaagacaaattggaaacaaaagagacagtggaagaattcatagagagtttctttgatttcaaatacgattttgtgggatatgttgcattgattcttgttggaatatcagttggctttctcttcatttttgcttactcaatcaaagcatttaacttccagaaaagataggggttggttctggt

SEQ ID NO: 1736 - DNA, 2053 bp, Saccharum officinarum
cccacctccgcttcgcttcccgaaccaggccgcgctcgcctgctcccgcaccggagaattcaccggcccgccagcctcgtcccgacatggcggtggcgctgcggttcccgggggtcgcgccggagtctctggacgcctccaagctcgggagggagcggcactcggtctgcgggagcgcgaggccgggagcgcaatgctggaggccaaggaggggtctggcggtgcgctgccagacgggcgccgccccggctgtcctcaggacggaggaggccgcggcgggaaggaatgcccaggcggggttcaccgtcgtcatgaagttcggcggctcgtcgctcgcgtcggccgagcggatgcgggaggtggccgacctcatccttagcttccccgacgagacgcccgtcgtcgtcctctccgccatggggaagaccaccaataacctcctcctggccggagagaaggcggtgagctgcggcgcccccaaggcgtccgaaatccctgagctcgccgtcatcaaggacctgcatctaaggacggttgatgagctcgggttagatagctcgattgtttcaggtttattggatgaattggagcaacttcttaaaggagttgctatgatgaaagagctgactctgaggacaagagattatcttgtttcctttggtgaatgtatgtctacaagaatatttgctgcatatttgcataaacttgggaaaaaggcacggcagtatgatgcatttgatattggctttataaccactgatgatttcacaaatgcggatattcttgaagtcacttatcctgctgttgcgaagaggctacatggagactggatggatgaccctgctattcctatagtcactggttttcttgggaagggatgtaaatcatgtgctgtcaccactttaggcaggggtggtagtgacttgacagctacaaccattggcaaagccttgggattaagagaaattcaggtttggaaggatgtagatggtgtgttgacgtgtgatcctaatatttatgcaaatgctatacccgtgccctacttgacttttgatgaggctgctgagcttgcctactttggggcacaggttttgcatccccaatcaatgcgaccggctagggatggtgatataccagtgagagttaagaactcgtacaatcgtcatgcacctggtactgtcatcactaaatccagagatatgagcaagagcatattgaccagcattgtgttgaaatcaaatgttaccatgctggatatagtgagcacacggatgcttggccagtacgggtttttagcaaaggtcttctcaatatttgaagatttgggcatctctgttgacgttgtggctactagtgaagtcagcatctcgttaactctagatccatcaaaactatggagccgtgaattgatccagcaggaacttgatcatgttgttgaagagcttgaaaaattttctgttgttcatctgctccagcgtagatcgatcatctcactgatagggaatgtacagagatcatcattgattcttgaaaaggcattcaatgttctacgaagaaatggtgttaatgtccagatgatctcacaaggggcgtccaaggtgaacatttccttagtagtcaatgacagtgaggcaaaacagtgtgtacaagcactccattcggcattctttgagaatggcttcttgtcggaagtagagggagctgatgttccccagaacggcgcctctctgaactcaaatggcgctatctatgcaaactagtcgactctgcaaatgcattctcagacttatgtaccattgataggttaaatggcgattcacagctatttatttaggtcacccagggccctgatcaaattccttgatgttttatgcaatcgtttaccgtgtgattgggtgctaccaagtagtagccaatgtcttggggatctgccacttggtcaaggcattcccaagcttattatatgttgagttgtattgtatgtgaaagtataagagaattgcttgcgccctttgggtggtgataaagtttgtagttttagactgcccccccc

SEQ ID NO: 1737 - DNA, 2117 bp, Sorghum bicolor
gtctcgccgccaccatctccccttcgcttcccgttcgattcgagccagcccagcctccccgcgcgcgcctgctcccgcaccggagaattcacaggcctctcgaccgcccaacgatggcggaggcgctgcggttcccgggggtagtcgcgggggagtctctggacgcgcccatcgccgcctccaagctcggaagggagcggcactcggtctccgcgagcgcgaggccgggagcgcaatgctggaggcggaggaagggtctggcggtgagctgccagacgggcgccgccccggctgttctcaggacggaggagaccacggccgcggcggcggcggggagcaatgctcaggcggagttcaccgttgtcatgaagttcggcggctcttcgctcgcgtcggccgagcggatgcgggaggtggccgatctcatccttagcttccccgacgagacccccgtcgtcgtcctctccgccatggggaagaccaccaataacctcctcctggccggagagaaggcggtgagctgcggcgcccccaaggcgtccgaaatccctgagctcgccgtcatcaaggacctgcatcttaggacggttgatgagctcgggttagataggtcgattgtttcaggtttattggatgaattggagcaacttcttaaaggagttgctatgatgaaagagctgactcttaggacaagagattatcttgtttcctttggtgaatgtatgtctacaagaatatttgctgcatatttgaataaacttgggaaaaaggcacgccagtatgatgcatttgatattggctttataaccactgatgatttcacaaatgcggatattcttgaagtcacttatcctactgttgcaaagaggctacatagagactggatggataaccctgctattcctatagtcactggttttcttgggaagggatgtaaatcatgtgctgtcaccactttaggcaggggtggtagtgacttgacagctacaaccattggcaaagccttgggattaagagaaatccaggtttggaaggatgtagatggtgtgttgacgtgtgatcctaatatttatgcaaatgctatacccgtgccctacttgacttttgatgaagctgctgagcttgcctactttggggcacaggttttgcatccccaatcaatgcgaccggctagggatggtgatataccagtgagagttaagaactcatacaatcgtcatgcacctggtactgtcatcactaaatccagagatatgagcaagagcatattgaccagcattgtgttgaaatcaaatgttaccatgctggatatagtgagcacacggatgcttggccagtacggatttttagcaaaggtcttctcaatatttgaagatttgggcatctctgttgatgttgtggctactagtgaagtcagcatctcgttgactctagatccatcaaaactatggagccgtgaactgatccagcaggaacttgatcatgttgttgaagagcttgaaaaattttctgttgttcatctgctccagcgtagatcaatcatctcactgatagggaatgtacagagatcatcattggttcttgaaaaggcattcaatgttctacgtagaaatggtgttaatgtccagatgatctcacaaggggcgtccaaggtgaacatttccttggtagtcaatgacagtgaggcaaaacagtgtgtacaagccctccattcggcattctttgagaatggcttcttgtcagaagtagagggagctgatgttccccagaacggctcctctctgaactcaaatggcgctatctatgcaaactagtcgactctgcaactgcattctcagatttatgtaccattgataggttaaatggcgattcatagctacttgtttaggtcacccagggccctgagcaaattccttgatgttttaagaacttactaggaactgtttgcatggtatgcaatcgtttaccgtgtgattgggtgctaccaagtagtagccaatgtcttggggatctgccacttgcattcccaagcttattatatgttgagttgtactgtatgtgaaagttataagagaattgcttgcgccctttgggtggtgataaagtttgtagtttca

SEQ ID NO: 1738 - DNA, 2140 bp, Panicum virgatum
ccccccttcctctccaccctcgcctcgcgccgattctccggcaaagggaagcttctggatctcgcatcgcccgtctcgtcacgagatggcggtggcgctgcggctccctggggtcgcgcgggggtctccggccgcgctcgccatccgcgccgccgccaagcacgtgagggagcaggactcggtccgcgcctgttgcgccaggccgcctgcgcaatgctggaggcggagccggctggtggtgcgctgccagacggccgccgcggctcttctcaaaaaaaaggaggccacggcggcggcggcggcgcacaagccccgcacgggcttcaccgtcgtcatgaagttcggcggctcctcgctcgcgtcggccgaccggatgagggaggtggccgacctcatcctcagcttccccgaggagacgccggtcattgtcctctccgccatggggaagaccacgaataacctcctgctggctggggagaaggcggtgagctgcggcgccccgaaggcgtccgaaattcccgagctcgcggtaatcaaggacctgcatcttaggacgattgatgagcttggattagataggtcggttgtttcaggcttattggatgaattggagcaacttcttaaaggagttgctatgatgaaagagctgactcgtaggacaagagattaccttgtttcctttggtgaatgcatgtctacaagaatatttgctgcatatttgaataaacttgggaaaaaggcacgacagtatgatgcatttgatatcggctttataaccactgatgatttcaccaatgcggatattcttgaagtcacttatcctgctgtggcaaagaggctaaatggagattggatggatgaccctgccattcccatagtcactggttttcttgggaagggatgtaaatcatgtgctgtcaccactttaggcaggggtggtagtgacttgactgctacaactattggcaaagctttgggattaagagaagtccaggtttggaaggatgtagatggtgtgttgacatgtgatcctaatatttatgcaaatgcgatacccgtgccctacttgacttttgatgaggctgctgaacttgcctactttggtgcacaggttttgcatcctcaatcaatgcggcctgctagggaaggtgatataccagttagagttaagaactcgtacaatcgtcatgcgcctggtacagtcatcactaaagccagagatatgagcaagagtatattaaccagcattgtgttgaaatcaaatgttaccatgcttgacatagtgagcacaaggatgcttggccagtatggttttctagcaaaggtcttctcaatatttgaagatttgggcatctctgttgattgtgtcgctactagtgaagtcagcgtatcattgacactagacccgtcaaaactatggagtcgtgaattgatccagcaggaacttgatcatgttgttgaagagcttgaaaaatttgcggttgttcatctgctccagcatagatcaatcatctccctgattgggaatgtacaaaggtcatcattgattcttgaaaaggcattcaatgttctgcgaagaaatggtgttaacgtacagatgatctcacaaggggcatccaaggtgaacatttccttggtagtcaatgacagtgaggcaaaacagtgtgtgcaagccctccattcggcattctttgagaacggcttcatgtcagagattgagggagctgatgttccccagaacggcgcctctctgaattcaaaccgcgcgatctatggaaactagtcgactctgcaactgtattctccccaattgtagtaccattgataggttgagtggtgattcgtagcaatttatttaggtcacccaaacgaattccttgctgttgtaagagcttaccaggaacagtttgcatggtatgccattgtttaccatgtcatcgggtgctaccaagtagtaaccaatggtcttggggatctgccaggttttcaaagcatccccaagcctatgtgtatcagaaagttgtattgcgcatgaatgttataagagttattgcactcattgggtggtgattaagtttgactctgtagatttaactcagtggattcattcataaaaaaactaagtggattcaccattatc

SEQ ID NO: 1739 - DNA, 2194 bp, Triticum aestivum
ggtctatcgccgccactcctctcctcgccgccactcttcttctccggcgaggccaggaagagaagggaggataagaggagaggagggatcccaagccaagagatccggagatctccatggcgaccgcgctgcgtctggcggcggtcgcgcgggactctccggcggccgtctccaagctcgggagggagagggccttgctgcgcgcggccgctaggccgggtgggcaatgctgcgcgcggagggggctggtgctccgctgccagagtggggcggccacgctcaagaagggcgaggcggcggatggggccggggcagcggcggggttcaccgtggtgatgaagttcggcggctcgtccgtgtcgtctgccgcgcggatgcgggaggtggccgacctcatcctcagcttccccgaggagacgcccgtcgtcgtcctctccgccatgggcaagaccaccaacaacctcctcctggccggagagaaggcggtgagctgcggcgcccccaaggcgtcggaaatcaacgagctcgccgtcatcaaggagctccatctcaggaccatcgatgagcttggactagatagctccattgtttcaggttttttggacgaattggagcaactgcttaagggtgttgctatgatgaaagagctgactcttaggacacgagattaccttgtatcctttggtgaatgcatgtctacaagaatatttgctgcatatttgaataaacttgggaagaaggcacgacagtatgatgcttttgatcttggctttataaccactgacgatttcacaaatgctgatattctcgaagcaacttatcctgctgttgcaaagaggctacatggagattggattgatgaccctgctattcctatagtgactggtttccttgggaaggggtggaaatcatgtgcggtcacaacgttaggaaggggcggcagtgacttgaccgctacaaccattggcaaagccttggggttaagagaaatccaggtttggaaggatgtagatggtgtgttgacgtgtgatccaaatatttatgcaaatgcggtaccagtaccctacttgacttttgatgaggcagctgaacttgcttattttggtgcacaggttttgcatccccaatccatgcgaccagctagggaaggtggtatcccagttcgagtgaagaactcatataaccgtcatgcacctggcactgtgatcactaaaacaagagatatgcgcaagagcatattaaccagcattgtcctgaaatcaaatattaccatgctggatatagtgagcacaaggatgctcggacagtatggctttctagcaaaggtcttctcaatatttgaagatttgggtatctctgttgattctgtggctactagtgaagtcagcatatcattgacactagatccatcaaaactgtggagtcgtgaattgatccagcaggagcttgatcatgtagttgaagagcttgaaaagattgcagttgttcatctcctacagcacagatcaatcatttccctgatagggaacgtgcagagatcgtctctgattcttgagaaggcgttcaacgttctacgcagaaatggtgttaatgttcagatgatttcgcaaggggcgtccaaggtgaacatctccttggtggtgaatgacagcgaggcgaagcagtgcgtgcaagccctccactcggcattcttcgagaacggcttcttgtcagaagtcgaggaagcggaccttgcacagaagagggctccagtcctagtaagctcgaatggtgccatcaacggaaactagtcgacgtcgcttttttctacttccagcaacggatgcgccgttcttaggttaagagggtgattcgaccttggattgtgattcattggtgttgtacgagcggtattatagctatcatggttggtgtcgtaagagcgagcggtgttatggttagcatgattcttggagtgctagcatatggcagcccaatcaatgtatgtgattgtgtgaggcgtgctacttgctgaacttaaccattggaggtttgtagtgcactccttgggtgtcttctaccaaatacttactaaatagtatgtgtgttgttcctcctatttatattagcgaataattcttgtttttgtctttgatatctatggcatggtgagcgtgggcactgtttttctgcctatggacttgtaaaaaaaaaa

SEQ ID NO: 1740 - DNA, 2070 bp, Oryza sativa
aaccacccccttcgcctcgccgccacctccgcttcgatccttggaagaggtgaggagaggagagatctagaagcttcggtcggtgctgacatggcggtggcgctccggttcgcggccgtcgcgcgggactcgccggcggccgccgctccccccagggtggggagggagcagcagtatctcgcgtgcgcggcggcggcgaggccgggagggaggtgttcgaggaggaggggattggtggtgcggtgccagagcggggcggcggcggttgtcctcaacaaggacgacgcggcgtcggtggccgccgccgccgcctcctccgcgacggggttcaccgtcgccatgaagttcggcgggtcgtcggtggcgtcggcggagcggatgcgggaggtggccgatctcatactcagcttccccgaggagactcccgttgttgttctctccgccatggggaagaccaccaataacctcctcctggccggagagaaggctgtcagctgcggcgccccgaaggcgtctgaaattcccgagctcgcagttatcaaggagctccatgttaggactattgatgagcttggattggatagatcgattgtttcaggtttattggaagaattggaacaacttcttaagggtgttgctatgatgaaagaactaactcctaggacacgggattaccttgtttccttcggtgaatgcatgtctacaagaatatttgctgcatatttgaataaacttgggaaaaaggctcggcagtatgatgcatttgatattggctttataactactgatgatttcacaaatgcggacattcttgaagcgacatatcctgctgttgcaaagaggttacagggtgattggattgacgaccctgctattcctatagttactggtttccttggaaaaggatggaaatcatgtgctgtcaccactttaggcagaggtggcagcgacttgactgctaccaccattggcaaagcgttgggattaagagagatccaggtatggaaggatgttgatggtgtgttgacatgtgatcctaatatttgtgcgaacgcgatacctgtaccctacttgacttttgaggaggcagctgaacttgcctactttggtgcacaggttttgcatccccaatcaatgagaccagccaaagaaggtgatataccagttagagttaagaattcatataaccgtcgagcacctggtactgttattactaaaacaagagatttgagcaagagtatattaaccagcattgtattgaagtcaaacattactatgctggatatagtgagcacaaggatgcttggccagtatggttttctggcgaaggttttctcaatatttgaagatttaggtatctctgttgattgtgtggctaccagtgaagtcagtatatcattgacactagatccatcaaaactatggtgtcgtgaattgatccagcaggaacttgatcatgtagttgaagaacttgaaaaaattgcagttgttcatctactgcagcacaggtctatcatctcactgatagggaatgtacagagatcgtcattgattcttgagaaggctttcaatgttctacggagaaatggcgttaacgtccagatgatctcacaaggggcatccaaggtgaacatttcattggtggtccatgatagcgaggcgaaacagtgtatacaggcccttcattcagcattctttgagaacggtttcttgtcagaagttgaggaagaggatcttcaacacaatggctctcctgtgagcccaaatggtgtcatttacggaaactagtcgacttagcatttcctgctattgttgtatctttggaatttggataggtttaaaggtgattcaggcatatagtcatttaggccacctaggtgaaatggtgaattccctggtgttgtaagagccctacaaggagcaccctgtgttaatgataatcacgcatagcaggctcacttataatgttaagtttgctgcaataccagcggtgcgatcgtaaataacattgtttgttatcttttggaataaagaatgatccggtgttgaaacaattccctgaaaaaaaca

SEQ ID NO: 1741 - DNA, 2189 bp, Brachypodium distachyon
cattctgccgctccggctcctctcctcgcgcgcgcttcctctctctctccggcgaggaagcgaaagggcggagagggggagagatctaggagcttctggatccaagtgttctacggggatggcgacggcgccggcgctgcgtctcgcgggggtctcggtgagggggcccgcctccgggctagggagggagagggaggccccgtgcggggctgccaggcctgggctgcaatgctggcggcggagggggctggtgctccgctgccagagcggggccgtggcgactactctaaagaagggcgaggaggcctcctcctcgctggagtcgtccgcggcggaggcggcgcgggacagggcgacggggttcaccgtggttatgaagttcggcgggtcgtcggttgccacggccgagcggatgaaggaggtggccgacctcgtcctcagcttccccgaggagacccccgtggtcgtgctgtccgccatggggaaaaccaccaataaccttctcctggccggagagaaggcggtgagctgcggcgctcccaaggcgtctgaaattgaagagctcgccgtcatcaaggagcttcaccttaggacgattgatgagcttggactagatgaatcgatagtttcaggtttcttggacgaattggaacaacttcttaagggcgttgctatgatgaaagagctgactcttaggacacgagattacctcgtttcctttggcgaatgcatgtccacaagaatatttgctgcacatttgaataaacttgggaaaaaggcacggcagtatgatgcgtttgatcttggttttataaccactgacgatttcaccaatgcggatattcttgaagcaacttatcctgctgttgcaaagaggctacatggagattggattgatgatcctgctattcctatagtgactggtttccttggaaagggatggaaatcctgtgcggtcactactttaggaaggggtggtagtgacttgactgctacgactattggcaaagccttggggttaagagaaatccaggtttggaaggatgttgatggtgtgttgacgtgtgatccaaatatttatgcaaatgcagtaccagtaccctacttgacttttgatgaggcagctgaacttgcatactttggtgcacaggttttgcatccccaatcaatgcgaccagctagggaaggtggtataccagttcgagtgaagaactcgtataaccgccatgcacctggtactgtgatcactaaaacaagagatatgcgcaagagtatcttaaccagcattgtgttgaaatcaaatattaccatgttggatatagtgagcacaaggatgcttggccaatatggttttctagcaaaggtcttctccatatttgaagatttgggtatatctgttgattctgtggctactagtgaagtcagcatatcgttgacactagatccatcaaaactgtggagtcgtgagttaatccagcaggagcttgataatgtagttgaagagcttgaaaagattgccgttgtccatctactacagcacaggtccatcatctccctgatagggaacgtacagagatcgtcactgattcttgagaaggctttcaatgttctacggagaaacggtgttaacgtccagatgatctcgcaaggagcatccaaggtgaacatttccttggtggtccatgacagcgaggcgaaacagtgtgtccaagccctccattcggcattcttcgagaacggcttcttgtcagaagtcgaggaagcagatcttgcacagaacggctccccagtcccagtgaactcgaatggtgctctctatgggaattagtcgacatcgcatttaattttggccatctattgatgtaccgtttcataggttaacaggtgattcgtacctgattatttaggctatctgagcgaattctatggtgttgtaagagcctaacctggaaggagtatggttccgtgtcatatgcaaccgagagtggtagcaaatagcaaatcaaaatgtgtgtgaggtgtgttactcatttgccgaacgtgtggtagtacctgattattggaagtttgcattgcactcttcgggtgtggtagcaagtactccgtagtaactagtaccgtatccttgtattcataccagtgaataaatatgatatgccgatacctcaaggcaacttatggattccgtt

SEQ ID NO: 1742 - DNA, 1909 bp, Triticum aestivum
  misc_feature (97)..(97): n is a, c, g, or t
  misc_feature (124)..(124): n is a, c, g, or t
  misc_feature (148)..(149): n is a, c, g, or t
  misc_feature (151)..(152): n is a, c, g, or t
  misc_feature (157)..(157): n is a, c, g, or t
  misc_feature (172)..(172): n is a, c, g, or t
  misc_feature (188)..(188): n is a, c, g, or t
  misc_feature (190)..(190): n is a, c, g, or t
cgctaggccgggtgggcaatgctgcgcgcggagggggctggtgctccgctgccagagtggggcggccacgctcaagaagggcgaggcggcggatggngccggggcagcggcggggttcaccgtngtgatgaagttcggcggctcgtcnntnncgtcngccgcgcggatgcgngaggtggccgacctcntnctcagcttccccgaggagacgcccgtcgtcgtcctctccgccatgggcaagaccaccaacaacctcctcctggccggagagaaggcggtgagctgcggcgcccccaaggcgtcggaaatctacgagctcgccgtcatcaaggagctccatctcaggaccatcgatgagcttggcctagatagctccattgtttcaggttttttggacgagttggagcaactgctcaagggtgttgctatgatgaaagagctgactcttaggacacgagattaccttgtttcctttggtgaatgcatgtctacaagaatatttgctgcatatttgaataaacttgggaagaaggcacgacagtatgatgcttttgatcttggctttataaccactgacgatttcacaaatgccgatattctcgaagcaacttatcctgctgttgcaaagaggctacatggagattggattgatgaccctgctattcctatagtgactggtttccttgggaaggggtggaaatcatgtgcggtcacaacgttaggaaggggcggcagtgacttgaccgctacaaccattggcaaagccttggggttaagagaaatccaggtttggaaggatgtagacggtgtgttgacgtgtgatccaaatatttatgcaaacgcggtaccagtaccctacttgacttttgatgaggcagctgaacttgcttattttggtgcacaggttttgcatccccaatccatgcgaccagccagggaaggtggtatcccagttcgagtgaagaactcatataaccgtcatgcacctggcactgtgatcactaaaacaagagatatgcgcaagagcatattaaccagcattgtcctgaaatcaaatattaccatgctggatatagtgagcacaaggatgctcggacagtatggctttctagcaaaggtcttctcaatatttgaagatttgggtatctctgttgattctgtggctactagtgaagtcagcatatcattgacactagatccatcaaaactgtggagtcgtgaattgatccagcaggagcttgatcatgtagttgaagagcttgaaaagattgcggttgttcatctcctacagcacagatcaatcatttccctgatagggaatgtgcagagatcgtctctgattcttgagaaggcgttcaatgttctacgcagaaatggtgttaatgttcagatgatttcgcaaggggcgtccaaggtgaacatctccttggtggtgaatgacagcgaggcgaagcagtgcgtgcaagccctccactcggcattctttgagaacggtttcttgtcagaagtagaggaagcggaccttgcgcagaagagggctccagtcctagtaagctcgaatggtgccatcaacggaaactagtcgacgtcgcttttttctacttccagcaacggatgcgccgttcttaggttaagagggtgattcgaccttggattatttaggccacctgagctgattcattggtgttgcacgagcggtattatagctatcattggtgttgtaagagtgagcggcatgattcttcgagtgctagcatatggtagcccaatcaatgtatgtgattgtgaggcgtcctacttgctgaacttaaccattgtgaggagcccctatgaacttatccttgggtgtcttctaccaaatactaaatagtatgtgtgttgttcctcctatttatattagcgaataatt

SEQ ID NO: 1743 - DNA, 1854 bp, Festuca arundinacea
  misc_feature (139)..(139): n is a, c, g, or t
  misc_feature (171)..(172): n is a, c, g, or t
  misc_feature (263)..(263): n is a, c, g, or t
  misc_feature (269)..(269): n is a, c, g, or t
  misc_feature (319)..(319): n is a, c, g, or t
  misc_feature (417)..(417): n is a, c, g, or t
  misc_feature (430)..(430): n is a, c, g, or t
  misc_feature (447)..(447): n is a, c, g, or t
  misc_feature (634)..(634): n is a, c, g, or t
  misc_feature (724)..(724): n is a, c, g, or t
  misc_feature (832)..(832): n is a, c, g, or t
  misc_feature (1378)..(1378): n is a, c, g, or t
  misc_feature (1435)..(1435): n is a, c, g, or t
  misc_feature (1441)..(1441): n is a, c, g, or t
  misc_feature (1462)..(1462): n is a, c, g, or t
  misc_feature (1552)..(1552): n is a, c, g, or t
  misc_feature (1555)..(1555): n is a, c, g, or t
  misc_feature (1561)..(1561): n is a, c, g, or t
ggcacgaggcaggctcgtgagggagagggactctgcgtgcggggccgccaggccgggagcgcaatgctgggcgcgcagggggctggtgctccggtgccagagcggggcggccgccacgacgaccctgaagaagggcgangcccccgcccccgcggtgtcggatgggggcannccgcccgccgcggcggggttcaccgtggtgatgaagttcggcgggtcctcggtggcgtcggcggagcggatgagggaggtggccgacctcntcctcngcttccccgaggagacgcccgtcatcgtcctctccgccatggggaagacnaccaacaacctcctcctggccggggagaaggcggtgagctgcggcgcccccaaggcgtccgagctcgacgagctcaaggccatcaaggagcttcattntaggacgattgangagcttggattagatanctctatcgtttcaggttttttggacgaattggaacaacttcttaagggtgttgctatgatgaaagagctgactcctaggacacgagattaccttgtttcctttggtgaatgcatgtctacaagaatatttgctgcgtatttgaataaacttgggaaaaaggcacgacagtatgatgcgtttgatctnggctttataaccactgatgattttacaaatgcggatattcttgaagcaacttatcctgctgttgcaaagagactacagggggattggatngatgaccctgctattcctatagtcaccggtttccttgggaagggatggaaatcatgtgcagtcactactttaggaaggggtggaagtgacttgaccgctacgaccatnggcaaagccttgggtttaagagaaatccaggtttggaaggatgtagatggtgtgttgacgtgcgatccaaatatttatgcaaatgctgtaccggtaccctttttgacttttgatgaggcagctgaacttgcatactttggtggacaggttttgcatccgcaatcaatgagaccagctagggaaggtggtataccagttcgagtgaagaactcgtataaccgtcatgcacctggtactgtgatcactacaacaagagatatgcgcaagagtatactaaccagcattgtgttgaaatcaaatattaccatgcttgatatagtgagcacaaggatgcttggccagtatggctttctagcaaaggtcttctcaatatttgaagatttgggtatctctgttgattctgtggctactagtgaagtcagcatatcattgacactagatccatcaaaactgtggagtcgtgaattgatccagcaggagctagataatgtagttgaagagcttgaaaagattgcagttgttcatcttctacagcacagatcaatnatctccctgatagggaacgtacagagatcgtccctgattcttgaaaaggcgttcaangttctncggagaaatggtgttaacgtncagatgatctcgcaaggggcgtccaaggtgaacatctctttggtggtccacgacagcgaggcgaagcagtgtgtgcaagccctccactcngcnttcttngagaacggcttcttgtcagaagtcgaggaagcggatatcgcacagaagaacggttccccgttgctggtaaactcgaacggcgccatgcacggaaactagtcgacattgcttttagtttcctgattagagggtgattggtacctgattatttaggccgagcggatcatttgtgttgtaagagcctatatgcatacctcggaaggtgtagggctctgtgttatactactagttagcatgatctaccatccttccatgtgcaatcgagtgctagcaaatggcggcccaatgtgtat

SEQ ID NO: 1744 - DNA, 2116 bp, Avena sativa
ctcctcctcgcgctttcttctccggcccggcgaggaacagagaagcgaggggaggagagatctggaagggatggccgcgctgcgcttcgcggcggtcgcgcgggaggcccccaccgctctctccgccgcctccaggcccgggagggagagggactcgtgtcccctgcgcggggccgccaccagtgcaaggctggtagggcaatgctgggcgcggagggggctggtgctccggtgccagagcggggcgggcgccacgactaccctgaagaagggcggcgaggtctcccccgtcacgccggagacggcgcccgcggctgggttcaccgtcgtcatgaaattcggcggctcctcggtggcgtcggcggagcggatgaaggaggtggccgacctcatcctcagcttccccgaggagacgcccgtcgtcgtcctctccgcgatggggaagaccaccaacaacctcctcctggccggagagaaggccgtgagctgtggcgcccgaatgcggccgagatcgacgagctcaaggccatcaaggagcttcattttaggacgatcgatgagcttggattagatagctctattgtttcaggttttttggacgaattggaacaacttcttaagggtgttgctatgatgaaagagttgactcctaggacacgagattaccttgtttcctttggcgaatgtatgtctacaagaatatttgctgcgtatttgaataaacttgggaaaaaggcacgacagtatgatgcatttgaactcggctttataaccactgatgattttaccaatgcggatattcttgaagcaacttatcctgctgttgcaaagaggctacatggggattggattgatgagcctgctattcctatagtgactggtttcctagggaagggatggaagtcatgtgcggtcactactttaggaagaggtggaagtgacttgactgctacaaccattggcaaagccttgggtttaagagaaatccaggtttggaaggatgtagatggtgtgttgacgtgtgatccaaatatttatgcaaatgcggtaccagtaccgtacttgacttttgatgaggctgctgaacttgcgtactttggtggacaggttttgcatccgcaatcaatgagaccagctagggaaggtggtataccagttcgagtgaagaactcgtataaccgtcatgcacctgggactgtgatcactaaatcaagagatatgcgcaagagtatattaaccagcattgtgctgaaatcaaatatcaccatgctcgatatagtgagcacaaggatgctcggccagtatggctttctagcaaaggtcttctcaatatttgaagatttgggcatctccgttgattctgtggctactagtgaagtcagcatatcattgacactagatccatcgaaactgtggagtcgtgaattgatccagcaggagcttgataatgtagttgaagagcttgaaaagatagcagttgttcatctactacagcacagatcaatcatctccctgatagggaacgtagagagatcgtctctgattcttgagaaggcattcaacgttctacgcagaaatggtgtcaatgtccagatgatctcgcaaggggcgtccaaggtgaacatctccttggtggtccatgacagcgaggcgaagcagtgcgtacaagccctccattcggcattcttcgagaatggcttcttggcagaagtcgaggaagtggatcgtgcgcagaagaacggttccctggccccagttaactccaacggtgccgtgcacggaaactagtcgacattgcttttagtgtcctgattagaggtgattggtacctgattggttaggcccaccctggatagcgaatttatgtgttgtaagagcctatataacgtacctggaaggcgtacggctctgtgttatactacactattagttagcatgacctaccattcttccatgggcaacgggaggtagcagatggcggcccagtgtgtgaggcccgcatgctacttgctggactaatggattattattggaagtttgtagtgcactctttaggcaagtgtgttgtatccatctatttattaccagccaataaattgagcattacgtgccacgt

SEQ ID NO: 1745 - DNA, 2090 bp, Avena sativa
ccggcgaggaacagagaagcgaggggaggagagatctggaagggatggccgcgctgcgcttcgcggcggtcgcgcgggaggcccccaccgctctctccgccgcctccaggcccgggagggagagggactcgtgtcccctgcgcggggccgccaccagtgcaaggctggtagggcaatgctgggcgcggagggggctggtgctccggtgccagagcggggcgggcgccacgactaccctgaagaagggcggcgaggtctcccccgtcacgccggagacggcgcccgcggctgggttcaccgtcgtcatgaaattcggcggctcctcggtggcgtcggcggagcggatgaaggaggtggccgacctcatcctcagcttccccgaggagacgcccgtcgtcgtcctctccgcgatggggaagaccaccaacaacctcctcctggccggagagaaggccgtgagctgtggcgcccgaatgcggccgagatcgacgagctcaaggccatcaaggagcttcattttaggacgatcgatgagcttggattagatagctctattgtttcaggttttttggacgaattggaacaacttcttaagggtgttgctatgatgaaagagttgactcctaggacacgagattaccttgtttcctttggcgaatgtatgtctacaagaatatttgctgcgtatttgaataaacttgggaaaaaggcacgacagtatgatgcatttgaactcggctttataaccactgatgattttaccaatgcggatattcttgaagcaacttatcctgctgttgcaaagaggctacatggggattggattgatgagcctgctattcctatagtgactggtttcctagggaagggatggaagtcatgtgcggtcactactttaggaagaggtggaagtgacttgactgctacaaccattggcaaagccttgggtttaagagaaatccaggtttggaaggatgtagatggtgtgttgacgtgtgatccaaatatttatgcaaatgcggtaccagtaccgtacttgacttttgatgaggctgctgaacttgcgtactttggtggacaggttttgcatccgcaatcaatgagaccagctagggaaggtggtataccagttcgagtgaagaactcgtataaccgtcatgcacctgggactgtgatcactaaatcaagagatatgcgcaagagtatattaaccagcattgtgctgaaatcaaatatcaccatgctcgatatagtgagcacaaggatgctcggccagtatggctttctagcaaaggtcttctcaatatttgaagatttgggcatctccgttgattctgtggctactagtgaagtcagcatatcattgacactagatccatcgaaactgtggagtcgtgaattgatccagcaggagcttgataatgtagttgaagagcttgaaaagatagcagttgttcatctactacagcacagatcaatcatctccctgatagggaacgtagagagatcgtctctgattcttgagaaggcattcaacgttctacgcagaaatggtgtcaatgtccagatgatctcgcaaggggcgtccaaggtgaacatctccttggtggtccatgacagcgaggcgaagcagtgcgtacaagccctccattcggcattcttcgagaatggcttcttggcagaagtcgaggaagtggatcgtgcgcagaagaacggttccctggccccagttaactccaacggtgccgtgcacggaaactagtcgacattgcttttagtgtcctgattagaggtgattggtacctgattggttaggcccaccctggatagcgaatttatgtgttgtaagagcctatataacgtacctggaaggcgtacggctctgtgttatactacactattagttagcatgacctaccattcttccatgggcaacgggaggtagcagatggcggcccagtgtgtgaggcccgcatgctacttgctggactaatggattattattggaagtttgtagtgcactctttaggcaagtgtgttgtatccatctatttattaccagccaataaattgagcattacgtgccacgt

SEQ ID NO: 1746 - DNA, 1829 bp, Triticum aestivum
ggcggcggatggagccggggcagcggcggggttcaccgtcgtgatgaagttcggcggctcgtcgctagcgtcggccgcgcggatgcgcgaggtggccgacctcgttctcagctttccccgaggagacgcccgtcgtcgtcctctccgccatggggaagaccaaccaacaacctcctcctggccggagagaaggcggtgagctgcggcgcccccaaggcgtcggaaatctacgagctcgccgtcatcaaggagctccatctcaggaccatcgatgagcttggcctagatagctccattgtttcaggttttttggacgagttggagcaactgctcaagggtgttgctatgatgaaagagctgactcttaggacacgagattaccttgtttcctttggtgaatgcatgtctacaagaatattttctgcatatttgaataaactagggaagaaggcacgacagtatgatgcttttgatcttggctttataaccactgacgatttcacaaatgccgatattctcgaagcaacttatcctgctgttgcaaagaggctacatggagattggattgatgaccctgctattcctatagtgactggtttccttgggaagggatggaaatcttgtgcggtcacaacgttaggaaggggcggcagtgacttgaccgctacaaccattggcaaagccttggggttaagagaaattcaggtttggaaggatgtagacggtgtgttgacgtgtgatccaaatatttatgcaaacgcggtagcagtaccctacttgacttttgatgaggcagctgaacttgcttattttggtgcacaggttttgcatccccaatccatgcgaccagccagggaaggtggtatcccagttcgagtgaagaactcatataaccgtcatgcacctggcactgtgatcactaaaacaagagatatgcgcaagagcatattaaccagcattgtcctgaaatcaaatattaccatgctggatatagtgagcacaaggatgctcggacagtatggctttctagcaaaggtcttctcaatatttgaagatttgggtatctctgttgattctgtggctactagtgaagtcagcatatcattgacactagatccatcaaaactgtggagtcgtgaattgatccagcaggagcttgatcatgtagttgaagagcttgaaaagattgcggttgttcatctcctacagcacagatcaatcatttccctgatagggaatgtgcagagatcgtctctgattcttgagaaggcgttcaatgttctacgcagaaatggtgttaatgttcagatgatttcgcaaggggcgtccaaggtgaacatctccttggtggtgaatgacagcgaggcgaagcagtgcgtgcaagccctccactcggcattctttgagaacggtttcttgtcagaagtagaggaagcggaccttgcgcagaagagggctccagtcctagtaagctcgaatggtgccatcaacggaaactagtcgacgtcgcttttttctacttccagcaacggatgcgccgttcttaggttaagagggtgattcgaccttggattatttaggccacctgagctgattcattggtgttgcacgagcggtattatagctatcattggtgttgtaagagtgagcggcatgattcttcgagtgctagcatatggtagcccaatcaatgtatgtgattgtgaggcgtcctacttgctgaacttaaccattgtgaggagcccctatgaacttatccttgggtgtcttctaccaaatactaaatagtatgtgtgttgttcctcctatttatattagcgaataattat

SEQ ID NO: 1747 - DNA, 2644 bp, Solanum phureja
ataataattgatttttaatttctgggtacttttctattgaagtttcttgttgagcaagttgagagctgagaccattttacctttctccggcgaaattcaagttctctacatttctttctttgccggaaccctaaattttagtgtctggttttaagaattcacaatgtcaagaagatatgacagccgcacaactatcttctcccctgaaggtcgtttatatcaggttgaatatgcaatggaagctattggaaatgcaggcagtgcaataggtatcttagctaaagatggtgtggtgttggtaggtgaaaagaaggtcacttcaaagcttctccagacctcgacatccaccgagaagatgtacaagattgacgaccatattgcctgtgctgtggctggaatgatgtcagatgccaacatcctcattaacactgcgagggttcaagctcaacgctatacttttgcttatcaagaaccaatgcctgttgaacaactagttcagtctctgtgcgacaccaagcaaggctacacacagtttggtgggcttcgtccatttggtgtttcctttctttttgcaggctgggacaagaactatggctttcaactgtacatgagtgatccaagcggcaattatagtggttggaaagctgcagcaattggggccaacaatcaaccagcacagtcatttgagcatgtttcagctatctgattactggataagctgttcactgacttgtccataaattcatgcctagatattttctgtctttattcacttccttagatggcaaagtccgctgccttgtgctaatgagaaattggaaatacatttgggtactttttggtgctttagtaataggtgtggtgcagtctcctatatgcttgttatgtttgataatgatattctgactcagtgctgggtaatagtcgaaaacatgaagcattagagcccatcaccttcagttttttataagaggcctcgaatttggagacgtatttttaatgaaaaaatgcaatgatctgggaattttatttagtgccacaccttaccacaaattgataccactttgtatcaatttaggggttgttaggacccgtcaaacttaaagtatatagtaataattagaaagatgacagagaaagtttgactgggttcttataaaaataagggaacagataaaatagcgcagtattccattaaaaaaattctgattttatgaccaattggttgtattctcagttctccagctatatatatatgtccaagtccaaccaccccgtctccttcacgtgatttttcttgggaattgcatcaaacaaaacaaacaacaagtagcctagatttgcttcttacagataaccatggctgaaactcatgaaacagttttcaagtcagtacaagaactagcaaatgacaatcaagttccagaaaagtatattcatacacaagggtcaatcaatagctcttctcctctgctggatgtgccagtggttgaccttagccttctcacatcgcctgccagacaacaagagctcaacaaacttcaatcaggcctcgagttttgtggctgcatccaggtcataaatcacggactagttgattcatttcttgacaaagtgcatgaaattagcaaacagttctttgctcttccagctgaagagaagcttaaatatgccagaacagttgatgacatttatggatacggaaacgattcagttctttcagataagcaaaagcttgattggactgacagattgtatctaaatgtgttccctgaagatataagaaacctcaaattgtggccccaaaaacctgaatgtttcagggaagttcttgaggaatatatcaagaatatgaagttgttgagtgagtccctcctaaaggccatggcagcatcattgaacttggaggagaactgctttctggaccagtgtggagaacgcggagatatgattgcaagattcaacttctatcctccgtgtccaacacctgaggttgtactcggagtcaaaccacatgctgatgcatcggccattaccatcctgttgcaagacaaagaagttgaggggcttcaggttctcaaagatgatcaatggttcagagtgcctattgtcccatatggtctactcgttaatgttggagatcaagttgagataatgagcaatggtatctttaagagccccgtgcacagggtggtgacgaatgcagaacgagaaagaaacacccttgctgttttcattatgccagatgtaactgttgggattggaccagtggagaagcttatcaatgaggaaaggccaagagcgtataaggacgttaagaattatgttgaactcttcttccaaagctatcagcacgggaaaagaccaatcgaaacagcaatgatatgccaagaacaagattagctgccaacaaatcttgcttttccatcaaacccccgctgacagtatgtttgtccttcttttttctctatttgtatttttactagtcgttgttacctgtgctgtacacgagctcaacatgctttgagaaatgcaagctcttgaataggggtttgatctggaacctattgttattcatttacaaaatataccacattcacaatatttccaaacaggatgaactgaaagttgctttgcgacagaa

SEQ ID NO: 1748 - DNA, 1315 bp, Solanum lycopersicum
acactattttcaagggcctactgtccaatcaccccatctatgtattgattttcttgggatatatttgagaaacaaagcaaaacagtaagatgtgcaaccacctaacatttgcttcgtacaaaaaaaattatggctgaaactcaagaaacagtttccaaatcagtacaagaactagcaaataccaatcaagttccagaaaagtatatttatgcacaaggatcaatcaatacctatcctcttttgttcgatgtgccacaagttgatcttagccttctcacatcccctaacagacaacaacagctcaacaaacttcaatcaggtctcaagtcttgtggctgtatccaggtcataaatcatggaatggaagattcatttcttgacaaagtgcgtgaaataagcaaaaagttctttgctcttccaactgaagagaagcttaaatatgcaagaacagttaatcaaattgaaggatacggaaatgataaagttcttacagataagcaaaggcttgattggtccgatagactgtgtctaaatgtgttccctgaagatataagagaactccgattctggccacaaaaacctgaatgttttagggaagtttttgaagaatatatgaagaatatgaagttgttgagtgagtccctcctaaaggccatggcagcgtcattgaacgtggaggagaattgctttctggaccagtgtggagaacgtggaacgactactgcaagattcaacttctaccctccgtgtccaagacctgatgtggtactcggagtcaaacaacatgctgatgcatcggccattaccatcctgttgcaagacaaagaagttgaagggcttcaggttctcaaagatgatcaatggttcagagtgcctgttgtcccatatggtttactcatcaatgttggagatcaagttgaggtaatgagcaatggcatctttaaaagcccggtgcacagggtggtgacgaatgcagaacgagaaagaaacacccttgctgtcttcattatgccagatgtacatgttgggattggaccagtagagaagcttatcaacgaggaaaggccgagagggtacaaggacattaagaattatgttgctctcttcttccaaagctatcagcaggggaaaataccaatagaagcagcaaagataagccaagaatttcattagctgatgttggttccttcttttcctctatttgtatgtttactagtcgtggttgcctgtgctgcgcacgagcccaacactaagatctggacatgctctaagaagggcaagctcttgaatataagcaagacaacggattgatcta

SEQ ID NO: 1749 - DNA, 1768 bp, Solanum phureja
actttatttgaaaaagcatcataaattttttaaattcaactgaaagttgcattttaaatttagaaaacagtttataacttgttttctaattcatttttattttaaaaattatatttaacattattcgaaatattctttataaaaaatataattaaacaaaccttttattttgaaataatgtttatgctcaaatttacttaaatataattttaaaagcagaaatacataaaaaaaaatagtttagctaaaaaatatccctactgtcccatataagatcattttgaactaaactattagcagatgacaaaaattaattgaacttacaactctagcgtgaaaaacattttcacagtttctttcttaccattaaaccatcaatcaattttgttagagttcacaagttaatatacatatatatttaattaaatttttaatataaatacagagtctaaccaaaagatactgaatttgtcttagtccacaaatcccacctagctttggatatatcatatattgagaaacgaagtaaaggataagatgtacaactagctaacatttgcctcttacaaaaataaaaaccatggctgaaactcaacaagaaatagttttcaagtcagtactagaactagcaaataataatcaagttccagaaaagtatatttatgcacaaggatcaatcaatacctctcctcccctgctggctgtgccacaagttgatcttagccttctcacatcccctaacagacaacaagagctcaacaaacttctatcaggtctcaagtcttgtggctgcatccatgtcataaatcatggaatagaagattcatttcttgacaaagtgcgcgaaattagcaaacagttttttgctcttccaactgaagagaagcttaaatatgccagaacagttaatcaaacagaaggatatggaaatgataaagttcttacagataatcaaaggctggattggtccgatagattgtatctaaatgtgttccctgaagatataagaaaactccaattctggccccaaaaacctgaatgttttagggaagtttttgaaaaatatatcaaggatatgaagttgttgagtgagtccctcctaaaggccatggcagcgtcattgaacgtagaggagaactgctttctggaccagtgtggagaacgcggaaacatgattgcaagattcaacttctatcctccgtgtccaaggcctgatgttgtactcggagtcaaacaacatgctgattcatcggctattaccatcctgttgcaagacaaagaagttgaagggcttcaagttctcaaagatgatcagtggttcagagtgcctgttgtcccgtatggtttactcattaatgttggagatcaagttgagataatgagcaatggcatctttaagagccccgtgcacagggtgttgacgaatgcagaacgagaaagaaacacccttgctattttcattatgccagatgtagatgttgggattggaccagtagagaagcttatcaatgaggaaaggccgagagcgtacaaggacattaacaactatgttgcactcttcttccaaagctatcagcaggggaaaagaccaatagaagcagcaaagataagccaagaacttcattaggtcgtatgttggttccttcttcctctatttgtatttttactagttgtggttgcttgtgatgtgtacgagcccaacactaagatctggacatgctctaagaaatgcaagctcttgaatatgagcaagacaacggtttgatct

SEQ ID NO: 1750 - DNA, 1475 bp, Quercus alba
gagcgagcgagcgagagagagagagagatcggagatgtgggaatcgattcttttaacgttagcagcaaccgccggaaacaacatcggcaaagttcttcagaaaaagggcaccgtcattcttcctccactctctttcaagttcaaggtgataagggcatatgctttcaacaaatcttggttggttggttttctaatggatatctttggagcaatgttgatgttgagggcactctctcaagctcctgtatctgtcatccaaccagtttctggctgtggacttgctattctttctatcttttcgcatttttacctaaaggaagtcatgaatgctattgactggatggggattactttggcgggtattggtaccataggagtcggtgctggaggtgaggagcaagatgctacttccatatctattttacatttaccatggctggcattcattgttgccatcttgtttgtacttcttaatggatggcttcggatttacagacgccaacgaagagaacaggagatgatggaatttgaagttgttgaagaaattatatatggcttggaatctggcattttgtttgggatggcatctgtaatatcaaagatgggatttgtattttttgagcagggcttccatagcatgctggtaccgatctgcatatcaatcagtgtatgttgtagcggtacaggattttattatcagactcgtggtctaaagcatgggagagcaattgtagtatccacatgtgcagctgttgcatcaattgtgactggtgttcttgctggtatgctggcattaggtgaacgattgccttcagcaccaacagctcgtttttcacttctgcttggatggttactcattattttgggcgtgattttacttgtgacttcaacgcggctgcttagacaccttccacggccattacgtgattttattcaaagtggtgttgacaggaatttcaaccttagacgatccggatctgcccgtgttagggatacaaacccaagtgctgttatccaggcagcaacattacattctttgatatcatccccttctaaagagaaggcttgaattgacaacgatggggagattgttgcatacacaactatgttaagattcttgttgacaggcttgtacatggcatgaaaagtagctccatttggtctctaattgaggttggggtgtatagtaccgttcatctgctcattcgtttttagaggttgaaaattttttttagatcattccttctgtcagacatctcttactagatatattgttgtacctgtttgaaactcttgcctcctacattccatatagtctcaagtttttgttttttgtttttttggttacttcaaggatgatgatcttagtgactagatatggaatggtaaacaggctttggttcacgtgcaagtgacttgaggcagaatgatttcaagctctttttttttaacagtgggggcaatactcgcgatat

SEQ ID NO: 1751 - DNA, 1499 bp, Mimulus guttatus
tttcaagaaaacgacagcccaacaaaatccctaagaattcaatcggttaatcgacggaaattcgacggagatctgtgataatcgacagagatcttcgcaggttgctcatatatatacattacaaattcacgcaatctcacttatttttttgtaagattatatcgaatgcgtcaatcgatagagcaataaagaaagaaattagcaaagaagaaaaaaaaaaggcaaaagggaggtggagggggagcgatgtgggaatcgatttgcttaacggtggcggccaccgccggaaataacatcggaaaagtcctccagaagaaaggcaccctcattctcccacctctctctttgaagctcaaggtgataaaagcatatgcttccaacagagattggatactcggcttcttgatggatattttcggagctgttttgatgttgctagcactttctcaggcccctgtgtcagtcattcaacccgtttctggctgcggacttgctattctttccgtcttttcccatttttatctcaaggaaatcatgaatgctattgactggataggaattgctttggccggtatcggcactataggtgtaggtgctggaggggaagagcaaaagtcgtcttccatctcggtttttcatttaccgtggctcgcatttgtcgttgctttcttgtttgtacttcttaatggatggcttcgtgtttatagacgccaaagaagagaacaagagttgatgcaatatgaagtggttgaagaaatcatttatggtttacaatccggcattttgttcgggatggcatctgtaatatcgaagatgggatttgtattcttggagcagggtttttctaagctattactccccatttgcgtttcaatcagcatttgctgtagtggttctggatttgtttaccagacccgtggtttaaagcatggaagggcaattgttgtgtccacgtgtgcagctgtggcttcgattgtgacaggtgtacttgctggcatgtttgcattgggtgaaagattgccttcagctcccatggctcgactaacgcttcttcttggatggctatgtattattgttggtgtgattttgttggtaacttcaacaaggctggttagacaccttccaaggccatggagaagatttgcaagaaatggtacagagaggaacttcgggctcaggcagacgggcctggcccgtacaagagattctaatcctagtgcggttatccaaacaaccacgctccatcaattaatgtcgtcgccctcaaaagctaaatcttgagtttttatagacatttaaaaaaggggaaaaaatgctaacaaattaaaaaagacttgtttcggctcatgaacatgtaattcgttagattcaacttaaaaggctatttgtttgaacgtttcgttggttcgtttgttttgagtgtataaatgtacagtgataattggagctatcaagattgtttgttttcagcttatatatttgataaacaaattgaacac

SEQ ID NO: 1752 - DNA, 1995 bp, Triticum aestivum
gagcagcagcagcacaccagaccacagcccacgctcactgtccatggaaaggacgcagggcttcttcgcggcgctcaagcaggaggtggcgcgcgggctgtcgccggcgagggcgcgccggaggtccgactcggccgacctcgacgccactgcgctccggttctccggcccgggggagatgctggcgccgctcatggaggggcccgatccggagtccggcgacggggacgcccgcgccgccgccggcgccaggagggagggctggggccgctgggtgcgcgggcagctcgcgcggacgccgtcctcggtcgccgccgcggcggccggcgccggcgccgcccgcaacgacctccgcctcctcctcggcgtcatgggcgcgccgctcgcgcccgtgcacgtctgcgccgccgagccgctcccgcacctcagcattaaggacacccccatcgagacctcgtcggcgcagtacattctgcagcagtacctggcggcctctggtgggcacaggctcctcgcctctgtgcgcaactcctacgccatgggcaaggtgcgcatggtggccactgagtttgagaacgccggccgcctggtcaagaaccgcaatgcggctcgctgcgccgagccaggccgcttcgtgctgtggcagatggctcctgagaagtggtacatcgaactggctgtcggtgggagcaaggtgcatgctggctgcaatggcaagcttgtgtggcgccacaccccgtggctcggctcccatgccgccaaaggccctgttcgccccctccgccgtgctctgcagggcttggatccactcactgcagcaagcatgtttgccggtgcacggtgcatcggtgagaggaaggtgaacggggaggattgcttcattctgaagctgtgcactgaccctgagaccctcaaggcacgcaccgagggcctcgcggagatcatcaggcatgtcatgttcgggtacttcagccagaggaccggccttcttgtccacattgaggactcacacctgacgcggattcagtcaacaaccggtggggatgcggtctactgggagaccaccatcaactcattcatcgaggactaccggccggtggatggcatcatgattgcgcactccgggcgctcggccgtgaccctgttccgcttcggcgaggtggccatgagccacaccaagactcggatggaggaggcgtggagcatcgaggaggttgcgttcaatgtccctggcctgtccatggattgcttcatcccacccaccgatatcaagtctggatctgttagtgagaccgtcgagctccctcatggtggtgagaagaacaagtttggtcctccccctggtcaccgtgccaaagttgctgcgctggagaagacggatggtggcgagctagcatggaggggaacccatacctgaaaatcgaaattgattttcaggccattgatacttgcttcttttcattgcaactgactgatgagtagtgtagagagaaacaggtcgacgggggatttcgattttggaaattccaaatgacctctgtgtacaggaaggaagcagcatgaggcattcacatggtgtgaagaatcgtttctaatctcttcaagggggagcggcagtaggtaaccctgtttgctatttcaggcttttttgtcagtatcatgtggaagacttggtgcgttccccattccaacaactctacctgagaaagctcatcgtggtggcgctgtttgctcccctttagcaaatactaattggtcagtgacactacatccaattggctgctcagtttgctaattgctatgcttggtgatggttcctggtgaagctaaccatgtcagaggagcgcaacctcttaggttttccatagttcttccttccttcgcatctcatctcttatttttcctgagatgaaggttgttgtactcattgacagaagctttgcttgtttccttgtaatccaaaacatttacatgagtgaagtgtcttgtgatgtc

SEQ ID NO: 1753 - DNA, 1935 bp, Triticum aestivum
  misc_feature (95)..(95): n is a, c, g, or t
  misc_feature (98)..(99): n is a, c, g, or t
  misc_feature (106)..(106): n is a, c, g, or t
  misc_feature (132)..(132): n is a, c, g, or t
  misc_feature (134)..(134): n is a, c, g, or t
  misc_feature (150)..(150): n is a, c, g, or t
  misc_feature (176)..(176): n is a, c, g, or t
  misc_feature (240)..(240): n is a, c, g, or t
  misc_feature (246)..(246): n is a, c, g, or t
  misc_feature (260)..(260): n is a, c, g, or t
  misc_feature (288)..(288): n is a, c, g, or t
  misc_feature (290)..(291): n is a, c, g, or t
  misc_feature (294)..(297): n is a, c, g, or t
  misc_feature (435)..(435): n is a, c, g, or t
  misc_feature (446)..(446): n is a, c, g, or t
  misc_feature (504)..(504): n is a, c, g, or t
  misc_feature (528)..(528): n is a, c, g, or t
  misc_feature (579)..(579): n is a, c, g, or t
  misc_feature (612)..(612): n is a, c, g, or t
  misc_feature (672)..(672): n is a, c, g, or t
  misc_feature (700)..(700): n is a, c, g, or t
  misc_feature (739)..(739): n is a, c, g, or t
  misc_feature (759)..(759): n is a, c, g, or t
  misc_feature (786)..(786): n is a, c, g, or t
  misc_feature (789)..(789): n is a, c, g, or t
  misc_feature (822)..(822): n is a, c, g, or t
  misc_feature (843)..(843): n is a, c, g, or t
  misc_feature (861)..(861): n is a, c, g, or t
  misc_feature (876)..(876): n is a, c, g, or t
  misc_feature (927)..(927): n is a, c, g, or t
  misc_feature (930)..(930): n is a, c, g, or t
  misc_feature (939)..(939): n is a, c, g, or t
  misc_feature (954)..(954): n is a, c, g, or t
  misc_feature (978)..(978): n is a, c, g, or t
  misc_feature (1167)..(1167): n is a, c, g, or t
  misc_feature (1185)..(1185): n is a, c, g, or t
  misc_feature (1206)..(1206): n is a, c, g, or t
  misc_feature (1262)..(1262): n is a, c, g, or t
  misc_feature (1269)..(1269): n is a, c, g, or t
  misc_feature (1290)..(1290): n is a, c, g, or t
  misc_feature (1345)..(1345): n is a, c, g, or t
  misc_feature (1347)..(1347): n is a, c, g, or t
  misc_feature (1364)..(1364): n is a, c, g, or t
  misc_feature (1378)..(1378): n is a, c, g, or t
  misc_feature (1395)..(1395): n is a, c, g, or t
  misc_feature (1444)..(1444): n is a, c, g, or t
  misc_feature (1446)..(1446): n is a, c, g, or t
  misc_feature (1907)..(1907): n is a, c, g, or t
  misc_feature (1910)..(1910): n is a, c, g, or t
cgcggcctgccatggcgtcgacccacgcgtccggtggcgcgcgggctgtcgccggcgagggcgcgccgcaggtccgagttggccgacctcgacgncgnngcgctcnggttctccggcccgggggagatgctngngccgctcatggagggncccgatccggagtccggcgacggcgncggcgccggcgccaggagggagggctggggccgctgggtgcgcggccagctcgcgcgcacgccntcctcngtcgccgccgcggnggccggcgccggcgccgcccgcaacgancnncgnnnnctcctcggcgtcatgggcgcgccgctcgcgcccgtgcacgtctgcgccgccgagccgctcccgcacctcagcattaaggacacccccatcgagacctcgtcggcgcagtacattctgcagcagtacctggcggcctcnggtgggcacangctcctcgcctccgtgcgcaactcctacgccatgggcaaggtgcgcatggtggccacngagtttgagaacgccggccgcctngtcaagaaccgcaatgcggctcgctgcgccgagccaggccgcttcgtgctntggcagatggctcctgagaagtggtacatcganctggctgtcggtgggagcaaggtgcatgccggctgcaatggcaagcttgtgtggcgccanaccccgtggctcggctcccatgccgccnaaggccctgttcgccccctccgccgtgctctgcagggcntggatccactcactgcagcnagcatgtttgccggtgcacggtgcatnggngagaggaaggtgaacggggaggattgcttcatnctgaagctgtgcactgacccngagaccctcaaggcacgnaccgagggcctcgcngagatcatcaggcatgtcatgttcgggtacttcagccagaggaccggcctnctngtccacatngaggactcacacctnacgcggattcagtcaacaaccggnggggatgcggtctactgggagaccaccatcaactcattcatcgaggactaccggccggtggatggcatcatgattgcgcactcggggcgctcggccgtgaccctgttccgcttcggcgaggtggccatgagccacaccaagactcggatggaggaggcgtggagcatcgaggaggttgcgttcaatgtncctggcctgtccatggantgcttcatcccacccaccganatcaagtctggatctgttagtgagaccgtcgagctccctcatggtggtgagaagancaagttnggtcctccccctggtcaccgngccaaagttgctgcgctggagaagacggatggtggcgagctagcatggaggggancncatacctgaaaatcganattgattttcaggncattggtacttgcttcntttcattgcaactgactgatgagtagtgtaggagagaaacaggtcgacngnggatttcgattttggaaattccaaatgacctctgtgtacaggaaggaagcagcatgaggcattcacatggtgtgaagaatcgtttctaatctcttcaagggggagcggcagtaggtaaccctgtttgctatttcaggcttttttgtcagtatcatgtggaagacttggtgcgttccccattccaacaactctacctgagaaagctcatcgtggtggcgctgtttgctcccctttagcaaatactaattggtcagtgacactacatccaattggctgctcagtttgctaattgctatgcttggtgatggttcctggtgaagctaaccatgtcagaggagcgcaacctcttaggttttccatagttcttccttccttcgcatctcatctcttatttttcctgagatgaaggttgttgtactcattgacagaagctttgcttgtttcctttaatccaaaacatntanatgagtgaagtgtcttgtgatgtca

SEQ ID NO: 1754 - DNA, 2071 bp, Brachypodium distachyon
atggaaaggaggcagggcttcttcgcggcgctgaggcaggaggtgtcgcgcgggctgtcgccggcgagggcgcgccggaggtcggaagccgcggagctggacgccgcgctcaggtcctccgccgcgcccgggggtggcgagatgctggcgccgctcatggaagggcccgatccggagtccggcgacggcgacggcgggggcgcgggaggcgcgagcgcgaggaaggaagggtgggggcaatgggtccgcggccagctcgcgcggacgccgtcctcggtggcggccgcggcggcggccggcgccggcgcggctcgcaacgacctcaggctgctcctcggcgtcatgggcgcgccgctagcgcccgtgcatgtctctgccgccgagccgctcccgcacctcagcattaaggacactcccatcgagacctcgtcggcgcagtacattctgcagcagtacctggccgcttctggtgggcaaaagctcctcgcgtccgtacgcaatacctacgtcatgggcaaggtgcgcatggtggccaccgagtttgagaacgccggccgccttgtcaagaaccgcaacgccgctcgcggtgccgagccaggccgcttcgtgctttggcagatggcccctgagatgtggtacatcgaactagctgtcggtggaagcaaggtgcatgctggctgcaatggcaagcttgtgtggcgccataccccgtggctcggatcccatgctgccaagggccctgttcgcccgctccgccgtgcacttcagggcctggatccattgaccgcagcaagcatgtttgctggtgcacggtgcattggggagaggaaggtgagcggggaggattgcttcattctgaagctgtgcactgaccctgagaccctcaaggcgcggactgagggcctcgcggagatcatcaggcatgtcatgtttgggtatttcagccagaggactggccttctcgtccacattgaggattcacatctcacgaggattcagtcaacaactggcggggatgcggtctactgggagacaaccaccaattctttcatcgaggactaccggccggtggatggtatcatgattgcgcactctgggcgctcggctgtgaccctgttccgttttggcgaggtggccatgagccacaccaagactcggatggaggaggcatggagcattgaggaggttgcgttcaatgttcctggtctgtccatggattgtttcatcccacccactgatatcaagtctggatctgttggtgaaactgtcgagctttctcatggtgagaagagtaagtttggccctcccccaggtcatcgtgccaaagttgccgcattggagaaggcagatgatcgcgactgatttgtaaacctttcatacttgcttgttacattgcagttgaccgactttgataaatttagtgtaggagactaaggagagagtcgaaggagaactttgagtttggaaattccaaatgacctctgtatataggaagtagcatgagaagttcacaaggtcttgcatatccttgaggaggttctatgtcaagaatctggcctaatctcatccggagtcatggtagtaggcaatcttgtttgctgcttcagggtttttgtcagtatcatgtggaagaacttggtgcgtcccccattctaaccacctgagaaaggtcatcgaggtgatgctgtttgttctcttttagcaattctaattagtcactggcgtcagcaggaagaaggatttcctcgccggtaactgacagtgatttagtcttctgtcattgcatacaattgactgttcagtgtggtgtgcttcgtgatggttcctggtcaagctaacttatctgaaaagtagaacctcttaatggctgttacctcttttgttttcaatattagcaaatatatttgtgagaaccttccttcgcatctctcttatttttcatgagatgaaggttgcattcaacagcagttttttgtaatccaaaacatctaatgagtgccatcggttgaactgttctgtgatgacccctgttttgcacactccaggaatgattttggctttctggacgttg

SEQ ID NO: 1755 - DNA, 2388 bp, Triticum aestivum
gaggtcacacactcggcgctgcgcctccagtctgctcccagcccttttccggcccagccccctcggcttggcttatattcgcaccccactccacacccccctctctttgtcgccaacacaagctacacactggcctgaggctttgtcttgggaaggcgctcgtggtctcgggtaatcgcgacaaggtccctgccaccggccatggacaagaagcagggcttcttctcggcgctgcgggaggaggtggcccgcgggctgtcgccggcgcgggcgcggcggagggccgaggaggtggcggcggcgaaggcggcactgcggtacgcggggggcggcggcggggaggcgctcgcgccgctcatggagggcccggatccggaggaggccggcggcggcgagggcgccgggcgcgcgcgcagggacgggtgggggcgctgggtgcgcggccagctcgcgcgcgccccgtcgtccgggcccgtggcctccggcggcggcgccggcgcggcgaggcggaacgacctcaggatgctgctcggggtcatgggcgcggcgctcgcgcccgtgcatgtctgcgccgccgagccgctcccgcacctcagcatcaaggacacccccattgagacttcgtcggcgcagtacattctgcagcagtatctggctgcctccggcgggcagaagctcctctcttcagtccgcaactcgtatgccatggggaaggtgcgcatggtggctaccgagtgcgagacagcggggcgtgtcgtgaagaaccgcatggcggcgcgctgtgctgaaccaggccggttcgtgctgtggcagatggctcccgagatgtggtacattgagctggctgttggtgggagcaaggtgcacgccggatgcaacggcaagctcgtctggcgccacactccatggcttggtgcacattctgccaagggacctgtccgccctctccgccgctcgcttcagggtctggatcctttgaccacggcgagcatgtttgctggtgcacgctgcattggcgagaggaaggtgaatggggacgattgcttcattctgaagctgtgtgctgatcctgagacgctaagagcacgcagcgaggggctcgcggagatcatccggcatgtcctctttgggtacttcagccagaagaccgggcttcttgtccacctcgaggattctcacctcactcgaattcagtccacaaccggaggtgatgcggtttactgggagactaccatcaattcgttcatcgaggactaccggccagtggaggggataatgattgcacatgctgggcgctcggccgtgaccctcttccgtttcggagaggtggccatgagccacaccaagactcgcatggaagaggcatggagcatcgaggaggtggcgttcaatgttcccggtctctccatggattgcttcatcccacccactgatatcaagtctggatccatcagtgagaccatggagcttccgcagagtgggaagagcaaggccggtggtcttctcccgtgccatggtgccaaggttgctgctctagagaaggccgatgataatgttgcgtggagcggagccctgcagcgagattgcaagtgatttcctggtctgttcatactgctgcttgcagtgctactgactcattttgatgaatgtagggtagaaagagaagggcaaaaggaggatttggatctttgaaattccaaatgccccctgtaaatagggaaggttaagcagtcacatggtcttcctcttccatatccctgaccctgaggagaggccctgtgtgaagaatcctttctgatctcattcagagataatggtgtagtaggcagtctttctgggttttttttttgccagtgcctgtggaagaagaaccaggggtgttctcctccatccatccagccacatgattaaccatcatggtggtggtgctgctctttccttggtagcaatactaattatcagaggccagcgaggaagaaggacttcttcgtcggcagccgagagtgatttcatcgttcctaattagcagtccagtgtgctttggtttgtgatagtctctggtcaaactaacttttaggggagactggaaggtccagagtggttgttgctcttattttaatagtgttccatatcatgggtccgtcggtctagctgtttttttctctccctttctccttcacacatctctctttatttagtatgagatggtggtattgtattttacaggagctgctgatgtatgccaaaaacttctatgaatggattgaggtgtttttccgtttgtgcactccttcttcaaccccacttttactattacatgctgaagtgttggtgatatttagctttgtgatgtgccatattgtagtaccataatgcagcatcagtggg

SEQ ID NO: 1756 - DNA, 2274 bp, Oryza sativa
ggcaaccgtataagcccaccgcagtctcctcgcttcacacactcctcgctccactgccatttcccgcgtagccccctcggcttctcttacatttacattcaggtcctccccccctcacggttcttcacgcgcgcgagggcccctttgttttctcgtatttacaaacaggtccctcccatggacaagaagcagggcttcttctccgcgctccgggaggaggtcgcccgcggcctctcgccggcgcgcgctcgccgccggtcgcaggcggccgccgcggcagaggtggccgcggcgctgcggtacgcgggaggtggtggtgggggggagatgctggcgccgctcatggagggcccggatccggagtcgggagacggcgggagatcgtcgtcgtcggcggcggcggcgaggagggaagggtgggggcggtgggtgcgcggccagctgtcgcgcgcgccgtcgacggccggcgcggcggtggtcgcggcgggtggtggcggcggcgcggcgaggcggaacgacctgaggctgctgctcggcgtcatgggcgcgccgctcgcgccggtgcacgtcgccgccggcgagccgctcccccacctcagcatcaaggacacccccattgagacctcgtcggcgcagtacattctgcagcagtatctggctgcctccggggggcagaagctgctgtcatcggtgaggaactcgtacgccatgggcaaggtgaggatggtggcgacggagttcgagaccggcggccgcgtggtgaggaaccgcatggcggcgcgcgccacggagtccggccggttcgtgctgtggcagatggccccggagatgtggtacattgagctcgccgtcggcgggagcaaggtgcacgccggctgcaatggcaagctcgtgtggcgccacacgccgtggctcggcgcgcattccgccaagggccccgtccgccctctccgccgcgcactccagggcttggatcctctgaccgcggcgagcatgtttgccggtgcgcggtgcattggcgagaggaaggtgaatggggaggattgcttcatcctgaagctgtgcgcggaccctgagacgctaagggcgcgcagcgaggggcttgcggagatcatccggcatgttctctttgggtatttcagccagaagactggcctccttgtgcatcttgaggattctcacctcaccaggattcagtccaccaccggaggggacgcagtttactgggagaccaccatcaattcgttcattgaggactaccgcccggtggagggtataatggttgcgcacgctggtcgctccgctgtgaccctcttccgtttcggagaggttgccatgagccacaccaagactcgcatggaggaggcatggagcatcgaggaggtcgcgttcaatgtccctggcctctccatcgattgcttcatcccgcccaccgacatcaagtctggatccatcagcgagaccgtcgagcttcctcatggcgagaagagcaaggttggtcttctccaatgccatagtgctaaggtggccgcgttggagaaggcagacgacaacgtcgcgtggagcggagcactgcagcgagatttcaagtgatttgctgtctgttcatagttgcttcttgcagtgccagtgctactgactcattttgatggttgtagggtagcaagaaagagccaagggaggatgatttggagctttgcaaattccaaatgtcctgtaaataggaagcttaaggaattcacatggtcttccatatccctgaggaggcctattgtgaagaacccttacctatcttattcagatatatggtagtaggtagttgttagtaacttctggcgtttttttttgtcggtgccttgtggaagaaccaggaggggtgtttctcatcctgcacccaaccacatggtaagggatcatggtggtggtgctgttctttctcttatagcgatactaatttatcggagcccagcgaggaagaagggtttcttctctggcaattgagagtgattttattctgattttagcagtccagtgtgcttttggttggtgatagtctccggtcaaaactaactttaggtgaaagattaagagttctgaattgctgttgctctttgtttagggttatcatgatgggtctctggttgtttttttccctgtccttccttcacatctctctttatttagtatgagatggtggttgtattctacagaagttgatgtaagccagaacttctaatgaatatcatggaatgaattgtttctttttgtggctta

SEQ ID NO: 1757 - DNA, 2227 bp, Sorghum bicolor
ctctcattcctcggccacagcgcggccaccagacgcccaccaaagtttccgctattcgccaaaaggtccccggcgctgcccgccatggaaaggcggcacggcttcttcgcggcgctgcgggaggaggtggcgcgcgggctgtcgccggcgcgggcgcgccgcaagtcggaggccgcggacctggccgccgccgcgctcaggttcgccggagtggtcggcggcggcgagatgctggcgccgctcatggaggggcccgatccggagcccagcgacggggagagcggcggcgcctgccgaggcgccgcgcgcgggaggaaggaaggttggggccactgggtgcgcggccagttcgcgcgggccccgtcctccgcggtcgccgccgccggggccggcgcgctgcgcaacgacctcaggatgctcctcggcgtcctgggagcgccgctcgcgccggtccacgtctgcgccaccgagccgctcccgcacctcagcgtcaaggacactcccatcgagacctcatcggcgcagtacatcctgcagcaataccttgcggcctccggagggcacaagcttctggcctccctgcgcaactcctacgccatgggcaaggtgcgcatggtggccactgagttcgagaccggcggccgcctcaccaagaaccgcaatgctggacgcggcggcgagcctggccgcttcgtgctgtggcagatggcccctgagatgtggtacatcgagctggttgtcggtgggagcaaggtgcacgcagggtgcaatggcaagctcgtgtggcgccacacaccatggcttggtgcccattctgccacgggccctgttcgcccgcttcgccgttcccttcagggcttggatccattgatgacggcaagcatgtttgctcgtgcccggtgcattggtgagaggaaggtgaatggggaggattgcttcatcctgaagctgagcacagacactgagaccctcaaggcacgcagcgagggccatgcagagattatcaggcatgtcacgtttgggtacttcagccagaggactggtcttcttgcccacattgaggattcacatctgacccgaattcagtcagctgccggaggggacgcggtctactgggagactaccatcagctcgttcatggaggactaccgtccagtggatggtataatgatcgcgcattctgggcgctcggctgtgaccctgttcaggtttggtgaggttgccatgagccacaccaagactcggatggaggaggtgtggagcattgaagaggttgcattcaacgtcccagggctgtccatggactgcttcatcccgcccactgatatcaagtctggatctgttggtgaggccatggagcttactcatggcgagaggagccgggctggccctccccaaggctactgcgctaaagttgctgccctggagaaagcagaagaagataaagtggcatggggtggtggaaccgtactcgagagtcacaactgatctgcagtctgtttatacttggttctcacagtgcagctgctgaccctgttgaatctagtgtaggagagaaacaagtgaaagttgagaggatttggaggtttggtaaatccaaatgcctcctctgtataggaagaagcatgaggcattcacatggtcttgcatatgattgaagcggatctgtgtgaatcatcctttctgatcccatccagagacatggtagtaggtagccttgtttcctgcttcaggcttttcttcatttttttgtctgttcctagtgaaaggactgcttagggtatgttctccattccaaccgcatgagaaaggccattgtggttggttctcttttagcttatactaattggtcgctgccatcaatggggaagaagggtttcctcgccaggaactggcagtgttttggccgtcatggcatccgattggcggtggttcagtgtgttttgcttgctgatggattgagctgaagctaacctctcaggggaaaaagagagagagagagagagagagagagagagtagaacatctgaatggtttttacttgtgttttagtactgggtagaacctgttagatgtttgttagttagcagtgttttatttagtaagttatcttgttcctgaacctcccccctttgcatctctctatatttaatcatgagatgaaggatccactattgttaaacagatgatggatgtaatatattcccaaacatctttttgagtgtca

SEQ ID NO: 1758 - DNA, 2093 bp, Oryza sativa
gatgaggatgtccggaggcggcggcggcgggggtgagatgctggcgccgctcatggaggggcccgatccggagtccggcgacggggaaggcgggggtggtggtgggggtggcggcggtggaggtggtgggggtggccggggcgcgcgcgggcggagaggggaagggtgggggcagtgggtgagggggcagctgtcgcggacgccgtcctccgtggccgccgcggcggccggcgccggcgccgcgcggaacgacctcaggctgctcctcggcgtcatgggcgcaccgctcgcgcccgtgcatgtctccgccgccgagccgctcccgcaccttagcatcaaggacacccccatcgagacctcgtcggcacagtacatactgcagcaatacctggcggcctctggtgggcagaagcttcttgcatccgtgcggaatgcgtacactatggggaaggtgcgcatggtggccaccgagtttgagactgctggccgccttgtcaagaaccgcaatgctgctcgctgcgccgagccaggccgctttgtcctgtggcagatggctcctgagatgtggtacattgagctggctgtcggtgggagcaaggtgcatgcgggctgcaatggcaagctcgtgtggcgccacaccccgtggctcggtgcccatgctgccaagggccctgttcgccctctccgtcgtgcacttcagggtttggatccattgaccactgcaagcatgtttgctggtgcgcgctgcattggggagaggaaggtgaatggggaggattgcttcattctgaagctgtgcacagaacctgagacccttaaggcacgcagtgagggtctcgcagagatcattaggcatgttatgtttggatatttcagccagaggactggccttcttgtccatattgaagattcacacctgactcggatccagtcgacaaccggaggagatgctgtttactgggagactaccatcaattcattcatcgaggattatcgtccagtggaaggtataatgattgcacattctgggcgctctgctgtgaccctattccgttttggtgaggtggccatgagccacaccaagactcgtatggaggaggcatggagcattgaggaggttgcgtttaatgtccctggtctgtccatggattgtttcataccacccactgatatcaagtctggatctattagtgaaactgttgagctttctcatggtgagaagagcaaggttggccctccccctggccatcgtgccaaagttgctgccttggagaaggcggttgatgggaaagtagcatggagtggaaccatacttgaagatcacaattgatctgcagtctgtccatacatgcttcttacattgcagttgactgactttgatgaatgtagtgtaggtgataaacaggtcgaaggaggatttggagtttgtagaaccaaatgccctttgtgtacagggagcaccatgaggtattcaccagatcctgcatatccttgagggtgatctgtgtgaataatcctttctaatctcatcctgatatacgcgtagtaggtagcctcgtttgctacctcaggctttttgtcagtgccatctgaaagaacatggtgcgttctccattccaggttccagccacatgtggaaggtccattgtggtaatgctgtttgttctcctttagcaatactgattagtcattggtgtcagtggggaagaagtatttcctcggtggcaaccgacagtgaattagttgtcaacttgttgccattgacatctgattggcgggtttagttttcgtcatcacatccaattggcggttcaaaatgctgtgcttggtgatgcttcctggtcaaagctaacttcagagaaaagtagaaactctaaaatggttgctacttcttaggtttctaattgtaagtttttttcccttttgaaccttcctttgcatctctcttatttatcatgagatgaaggtgtactcaacagaagtttgatgtaatccaaaacatttatgattgtgatgggttgaactgtttgtgatgtctgctgccctgctcacacccatcttttttgagtactttaaaaatgattttggctccc

SEQ ID NO: 1759 - DNA, 2095 bp, Brachypodium distachyon
atggacagcagcggcggcaacaggaagcagggcttcttctcggcgctcagggacgaggtggcgcgcgggctgtcgccggcgagggcgcggcggaggtcggcggaggcggcggcggcggccgcggcgctgcggtacgcggggggaggcggcggggaggtgctcgcgccgctcatggagggcccggatccggaggagtccagcggcggcggcggcggcggtgggggagacgggggtttcggccgcgggaggaagggggacgggtggggccggtgggtgcgcggccagctcgcgcgtgcgccgtccgcgggagccttggctgtcgggaccggcggcggcggcggcgcggcgaggcggagcgacctcaggatgctgctcggggtcatgggcgccgcgctcgcccccgtgcacgtctgcgccgccgagccgctccctcacctcagcatcaaggacacccccattgagacttcgtcggcacaatacattctgcagcagtatctggctgcctccggcgggcagaagctcctttcttctgtacgaaacgcttatgccatgggcaaggtgcgcatggtggctaccgagtgtgagacggctggccgtgtcgtgaagaaccgcatggcggcgcgctgcgctgagcctggccggttcgtgctgtggcagatggctccagagatgtggtacattgagctggctctcgggggtagcaaggtgcatgccggatgcaacggcaagcttgtctggcgccacaccccatggcttggcgcacactctgccaaggggcctgttcgccctctccgccgagcacttcagggactggatcctttgaccaccgcaagcatgtttgctggtgcacgctgcattggtgagaggaaggtgaatggggaagattgcttcattctgaagctgtgtgctgatcctgagacgctaagagcgcgcagcgaggggcttgcagagattatcaggcatgttctctttggatatttcagccagaagaccggccttcttgtccatctcgaggattcacaccttaccagaattcagtccacaactggaggtgatgcagtttactgggagactaccatcagttcgttcatcgaggactaccggccagtggaaggaataatgattgcacatgctggacgctcggccgtaaccctctttcgcttcggagaggttgccatgagccacaccaaaactcgcatggaggaggcatggagcatcgaggaggttgcgttcaatgttcctggtctctccatggactgcttcatcccacccactgatatcaagtctggatccatcagtgagactgttgagcttccgcacggtggcaagagcaaggttggtcttctcacatgccatggtgtgaaggttgctgctttggagaaagctgatgataacgttgcttggagcggagccctgcagcgagattgcaagtgatttgtggtctgtccatactgcttcttgcagtagctactgactcattttgatgaatgtaggtagaaagaaagggccaaaggaggattttggatctttaaaattccaaatgtcctctgtaaatagggaaggtcaaggcaatcacatggtcttccatgtccctgaggaggccttgtgtgaagaatcctttccgatctcattcagagatatggcgtagtaggtaggcttgttggtaatttctgttttttggttagtgcctgtggaagaaccaggggtgttcctcctccatccaaccacatgatgaggacatggtggtggtgctagcagtactaattatcagagagccagcgaggaagaaggatttcgtcgtcggcaatcaagagtgaattttatcattgggtcgcgtctaattagcagtccagtgtgctttggttggtgatagtctgtggtcaaactaacttttagggggagaaatggaaggggtccagagtggttgttgctctttgtttagggtaccaccatatcatgggtctggctgttctcccctttccccttcacacacatctctcttatttagtatgagatggtggttgtattctacagaagttgatgtaagccaaaaacttctatgaatatcatggattgagctgttttttttcccttc

SEQ ID NO: 1760 - DNA, 2265 bp, Triticum aestivum
ggcacgagctcgaaccctagcggccaccggcgacgacgccgtcgcctgaccgccccgcgaccgaccacgacctgccgagctcctccgcgacaccctcgaccccggcctaccgacggctgctccttctcttcctcaaggacacaaactcaaagatgggaaagggtgacagggagaaggaagcgaagcgccgacgacgcggccgcagcagcaagagatcgcgcaatgccacaccctcttcggactctgattcttccccttcgccggactcctctcctagccgcagccctgggccccggagtcgcagtaacagcaaacctgaaaagtcgtcctcttctcgtcgccgccgccatcaccataagaacagcggccgctcacgcagttcccgggacgatgatagacatcgtcaccggcagaggcgccgggatgagcgtgcccgtcacagcagcgatggcagcgacctgtcgggatcaggctcagatgattcaggatggatggaggaggcgcaggaaatcgtccgtggcattctcagtgaattccctgccatcaccagcgagcttcgtcagcttctccaaatgatagatagtggtgaaggcattgatatttccggaatttctgacaagccattggtgaagcgtttgaagaaacttttcagatccctgaaattgaaagaaagtgcaaatggagcttacttgctttcagcaaaaggtgttcctacccttgatgttgttggaccagtattagaagcaagtgccaaacatggaaatgatccaaatgaaactgtggcacgaaatagacaacaagtaccgttgcctaactttgacgtacaaaataaagatgacatccctcctgaagatggaggaaaagttgaccgggaagaggacacccctataaagagggtaattggtcctgcaatgccatcacgtgaattactagctgcagcagccgaaatgacagaggctcttaggtgccgggatgctgaattggaagctgatgatggatttcttataggtcctccaccaccagccatggtcgctgaagctgcatctgcaaatgaagccgagcgatttgaagaggttactcgaatattgggtgctgatgcagatgcactctatgatgttctgggcataaattggaagatgtcgtctgataacatcaagaaaaggtattggaagctatctcttttagtgcatccggacaagtgccctcatccttcagcacaggaggcttttgtgaaattgaacaatgcttttaaagacttgcaagaccctcaaaagagaggcgcaatagatgagaagatacaaaagaaagaagagatggaacaattcgaggttgagcttaaagcaatgcgcgaggctgcagaatggagacgattacaaggtatatctcttgaaggcgatgaagaacttttggcagttccgaaacagccagaggcaccgcctacacgagacgaatggatgactacattgccacctgaaagaaaagctggagtaccaatgcattcaactacggcatttagcatgaatggcaaagaaggacgtggtggcacaagtgcatggacagatagtccacttgatagagcccagaaagcacagcaaaactacttagaagcctacaacaaagcaaaggcaattgcagatggacatgaagagcagggcaaaagcgcaaatgcttctcttgtggataaatacaactcctctaagcggtcggtatctcttgtgcagaagcaccgagagagcaaaaaggagaaaaaaaagcagaagcaacaacgagggaaggaagaatgggaggagaaccacccatggaagccgtgggaccgtgagaaagacttgaccgctgggcggcaaaatgtggctttggatccagagaacacggcacaaggactgtcgtcccgtttctcatctggagctgtgcagaggaacttcctgtgaggaatttgagtcagactctgcttgaggcacgccaaggagcatgccctaattagtggccggtaccagggtatgtatttggcgtcgaacgccagtgttgctaggggcacagaaaccatagagaatatgaggtttgtgacatttgctatacgagcagcttgcatgttgttttctggagagagctgaagttctcgatacatatagaagggttttgcttgtgagttgtttcaaagttcaagctgtataacaaccctaggtaggtcttcgttcctggcttatttttgcctagcgcgaagacctatgctctgagacttaaaaggatggaataatggtgtatact

SEQ ID NO: 1761 - DNA, 2371 bp, Triticum aestivum
  misc_feature (25)..(26): n is a, c, g, or t
  misc_feature (386)..(386): n is a, c, g, or t
  misc_feature (412)..(412): n is a, c, g, or t
  misc_feature (659)..(659): n is a, c, g, or t
  misc_feature (760)..(760): n is a, c, g, or t
  misc_feature (1259)..(1259): n is a, c, g, or t
  misc_feature (2176)..(2177): n is a, c, g, or t
  misc_feature (2183)..(2183): n is a, c, g, or t
  misc_feature (2196)..(2196): n is a, c, g, or t
  misc_feature (2202)..(2202): n is a, c, g, or t
  misc_feature (2206)..(2207): n is a, c, g, or t
  misc_feature (2223)..(2223): n is a, c, g, or t
  misc_feature (2229)..(2229): n is a, c, g, or t
  misc_feature (2231)..(2231): n is a, c, g, or t
  misc_feature (2233)..(2233): n is a, c, g, or t
  misc_feature (2237)..(2237): n is a, c, g, or t
  misc_feature (2239)..(2239): n is a, c, g, or t
  misc_feature (2257)..(2257): n is a, c, g, or t
  misc_feature (2262)..(2262): n is a, c, g, or t
ggcacgagctcgaaccctagcggcnnccggcgacgacgccgtcgcctgaccgccccgcgaccgaccacgacctgccgagctcctccgcgacaccctcgaccccggcctaccgacggctgctccttctcttcctcaaggacacaaactcaaagatgggaaagggtgacagggagaaggaagcgaagcgccgacgacgcggccgcagcagcaagagatcgcgcaatgccacaccctcttcggactctgattcttccccttcgccggactcctctcctagccgcagccctgggccccggagtcgcagtaacagcaaacctgaaaagtcgtcctcttctcgtcgccgccgccatcaccataagaacagcggccgctcacgcagttcccgngacgatgatagacatcgtcaccggcngaggcgccgggatgagcgtgcccgtcacagcagcgatggcagcgacctgtcgggatcaggctcagatgattcaggatggatggaggaggcgcaggaaatcgtccgtggcattctcagtgaattccctgccatcaccagcgagcttcgtcagcttctccaaatgatagatagtggtgaaggcattgatatttccggaatttctgacaagccattggtgaagcgtttgaagaaacttttcagatccctnaaattgaaagaaagtgcaaatggagcttacttgctttcagcaaaaggtgttcctacccttgatgttgttggaccagtattagaagcaagtgccaaacatgnaaatgatccaaatgaaactgtggcacgaaatagacaacaagtaccgttgcctaactttgacgtacaaaataaagatgacatccctcctgaagatggaggaaaagttgaccgggaagaggacacccctataaagagggtaattggtcctgcaatgccatcacgtgaattactagctgcagcagccgaaatgacagaggctcttaggtgccgggatgctgaattggaagctgatgatggatttcttataggtcctccaccaccagccatggtcgctgaagctgcatctgcaaatgaagccgagcgatttgaagaggttactcgaatattgggtgctgatgcagatgcactctatgatgttctgggcataaattggaagatgtcgtctgataacatcaagaaaaggtattggaagctatctcttttagtgcatccggacaagtgccctcatccttcagcacaggaggcttttgtgaaattgaacaatgcttttaaagacttncaagaccctcaaaagagaggcgcaatagatgagaagatacaaaagaaagaagagatggaacaattcgaggttgagcttaaagcaatgcgcgaggctgcagaatggagacgattacaaggtatatctcttgaaggcgatgaagaacttttggcagttccgaaacagccagaggcaccgcctacacgagacgaatggatgactacattgccacctgaaagaaaagctggagtaccaatgcattcaactacggcatttagcatgaatggcaaagaaggacgtggtggcacaagtgcatggacagatagtccacttgatagagcccagaaagcacagcaaaactacttagaagcctacaacaaagcaaaggcaattgcagatggacatgaagagcagggcaaaagcgcaaatgcttctcttgtggataaatacaactcctctaagcggtcggtatctcttgtgcagaagcaccgagagagcaaaaaggagaaaaaaaagcagaagcaacaacgagggaaggaagaatgggaggagaaccacccatggaagccgtgggaccgtgagaaagacttgaccgctgggcggcaaaatgtggctttggatccagagaacacggcacaaggattgtcgtcccgtttctcatctggagctgtgcagaggaacttcctgtgaggaatttgagtcagactctgcttgaggcacgccaaggagcatgccctaattagtggccggtaccagggtatgtatttggcgtcgaacgccagtgttgctaggggcacagaaaccatagagaatatgaggtttgtgacatttgctatacgagcagcttgcatgttgttttctggagagagctgaagttctcgatacatatagaagggttttgcttgtgagttgtttcaaagttcaagctgtataacaannctaggnaggtcttcgttcntggctnattnntgcctagcgcgaaganctatgntntnagantnaaaaggatggaataatgntgtanactatcctgctatgctaccagtcattggctgatgatgctaacctactgatacttattgcaagtacaatgagcttttgcaagtgaaaggtgtcttgcgagttggctgttc

SEQ ID NO: 1762 - DNA, 2165 bp, Brachypodium distachyon
atgggaagaggcgacggagagaaagaaggcaaacgccgccgcggccgcagcagcaagagatctcgggacgcctcaccatcatctgactccgattcttacccttcctcggcttcctcccccggccgtagtctcgagcaccggagccatagcggcagcaagcacagaaagtcgtccaactcgtcccatcgccaacatcatcaccacaaaagcagtggccgctcacactgttcccgcgacgaaaaccgtcgccgccgccgtaggagacgcagggatgaggggcgggtacagcgccatggcgatgccagtgacttttctggatcaggttcagaggattcagataatgaggaggcgcggcagattgtgcgcggcattctcagtgaattcccagctgttgctggtgagctttgtcagctccttcaaatgatagatggcggtgaaggcattgatatttctggaatatctgacaagccattggtgaagcgcctgaagaaacttttcagatcgctgaagctgaaagaaagttcaaatggagcttacttgctaccaccaaaaagagttcctactcttgatattattggaccaatattatcaggaagtgctaaatgtggggatgatcaaaatgagaatgcgatgttacagaagagacaacaactactgtcatctaattttgatgtacaaaataaagatgatttccctcctgcacacggaggaaaagttgacagggaagatgacaccccgaaaaagagggtaattggtcctgcaatgccatcacgtgagttactagctgcagcagctgaaatgacagaggctcttaggtgccgggatgctgaattggaagctgataatgattctcttataggacctccaccacctgccatggttgctgaagctgcatctgcaaatgaagctgagcgatttgaagaggttactcgaatattgggtgctgatgcagacgcgctctatgatgttctgggcataaactggaagatgtcatctgagaacattaagaaaaggtattggaagctatctcttttagtgcatccagacaagtgcccccatccttcagctcaggaggcatttgtaaagttgaacaatgctttcaaagacttacaagaccccggaaagagaggtgtgatagatgagaagataaaaaagaaagaggagatggaacaatttgaggttgagcttaaagcaatgcgtgaggctgcagaatggagacggttacaaggtatatctcttgagggtgatgaagaacttttggccgctccaaaacagccacaagaaccacctacacgggatgaatggatgaccacactgccacctgaaagaaaagctggagtaccaatgcattcaactacgtcattcagtatgaatggtaaagaaggacgtggtgacacaagtgtttggacagatagtcctcttgatagagcccaaaaggcacagcagaactacttagaggcctataacaaagcgaaagcaattgcagatggatatgaagacaagggcaaaagctcagatgcttctcttgtagataaatacaactcgtccaagagatcagtatctcttgtgcagaagcaccgagagagcaaaaaggagaaaaagaagcataagcaacgagataaagaaggatgggaggaaaatcacccatggaagccatgggatcgtgagaaagatctgactgccgggcggcagaatgtggctttagatccagagaacatgactcaaggattgtcgtcccgtttttcatccggagctgtgcaaaggaacttcctctgagtaatttagacgtagccgcagatgagcagttgcctagctgatacttggtgtcgaatgccaatgttttcttttcatgaaaatgttgaagttgttaggggcacagaaacaggagaatgccagattagttatattcgatatatcctgttggggttggcttgtgcttgtgagctgttttccacttttccgtaacaactctggatgtttttgaaggccttatagctgatggcccaccatttacatctgagaatcacagaatgcagtaatattttaatactacgtgacttgtagaccgaaacgaaatgagtggactgatcaagctaacaattgatacttgatatacaatgaactctttattcaattggtacttgaagtaaaatgaattgtttatt

SEQ ID NO: 1763 - DNA, 2278 bp, Oryza sativa
atattctccattcaggttatgcccttccaggcttccagtccccgtaacagacaaattcacaagaagcctttcttccccaaggtagaggtccgtccgaccgtcggagaagatggggaggggcgacgaggcggagaaggaaggcaagcgccgccgcggccgcggccgcagcagcaggagatcccgcgacgcctcctccgaccccgaccccgactccgcctcctccccttccccatcctccgcctcctcccccagccgcagccccgaccgccgcagccgcagccgcagcagcggcagcaagcggaggaaggcctcctcctcgtcacgccggcatcgccaccaccaccacaagagcagcggccggtcccgccgctcgcgcgacgacgacgatgaacggcggcgccggcggaggcggcgggacgaggagcgcgggaggcgcggcggcgatgcgtcggagtcgtcgggatcgggctcggaggagccggatagggcggaggaggcgcgggagatcgtccgcgacatcctcggtgatttccccgccgtcgccggggagctccgtcagcttcttcaaatgatagataatggtgaaggcattgatatttctggaatttctgacaagccattggtgaagcgcctaaagaaacttttcagatcacttaaactgagagaaagctcaaatggggcttacttgttgccaccaaagagtgtacccacccttgatgttgttggatcagcattagtagctagcggtgaactggctgataatgaaaataaaaatccagcgtcaccaactagacaggaacaaccatcatccaattttgatgtgcaaaataaaaatgatagcactcctgaagagccagcgaaaaatgatgctgatgaacaaccccctaaacggagggtaattggtcctgctatgccatcacgcgagttactagctgcagctgctgaaatgacagaggctcttagatcccgggatgctgaagttgaagctgatgatggttttctcataggccccccaccgcctgccatggtcgctgaagcagcatctgcaaatgaagctgagcgatttgaagaggttactcgaatattggcggcggatgagaactcgccatatgatgttgtgggcatcaattggaagatgtcatctgataacatcaagaaaaggtactggaagttatctcttctagtgcatcctgacaaatgtcctcatccttcagctcaggaggcatttgtgaaattgaataatgctttcaaagacttacaggaccctgaaaagagaggtgtgatagatgagaagataaaaaagaaagaggagatggaacaatttgaggtcgagcttaaagcaatgcgcgaggccgcagaatggaggcggctacaaggtgtatctcttgagggtgatgatgaacttctggcagttccaaaacaggcacaggcacctaaaagagatgaatggatgaccacattgcctcctgaaagaaaacctggagtaccaatgcattcgactacgtcatttagtatgaatggtaaagaaggacgtggtgatacaagtgtctggacagatactcctcttgaaagagctcaaaaagcacaacagaactacttagaagcctacaacaaagcaaaggcaattgcagatgcagatgaagaaaagattaaaacctcagacgcttcattggtggatacatacaattcctccaagcgatcagtatctctcgtgcaaaagcatcgagaaagcaaaaaggagaaaaagaagcagaagcagcgggataaagaagaatgggaaggaaaccacccatggaagccttgggaccgtgagaaggacctgactgctgggcggcaaaatgtcaatttagatcctgagaacatggcacaaggattgtcgtcccgattttcgtccggagccgttcagaggaacttcctctgagccattttgagatgatcggctaatcacagatgaaacatcaccatgttggtcaccagtacgctggtatgtatttgctgtaaggttgcataggatgcttgttagttatgatgttaagatgatccatgttataagtgtaacgtatgttagatgggttgggttcgcatgtccatttcccagaaatgaattattgcattatcgagagagagctctagctacctatctctactgaacgactgtgcataccggttgttttgaactgtatatgaacttttccagacagtttaatggtacctggtacttaatggtacatccttaaggatagaaaaagtacctcctcaaggatggaaaaagagctcc

SEQ ID NO: 1764 - DNA, 1462 bp, Solanum tuberosum
gatcgaaaagccaaagaaaactcacccacccaccactaaaaatccattaattatattttcacccctgatttttcctctctccataccaatttcccacttcccaagaaaatcaaaattcacaaaaccctagaaataataaaaggaaaaaagaaaaaaaaaacaaagaaggagagagagtctctctctttctttctctctattttttctttcaaccaaacagaccacaaacagtagagagagaaactgagatatctagagagagaaagtgtgaagcttttgcagataagaattctcatctgttcttccatggctttaacgtttcatatttttccctaattctctcttcagatcttaaaaaaaaaagcaaaaacaaaaaaaaaactttttttgaatcatcgatcatgcggagaggtagagcagccgcggcggcgagacaagttccggcgacggaagttccggtaccggcaccggtggccggagaactcaacggatctggaggatctaaggagataaggttccgtggagttcggaagagaccatggggaaaatttgcagcagagattagagatccatggaagaaaactagggtttggttgggtacttttgattctgctgaagatgctgctcgtgcttatgatacagcagctcgtacacttcgtggacctaaagctaaaactaacttccctttaccttcttctcatcatctacctccttatcctcaccatcatcagttcaatcaaagcatcaaccctaacgatccctttgttgattcccggttatactctcaggaccacccgatagtttctcagagacctacttctagcagcatgagtagtacggtggagtctttcagtggaccacggccgccgccccggcagcagacggcagcttccgtgccttccagaaagtatccccggtcgccgcctgttgtcccggacgattgccatagcgactgtgactcgtcgtcttctgtcgttgaagacggtgaatgtgataacgacaacatcgcttcttcctctttcagaaagccgttgcctttcgatctaaacttaccggcgccgatggatgacttcggcgccgacgcatatgctgatgatcttcactgcacagcactatgtctttgacgaaatgatggtttgtgacccacctgtcatttgataccattggcttacctagtttttttttttctttttttgggtgaccggaaaaaaaaagcaaaaaaaagagaatggaaccatagaagataagctaaactatgtctgctatgagtcaatctgttgttgtaagagtattcacttgtttaatttaattctcatattttatatcatgggatttcttgataggtggatggatcagtgtatgtcaaatttgatctgattgtgtatcttaaaactatatgtgagttctcagctgaaggtgcccctttgttgttcgaatatatattgacatggaagattagagg

SEQ ID NO: 1765 - DNA, 1591 bp, Solanum phureja
cgaaaagccaaagaaaactcacccacccacccctaaaaatccattaattatattttcacccctgatttttcctctctccataccaatttcccacttcccaagaaaatcaaaattcacaaaaccctagaaataataaaaggaaaaaagaaaaaaaaaacaaagaaggagagagagtctctctctttctttctctctattttttctttcaaccaaacagaccacaaacagtagagagagaaactgagatatctagagagagaaagtgtgaagcttttgcagataagaattctcatctgttcttccatggctttaacgtttcatatttttccctaattctctcttcagatcttaaaaaaaaaagcaaaaacaaaaaaaaaactttttttgaatcatcgatcatgcggagaggtagagcagccgcggcggcgagacaagttccggcgacggaagttccggtaccggcaccggtggccggagaactcaacggatctggaggatctaaggagataaggttccgtggagttcggaagagaccatggggaaaatttgcagcagagattagagatccatggaagaaaactagggtttggttgggtacttttgattctgctgaagatgctgctcgtgcttatgatacagcagctcgtacacttcgtggacctaaagctaaaactaacttccctttaccttcttctcatcatctacctccttatcctcaccatcatcagttcaatcaaagcatcaaccctaacgatccctttgttgattcccggttatactctcaggaccacccgatagtttctcagagacctacttctagcagcatgagtagtacggtggagtctttcagtggaccacggccgccgccccggcagcagacggcagcttccgtgccttccagaaagtatccccggtcgccgcctgttgtcccggacgattgccatagcgactgtgactcgtcgtcttctgtcgttgaagacggtgaatgtgataacgacaacatcgcttcttcctctttcagaaagccgttgcctttcgatctaaacttaccggcgccgatggatgacttcggcgccgacgcatatgctgatgatcttcactgcacagcactatgtctttgacgaaatgatggtttgtgacccacctgtcatttgataccattggcttacctagtttttttttttctttttttgggtgaccggaaaaaaaaagcaaaaaaaagagaatggaaccatagaagataagctaaactatgtctgctatgagtcaatctgttgttgtaagagtattcacttgtttaatttaattctcatattttatatcatgggatttcttgataggtggatggatcagtgtatgtcaaatttgatctgattgtgtatcttaaaactatatgtgagttctcagctgaaggtgcccctttgttgttcgaatatatattgacatggaagattagagggtaatttgtgttcttcttttgctggtatcatgtgtgtatgatgttatcttctgccctttcagtctatgtaacaattgagacttcatgtgatcatatatcagttgagaagtattcgttttgcgtttcttcgaa

SEQ ID NO: 1766 - DNA, 2087 bp, Sorghum bicolor
agcatcccaagttgaggaaacaggagatggcaagagacgggaaggagactaggcgccggagccgcaagagatcccgcgacgcctccctctccccctcctcggattccgactccccttcctcggcgtcctccccaagcagcagccctgagcgacggagccgcagcagcaagcggagtagatcatcctcatcgcaccgccaccgccaccgccacagccgcaaggacagcggccggtcgcggagctcccgcgacgaggaccgccgccgccggcatcggagaagacgggaccaggagagaaagcggcacggtggggatggtggcgggtcctccgactcccaatcgtcggaggaggatagggcggaggaggcgcgggagatcgtccgagatatcctcagggaattgccggccgtagccggagagcttcgccagcttctccaaatgatagacagtggtgaaggcattgatatttctggaatttctgacaagccattggtgaagcgcttgaagaaacttttccgatctctgagactgaaagaaagtgcaagtggggcttacttgctgcctccaaaaaatgttcctacacttgatattgttggatcattactattagcaggttccaaactttcagacaacaaaagtgaaaagtcagtatcaccatatagagaagaactaccacaggctaactttgatgtgcaaaataaagataaagatgactctatttccgaagagccgaaaattattggtgtggaagaggaacctcctaaaagaagggtaatcggtcctgcaatgccatctcgtgaattactggctgcagcagctgaaatgacagaggctcttaggtgccgggatgctgaactggaagccgatgatgatttgctcataggccccccaccgccagctgtagtcgctgaagctgcatctgcaaatgaagctgagcgatttgaagaggttactcgaatattggcagctgacacaaattcaccttatgatgttctgggggtaaattggaagatgtcaactgataacatgaagaaaaggtattggaagttgtcccttttagtgcacccggacaaatgtcctcatcctttagcacaagaggcattcgtgaaattaaataatgccttcaaagacttacaagaccctgataagagaggtgcaatagatgagaaaataaaaaagaaagaggagatggaacaatttgagattgagcttaaagcaatgcgtgaggctgcggaatggagacggttacaaggtgtatcacttgcaggtgatgatgaacttttagcaggtccaaaagagtcacaggcacctaagagagatgaatggatgaccacattgccaccagagagaaaagcaggagtgccgatgcattcaactaaatcatttagtatgaatggtaaagaaggacgtggagacacaagtgtctggactgatacccctcttgatagagcacaaaaagcacaacaaagctatctagaagcctacaataagacaaaggcgattgcagaaggcgaggatgtaaagagcaaaaacccggatgcttcaattgtagataagtacaatacctccaaaagatcagtgtctcttgtgcagaagcaccgagagagtaaaaaggagaaaaagaaacaaaaacagcacgagaaagaagaatgggagggaaaccacccatggaagccatgggaccgggagaaggatctgactgctgggcgccaaaaggtagctttagacccagagaacatgtcacaaggattaacttcccgtttcgcatctggttctgttcagaggaacttcctgtaagcagtatggaaagatactcctggagcatagcctaatcgatgattaatatatccagttacatcctttccggcagatggcaaagatattactgacacgtaaaaacgagttatgttatcaaggataatcatcttgtaagttggtgcctgttatgtttattttctcagtgtattatctggtaagctaaaatgatgtcatagtttgttcgaactatacaataactttttcaatagttcttagaatcgtaatttcattttgatgatgctaaaatgactaggttatggggttgggtta

SEQ ID NO: 1767 - DNA, 818 bp, Panicum virgatum
caatttgctccgcaccgaccacgaaccgaaccgcgcgccgccgccgtcgctccctctccacctccatttccttccccttgctcttcgccttccccccctaccggagccacaaccagcgccctgggcagccgccgcagtctcgctgccgctcgcttcgccgaccaatccggccgtgcgggacgcgggaggatttggcgccggagcaggccagggaggacgggacgggatgttctccggcgactggacgccgccgtgcggcagctgctgcaccaagaagtacgcgagcctcgtgcagatcccatggagggtgttctgcaagaaggggtgcaacgcggacggcgacacctgggaagaatgcataggaaaatgtactgaaatctgctacaaagatccagtgttggaagatcgtcagtggagtgcttacattgatcgatctccagggcaggatagttactctttggagtgcttcaatgcttgtgtgtctggttgtggattcaggtttgagatcccagcagagaaggttgaagagatcaagcccaacaggccgtccaagccgccgccgcctcctgaagtgaagccaactacgggttcagactccgctgctgggagccgtgaagacgcgccatgcacatcggcctagttgcctccaactcttgatgtgtttctatttgctctgttctcctcactcgtccttccccttctcttagctagtggtaatcgcgaaatttagagtgaatttgtagcactggcagtaagagatgacgaggggagtgcagcgatgtattgtgcacaagtaacaggagttttacttgatgaat

SEQ ID NO: 1768 - DNA, 917 bp, Sorghum bicolor
accgaacaacgcgccgccgccgccgctccctctccacctccatttcctggacccctgccccctcgcctccccctttaccggggcccgcgcaccagcatccttcggcagccgccgcggtcccgctgccgctcgcttcgcctaccgatccgtgtccgtgcgagacgcgggaggtattggcgccggaggcaggccaggatgttctccggcgactggacgccgccgtgcggcagctgctgcaccaagaagtacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcctatattgatcgatctccagggcaggatagttactctttggaatgcttcaatgcttgtgtgtctggctgtggatacaggtttgatgtcccaacggagaaggtcgaagagatcaagcccaataggccgtccaagccgccagctcctgaacctgatgtgaaacgaactaagagtccagattgtactgaagatgtgccatgcacatcggcctagattgagtgttgacgtgcctcaaattttgtaaagccgatgtgcttctgcatgttgtattcctactcgacctaatttctctctgggaaacacgcgagaaatttatctagcttagggtgaagatttactgcactggccgtgagaggtgatggcctggctgaaggtttgatggcctgatgaggaatgcgacaatgtaatgtacacaagtaatggagtcagagtttctactccatgccatgcatgacatatttcatagcctcacgatactgaattatctttcggttcaatcatgtttgggtgacaacacctagcaatggcat

SEQ ID NO: 1769 - DNA, 445 bp, Pennisetum glaucum
gggggatgttctccggcgactggacgccgccgtgcggcagctgctgcaccaagaagtacgcgagcctcgtgcagatcccgtggagggtgttctgcaagaaggggtgcaacgcggacggtgacacctgggaagagtgcataggaaaatgtactgagatctgctacaaggatccagtgttggaagatcgccagtggagtgcttacattgatcgatctccagggcaggatagttactctttggaatgcttcaatgcttgtgtgtctggctgtggattcaggtttgatgtcccaacagagaaggttgaagagatcaagcccaacaggccgtcaaagccgccgccacctcccgaagtgaagcgaagtacgacgagtccaccagagtccactgggggaagccgtgaagacgtgccatgcacatcggcgtagtttcacacgccccccccccc

SEQ ID NO: 1770 - DNA, 2309 bp, Zea mays
ctacaatggtgccaaaatctactcgttatctcgttttctactctcttccatttcatcctggccaccagttcccgccatgccgccaccgccgccgcagcgtccagcttcatcccacgttggccgcgccaacctcttctccgcctcaccgcctcccctctccaatcgccgctacccccatcatcggtcgttgcccctcccgcccgtctccccacgccgccgcgaccccaagaagcactcccagcagccttcccaagaagaaccgacagacagcggtccaacaagaacggtcacaaccaacccggccttccgcgcggcccatctccgtaccgcgtaccgcaagcccgtgcctccagccgcagccgccggcgaaggcgaggccctcctcgccgccgacccaaccgatgccgcctcggggcgcgctgtcgtcgtgggtccctcgggcctttccttccgcctccccggggcgccgttcgacttccagttcagctactccgaggcgccccgcgccccaccgctcgccatccgggaaccggccttcctgcccttcgcgccgccgaccatgccgcggccctggacgggcaaggcgccgcttctgacaaaggaggagaaggcgcggcgccggggcgtgcggctgcacacgccgctcgggcaggagacgccgcagacggtgagcgcgcacgggatcatgatggaggtcagggagaggaggaaaatggacctggccagggtgagccccggtgacggcaggagcagggaggaggtgctcggtgagccgctcaccccatctgaggtgcgcgcgctcgtcaagccgcacatttcacacaaccggcagctgaacattggaagagatggcttgactcacaacatgttggaaatgatacattgtcattggaggcgccaggaaatctgcaaagttagatgccgaggcgttccaactgttgatatgaagaatctctgttatcatcttgaggagaagtcaggtggaaaagtcattcaccgagtaggcggcgttgtttttctatatagaggaagacattatgatcctaagacccgtcctcgctatccactaatgctctggaaacctgcaactcctgtatatccaaaactcatcaaagaagctccagatgggtttacaaaagaagaagcggatgaaatgagaagaaaagggcgtgatctgctgccaatctgtaaattagccaaaaatggaatatacatcactcttgtcaaggatgtgcgagatgcttttgaaggaagtgacctggtgaagattgactgtgagggtttgaatccaagtgactacaaaaagattggagcgaaactaagggatcttgttccctgtgttcttttatcatttgatgatgagcagatattgatgcacagaggcaaagaatggaaatccagatactcgaagcctcttactctcattccaaaagttccaaagaataatctggcaatgacatctgtcatgaatagttcagatgaagttagtgatgccaacactcaagttgcgataagagaagtattgagacccaaaatgttcaaattatggaagagtgcggtggactcgtctctggcattgctgctggatgacgccgaagcaaataatctcacacccgattcgctcctgactctggttgaggagttcagcgtgacatctcaggcggtggagcactcatttcctgctctgcttgtgaccaatggtgatgcgagcaccgactctctaagtgcagagtacatgaatgacgagcctgaaacaagcgttgctggaaacgaagagggccagctggagcagtcacctgatctccgtgacgatgaacattttgatgtcgacatgtttgagcgtctggagtcatctgtgccattgggatcgctgcctattgacagcatgatagagcggctgaacagtgagtgaagtacagcgagcagttcgttctgtccactgggataactactgatggtcagattgcaatctcggatcgtgtgatgcattatctacgttcctccggaccctcagtctggtgataatctcaagatccgagaatttcctgcgatttggtagcaaacgtgatgtaaagaaactaactgtagtatgcaagtgcgccatgcatttggcaaacgcaccaacggataacacgtctcgtttgccatcgtcaatgagtgcgcttgcatgtatatgaatatctgcatttatactgtgtttaccaaaaaaaaaagtattgtgccatgctccaaaaagatgcggagctagcagtgtcagaagtctataaactctatagtaatttatacttctgcattttctgaatattttt

SEQ ID NO: 1771 - DNA, 2309 bp, Zea mays
ctacaatggtgccaaaatctactcgttatctcgttttctactctcttccatttcatcctggccaccagttcccgccatgccgccaccgccgccgcagcgtccagcttcatcccacgttggccgcgccaacctcttctccgcctcaccgcctcccctctccaatcgccgctacccccatcatcggtcgttgcccctcccgcccgtctccccacgccgccgcgaccccaagaagcactcccagcagccttcccaagaagaaccgacagacagcggtccaacaagaacggtcacaaccaacccggccttccgcgcggcccatctccgtaccgcgtaccgcaagcccgtgcctccagccgcagccgccggcgaaggcgaggccctcctcgccgccgacccaaccgatgccgcctcggggcgcgctgtcgtcgtgggtccctcgggcctttccttccgcctccccggggcgccgttcgacttccagttcagctactccgaggcgccccgcgccccaccgctcgccatccgggaaccggccttcctgcccttcgcgccgccgaccatgccgcggccctggacgggcaaggcgccgcttctgacaaaggaggagaaggcgcggcgccggggcgtgcggctgcacacgccgctcgggcaggagacgccgcagacggtgagcgcgcacgggatcatgatggaggtcagggagaggaggaaaatggacctggccagggtgagccccggtgacggcaggagcagggaggaggtgctcggtgagccgctcaccccatctgaggtgcgcgcgctcgtcaagccgcacatttcacacaaccggcagctgaacattggaagagatggcttgactcacaacatgttggaaatgatacattgtcattggaggcgccaggaaatctgcaaagttagatgccgaggcgttccaactgttgatatgaagaatctctgttatcatcttgaggagaagtcaggtggaaaagtcattcaccgagtaggcggcgttgtttttctatatagaggaagacattatgatcctaagacccgtcctcgctatccactaatgctctggaaacctgcaactcctgtatatccaaaactcatcaaagaagctccagatgggtttacaaaagaagaagcggatgaaatgagaagaaaagggcgtgatctgctgccaatctgtaaattagccaaaaatggaatatacatcactcttgtcaaggatgtgcgagatgcttttgaaggaagtgacctggtgaagattgactgtgagggtttgaatccaagtgactacaaaaagattggagcgaaactaagggatcttgttccctgtgttcttttatcatttgatgatgagcagatattgatgcacagaggcaaagaatggaaatccagatactcgaagcctcttactctcattccaaaagttccaaagaataatctggcaatgacatctgtcatgaatagttcagatgaagttagtgatgccaacactcaagttgcgataagagaagtattgagacccaaaatgttcaaattatggaagagtgcggtggactcgtctctggcattgctgctggatgacgccgaagcaaataatctcacacccgattcgctcctgactctggttgaggagttcagcgtgacatctcaggcggtggagcactcatttcctgctctgcttgtgaccaatggtgatgcgagcaccgactctctaagtgcagagtacatgaatgacgagcctgaaacaagcgttgctggaaacgaagagggccagctggagcagtcacctgatctccgtgacgatgaacattttgatgtcgacatgtttgagcgtctggagtcatctgtgccattgggatcgctgcctattgacagcatgatagagcggctgaacagtgagtgaagtacagcgagcagttcgttctgtccactgggataactactgatggtcagattgcaatctcggatcgtgtgatgcattatctacgttcctccggaccctcagtctggtgataatctcaagatccgagaatttcctgcgatttggtagcaaacgtgatgtaaagaaactaactgtagtatgcaagtgcgccatgcatttggcaaacgcaccaacggataacacgtctcgtttgccatcgtcaatgagtgcgcttgcatgtatatgaatatctgcatttatactgtgtttaccaaaaaaaaaagtattgtgccatgctccaaaaagatgcggagctagcagtgacgaagtctgtaaactctatagtaatttatacttctgcattttctgaatatttttt

SEQ ID NO: 1772 - DNA, 2021 bp, Setaria italica
cgccgccgcatcacttcccgccatgccgccaccgccaccgcagcggccagctccctcccgcgccggccgcgtcaacctcttctccgccccgcctcctccactctccaaccgccggtacccccagcaccggtcccttcccctcccgccagtcccccctcgccgccgacaccccaagaaccacgccgagcagccttccgaagaccaggagccgacagacggcggtccaagagcgaccaccaccaccaacaaccccgccttccgcgcgacccacctccgcaccgcgtaccgcaagcccgtgcccccggtcgcggccgccggcgagggcgaggccctcctcgccgccgaccctgccgatgccgcccgtcgttgtggggccctcgggcctctccttccgcctacccggcgcgccgttcgacttccagttcagctactccgaggcgccgcgcgcgccgccgctcgccatccgcgagcccgcgttcctgcccttcgcgccgccgaccatgccgcggccttggacgggcaaggcgccgctgctgaccaaggaggagaaggcgcgccgccggggcgtgcggctgcacacgccgctcgggcaggagccggcgcagacggtgagcccgcacgggatcatgatggaggtcagggggaggaggcagatggacctggcaagggtgagccccggcgacggcaggactagagatgaggtgctcggcgagccgctcacccccgccgaggtgcgtgcgctcgtcaagcctcacatctcgcacaaccgacagctcaacattggaagagatggcttgactcacaacatgttggaaatgatacattgtcattggaggcggcaggaagtctgcaaagttagatgccgaggcgttccaactgttgatatgaacaatctctgttatcaccttgaggaaaagtcaggaggaaaggtcattcaccgagtaggtggcgttgtttttctatatcgaggaagacattatgacccacggactcgtcctcgctatcccctgatgctctggaaacctgctactcctgtatatccaaaactcatcaaggaagctccagaagggcttacaaaagaagaagcagatgaaatgagaagcaaagggcggaatctgccgccaatttgtaaactagcatcttattttgtatcctgcatcatggaatatatatcactcttgtcaaggatgtgcgagatgcttttgaaggaaatgacctggtgaagattgattgtgagggtttgaatccaagcgactacaaaaagataggagcaaaactaagggatcttgttccctgtgttcttttatcattcgataatgaacagatattaatgtacagaggcaaagaatggaaatccagatactcgaagcctctgactctcattccaaaagttccaaagaataatccgacaccaaaagttccaaagaataatccgacaatgtcttctgatgcaagtggttcagatgtcaatgaagccactgatgccaacactcaattcacagtaagagaagtattgaggcccaaaatgtttaaattgtgggagagtgcagtggactcgtctctggcattgctgctggatgatgccgaagcaaatgatctgacacccgattcactcctgacgagggttgaggagttcagcgtcacatctcaggcagtggagcactcatttccagctctgcttgtggccaattgtgaggtgaacaccgaatctccaagtgcagaatacataaacgatgagtctgaaacaagcattgctggaaaccaagaggaacagcttgagcaatcacctgatctcagcagcgatgaacactttgaactcgacatgcttgagcgtctggagtcatcggtgccattgggatccctgccgatcgacactatgatagagcagctgaacagtgagtgaactggaatagcagtccagtacgttgggggttaactgctgatgatcaaattgcattcttggattgtataagcattctgtgctccaatcgcagtccgtttccagagaattttcagcgatt

SEQ ID NO: 1773 - DNA, 1990 bp, Saccharum officinarum
gagtaccggtccacccacctgccctgcccggctgctctcgttcttcccattctccagccgccgcggcgacgcgcagacctagcactagcagagaaacacccgagatggcgatggctctgcgccgcctcgcgggcgtgtccggctcgccgtcggcctccgctgccgcggcggcgctgctactccggccggcgctgacccgcccgatctccaccggcttccgcgaggagcgcgacaccttcggtcccatccaagtccccaacgacaagctgtggggcgcgcagacccagaggtcgctgcagaacttcgacattggcggggatcgcgagaggatgcccgtgcccatcatccgcgcttttggcgtgctaaaaaagtgcgccgctaaggtgaatatggagtatggcctggatccaacaatagggaaggccataatgcaggcagctgaggaggtcgcagagggaaagttggacgatcacttcccacttgttatctggcaaactggcagtggcacacaaagcaacatgaatgccaatgaggtaattgcaaatagggcagctgagatccttggacacaagcgcggtgagaagtttgtgcacccaaatgaccatgtgaataggtcacaatcttcaaatgatacatttcccactgtaatgcatatagcggcggccgttgagataaattcgaggtttatgccaagtttgcaacagttgcatgattcacttcattcaaaaacttgtgagtttaaagacataattaaaattggacgtacacatacccaagatgccaccccgttgactcttggccaagaattcagtggttacactacacaggtcaaatatggaattgaccgtattaattgtacattacctcggatgtaccagcttgctcaaggtggaactgcagttggaactggcttgaacactaagaaaggatttgatgtcaaaatagctgctgcagtggctgaggaaacaaacctaccctttgtgacagcagagaacaagtttgaagctttggcagcgcatgatgcttttgtcgagagcagtggtgcggtaaatacaatttctgcatctcttatgaagatagcaaatgacatacgcttgctaggaagtggtcctcgatgtggtcttggtgaactaatcctaccagaaaatgagcctgggagcagcattatgcctggaaaagttaatccaacccagtgcgaggctctgacaatggtttgtgctcaggttatgggtaatcatgttggtgttacagttggtggtgcaaatgggcattttgaactgaatgtttttaagccaatgatcgcagccggattacttcgatcattgaggttgttaggggatgcatctgtgtccttcgagaaaaattgtgtcaggggaattcaagcaaaccataagagaatttcacaacttttgcatgagtctctgatgttggtgacatctttgaaccctaaaattggctatgacaacgctgcagctgttgctaagaaagcccacaaagaaggaaccacgttgaagaaagctgcattagaccttggagtattaacggagcaagaattccatgagcttgttgtcccagagaaaatgattggtccttctgattgataaccccatgttcactatgtttctttgaagcattcaggttgccacatccgcgagttctggtggcttcctgtgatgccaacttaatgattctagtgcacccgtaaataaaccaaataattttttcatatggtcattaggtcctctccacactggagaaatgatttttgcatggcggatggtacctgagaaaacaattgtatgcttgttccaataggacaatagagcacttgatgcatgaggcaccgtccattctcctggcatcagtcaagcttttgttgccaggtagctaatgctatgtaataagtgacatggcaaccatgtctagaaactatttgcattggtctttgacaagtgaaagtagaaatatacctgagttctagttcttttta

SEQ ID NO: 1774 - DNA, 1836 bp, Setaria italica
ccgagatggcgatggccctgcgccgcctcgcgggcgtgtccggatcgccgtcggccgccgcggccgcgctgctcctccggccggcgctgacccgcccgatctccaccggcttccgcgaggagcgcgacaccttcggccccatccaggtccccaatgacaagctgtggggcgcgcagacgcagaggtcgctgcagaacttcgacattggcggcgagcgcgagcggatgcccgtgcccatcatccgcgcctttggtgtgctcaaaaagtgcgccgctaaggtgaatatggagtatggccttgatccaacaataggcaaggcaataatgcaggcagctgaggaggtcgcagagggaaagttggatgatcacttcccacttgttatctggcaaactggcagtggcacacaaagcaacatgaatgccaatgaggttattgcaaatagggcagctgagattcttggacacaagcgtggtggcaagtttgtacaccctaatgaccatgtgaataggtcacaatcctcgaatgatacatttcccactgttatgcatatagcagcagctgttgagatcaattcaaagtttatcccaagtttgcaacagttgcatgattcacttcacgcaaagtctgttgagtttattgacataattaaaatcggacgtacacatacccaagatgccaccccgttgactcttggccaagaattcagtggctacactacacaggtcaaatatggaattgaccgaattaattgtacattacctcggatgtaccagcttgctcaaggtggaactgcagttggaactggcttgaacactaagaaaggatttgatgtcaaaattgccgccgcagtggctgaagaaacaaatctaccctttgtgacagcagagaacaagtttgaagctttggcagcacatgatgcttttgttgagagcagtggtgctgtgaacacaatatctgcatcccttatgaagatagcaaacgacatacgcttgctgggaagtggccctcgctgcggacttggtgaactaatcctgccagaaaatgagcctgggagcagcattatgcctggaaaagttaatccaacacagtgtgaggctctgaccatggtttgcgctcaggttatgggtaatcatgttggtgttacagttggtggtgcgaatgggcattttgaactgaatgttttcaagccaatgattgcagccggattacttcgatcattgagattgttgggggatgcttctgtgtccttcgagaaaaattgtgtcaggggtattcaagcaaaccataagagaatttcacaacttttgcatgagtctctgatgttggtgacatctttgaaccctaaaattggctatgacaatgctgcagctgttgcgaagaaagctcacaaagaaggaaccacattaaagaaagctgcattagaccttggagtattaacggaagaagaattccatgagctcgttgtcccagagaaaatgattggcccttctgattgataacccaatgctagctatgtttctagaagcattcatgctgccacatcagagtttcagtggttgcctgtggtgtcagaattcatgatcctggcctaaccgtaaataaagcaaatcaagtttcaaatcattgttagttcctcaccccattggagacatgattttgtacggcccatggtgcctgagaagacaatattcattcgtgttaaaatagggagaagtgtactttgattaattggaagagatgctttctctttctctctctctctttgacgtcggaacaactttcttatatttaaacctatacattcacaataatatattataatattggatatatggt

SEQ ID NO: 1775 - DNA, 1947 bp, Panicum virgatum
ccagccgccgctccccccacgcgccgggcagcggacccacgagcggagaatcacccgagatggcgatggctctgcgccgcctcgcgggcttgcccggctccccgtcggccgccgcggcagcgctgctcttccgcccggcgctgacccgcccgatctccaccggcttccgcgaggagcgcgacaccttcggccccatccaggtccccaacgacaagctgtggggtgcgcagacgcagaggtcgctgcagaacttcgacattggcggcgagcgcgagcggatgcccgtgcccatcatccgcgcctttggtgtcctcaaaaagtgcgctgctaaggtgaatatggagtatggccttgatccaacaataggcaaggcaataatgcaggcagctgaggaggtcgctgagggaaagctggatgatcacttcccacttgttatctggcaaactggtagtggcacacaaagcaacatgaatgccaatgaggtaattgcaaatagggcagctgagattcttggacacaagcgtggtgagaagtttgtgcaccctaatgaccacgtgaataggtcacaatcctccaatgatacatttcccactgttatgcatatagcagctgctgtcgagatcaattcaaaatttatcccaagtttgcaacagttgcatgattcacttcactcaaagtctgttgagtttaatgacataatcaaaatcggacgtacacatacccaagatgccaccccgttaactcttggccaggagttcagtggttacacaacacaggtcaaatatggaattgaccgaattaattgtacattacctcggatgtaccagcttgctcaaggtggaactgcagttggaactgggttgaacactaagaaaggatttgatgtcaaaattgccgctgcagtggctgaggaaacaagtctaccctttgtgacagcagagaacaagttcgaagctttggcagcacatgatgcttttgttgagagcagtggtgccgtaaacacgatatccgcgtcccttatgaaaatagcaaacgacatacgcttgctgggaagtggccctcgctgtggacttggtgaactaatcctgccagaaaatgagcctgggagtagcattatgcctggaaaagttaatccaacacagtgtgaggctctgaccatggtttgcgctcaggttatgggtaatcatgttggtgttacagttggtggtgcgaatgggcattttgaactgaatgttttcaagccaatgattgcagccgggttacttcgatcattgagattgttgggggatgcttctgtgtcctttgagaaaaattgtgtcaggggaattcaagcaaaccataagagaatttcacagcttttgcatgagtctctgatgttggtgacatctttgaaccctaaaattggctatgacaatgctgcagctgtagctaagaaagctcacaaagaaggaaccacattaaagaaagctgcactagaccttggtgtcttaacggaagacgaattccatgagcttgtcgttccagagaaaatgattggcccttctgattgataaccccatgctagctatgtttcttgaagcattcaggcggccacatctgagttttattggttgcctgtgatgtcagaattcatgatcctggcccatccgtaaataaagcaaatcaatttcatatcatcattagctcctcaccccattggagacatgattttgtacggcccatggtgcctgagaaaataacattcattcctgttgaaatagggagcagtgtactttggttaaccggaagagatgcctttttttttccctcttggatatcattatgcacaagtttttcccccatatggcgagtgttatgtaataaatgatatggcaaccctgtctctggaaataattatcatgcatcttaagtgaaagaagcaaaatacatacattttggttttctcct

SEQ ID NO: 1776 - DNA, 2111 bp, Zea mays
tccctggttccctgcctcctctgtatactaactctcctctctcccagagtcccggtcagctcgactgctccagttcttcccatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaaagtgcgccgctaaggtgaatatggactatggccttgatccaacaatagggaaggccataatacaggcagctgaggaggtcgcagagggaaagttggatgatcacttcccacttgttatctggcaaactggcagtggcacacaaagcaacatgaatgccaatgaggtaattgcaaatagggcatctgagatccttggacacaagcgcggtgagaagtttgtgcacccaaatgaccatgtgaataggtcacaatcttcaaatgatacatttcccactgtaatgcatatagcgacggccgttgagatacattcgaggtttatcccaagtttgcaacagttgcatgattcacttcattcgaaaactattgagtttaaagacataattaaaattggacgtacacatacccaagatgccaccccattgactcttggccaagaattcagtggctacactacacaggtcaaatatggaattgaccgcattaattgtacattacctcggatgtaccagcttgctcaaggtggaactgcagttggaactggcttgaacaccaagaaaggatttgatgccaaaatagctgctgcagtggctgaggaaacaaacctaccctttgtgacagcagagaacaagtttgaagctttggcagcacatgacgcttttgttgagagcagtggtgccgtaaatacaatttctgcatctcttatgaagatagcaaacgacatacgtttgctaggaagtggtcctcggtgtggtcttggtgaactaatcctaccagaaaatgagcctgggagcagcattatgcctgggaaagttaatccaacccagtgtgaggctctgacaatggtttgtgcacaggttatgggtaatcatgttggtgttacaattggtggtgccaatgggcattttgaactgaatgtttttaagccaatgatcgcagccggattacttcgatcattgaggttgttaggggatgcatccgtgtcctttgagaaaaattgtgtcaggggaattcaagcaaaccacaagagaatttcacaacttttgcatgagtctctgatgttagtgacatctttgaaccctaaaattggctatgacaatgctgcagctgttgctaagaaagcccacaaagaaggaaccacgttgaaggaagctgcattagaccttggagtattaacggagcaagaattccatgagcttgtcgtcccggagaaaatgattggtccttctgattgataaccccatgttcactatgtttctttgaagcattcaggttgccacatccgcgagttctggtggccctgtgtttccaagttaatgattctagcgcacccataaataaagcaaataatttttcatatggtcattaggtcctcaccgtaccgcactagagaaatgatttttgcatggcggatggtatctgagaaaacagttgtattcttgttcaaatagggagcagtgcactttgattcatgaggcgccttccattatcttggcatcagtcaaccttttcttgccaagtagctagtgctatgtaacaagtgacatggcaaccatgtatagaaattatttgcatgggtttgtgttcttgccaggtagctaatgttatgtaataagtgacaaggaaacaatgtcatgaattatttgcattgggttttgacgagtgaaatagaaatatacgccctgttttagttttctttttagggctagtttga

SEQ ID NO: 1777 - DNA, 2063 bp, Zea mays
cccggtcagctcgactgctccagttcttcccatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaaagtgcgccgctaaggtgaatatggactatggccttgatccaacaatagggaaggccataatacaggcagctgaggaggtcgcagagggaaagttggatgatcacttcccacttgttatctggcaaactggcagtggcacacaaagcaacatgaatgccaatgaggtaattgcaaatagggcatctgagatccttggacacaagcgcggtgagaagtttgtgcacccaaatgaccatgtgaataggtcacaatcttcaaatgatacatttcccactgtaatgcatatagcgacggccgttgagatacattcgaggtttatcccaagtttgcaacagttgcatgattcacttcattcgaaaactattgagtttaaagacataattaaaattggacgtacacatacccaagatgccaccccattgactcttggccaagaattcagtggctacactacacaggtcaaatatggaattgaccgcattaattgtacattacctcggatgtaccagcttgctcaaggtggaactgcagttggaactggcttgaacaccaagaaaggatttgatgccaaaatagctgctgcagtggctgaggaaacaaacctaccctttgtgacagcagagaacaagtttgaagctttggcagcacatgacgcttttgttgagagcagtggtgccgtaaatacaatttctgcatctcttatgaagatagcaaacgacatacgtttgctaggaagtggtcctcggtgtggtcttggtgaactaatcctaccagaaaatgagcctgggagcagcattatgcctgggaaagttaatccaacccagtgtgaggctctgacaatggtttgtgcacaggttatgggtaatcatgttggtgttacaattggtggtgccaatgggcattttgaactgaatgtttttaagccaatgatcgcagccggattacttcgatcattgaggttgttaggggatgcatccgtgtcctttgagaaaaattgtgtcaggggaattcaagcaaaccacaagagaatttcacaacttttgcatgagtctctgatgttagtgacatctttgaaccctaaaattggctatgacaatgctgcagctgttgctaagaaagcccacaaagaaggaaccacgttgaaggaagctgcattagaccttggagtattaacggagcaagaattccatgagcttgtcgtcccggagaaaatgattggtccttctgattgataaccccatgttcactatgtttctttgaagcattcaggttgccacatccgcgagttctggtggccctgtgtttccaagttaatgattctagcgcacccataaataaagcaaataatttttcatatggtcattaggtcctcaccgtaccgcactagagaaatgatttttgcatggcggatggtatctgagaaaacagttgtattcttgttcaaatagggagcagtgcactttgattcatgaggcgccttccattatcttggcatcagtcaaccttttcttgccaagtagctagtgctatgtaacaagtgacatggcaaccatgtatagaaattatttgcatgggtttgtgttcttgccaggtagctaatgttatgtaataagtgacaaggaaacaatgtcatgaattatttgcattgggttttgacgagtgaaatagaaatatacgccctgttttagttttctttttagggctagtttgacc

SEQ ID NO: 1778 - DNA, 1996 bp, Pennisetum glaucum
gtcgcccccctccaccagccgccgctcctcccttcacgcgccgcccacgcagctgacctagcagagaatcatcccgagatggcgatggccctgcgccgcctcgcgggcgtgcctggctcgccgtcgcccgccgcggccgcgctgctcctacggccggtgctgacccgcccgatctccaccggcttccgtgaggagcgcgacaccttcggccccatccaggtccccaacgacaagctgtggggcgcgcagacgcagaggtcgctgcagaacttcgacattggcggcgagcgcgagcggatgcccgtgcccatcattcgcgcctttggtgtgctcaaaaagtgcgccgctaaggtgaatatggagtatggccttgatccaacaataggtaaggcaataatgcaggcagctgaggaggtcgcagagggacagttggatgatcacttcccacttgttatctggcaaactggcagtggcacacaaagcaacatgaatgccaatgaggttattgcgaatagggcagctgagattcttgggcacaagcggggtgggaagtttgtacatccaaatgaccatgtcaataggtcacaatcttcaaatgatacatttcccactgttatgcatatagcagcagctgttgagatcaattcaaagtttatcccaagtttgcaacagttgcatgattcacttcatgcgaagtctgttgagtttaatgacataattaaaattggacgtacacatacccaagatgcgaccccgttgactcttggccaagagttcagtggctacactacacaggtcaaatatggaattgaccgaattagttgtacattaccacggatgtatcagcttgctcaaggtggaactgcagtcggaactggcttgaacactaagaagggatttgatgtcaaaattgccgctgcagttgctgaagaaacaaatctaccctttgtgacagcagagaacaagtttgaagctttggcagcacatgatgcttttgttgagagcagtggtgccgtaaacacaatatctgcgtcccttatgaagatagcaaacgacattcgcttgctgggaagtggccctcgctgcgggcttggtgaactaatcctgccagaaaatgagcctgggagcagcattatgcctggaaaagttaacccaacacagtgtgaggctctgaccatggtttgcgctcaggttatgggtaatcatgttggtgttacagttggtggtgcgaatgggcattttgaactgaatgtttacaagccaatgattgcagctggattacttcgatcattgagattgttgggggatgcttctgtgtctttcgagaaaaattgtgtcagaggcattcaagcaaaccgtaagaggatagaacaacttttgcatgagtctctgatgttggtgacatctttgaaccctaaaatcggctatgacaatgctgcagctgttgcgaagaaagctcataaagaaggaaccacattaaaggaagctgcattagaccttggagtattaacggaagaagaattccatgagctcgttgtcccggaaaaaatgatttgcccttgtgatgattgacaaccccatgctagctacatcagagtttcagtggttgcctgtggtgtcagaattcatgatcccggcccaacataaagcaaatcaaatttcatatcattgttactcacccccattggaggcatgattttgtacgggcgtacggcccatggtgcctgagaagacaacattcattcctgttcaatcgggagcattgtactttgattaactggaagagatgccttttcagttccccccctctcttggacgtcggaacaactttcttcccatatggcttgcgttacctaatactaggtgataccccgcgcgttgctgcgagaattttttaaacaaaattttaaggtgaaatgtgaaagtagtgacatcaaatatattacatggcaatattcgtttgtaaactcattatatatgaaagcatgttattttg

SEQ ID NO: 1779 - DNA, 1887 bp, Triticum aestivum
ctcctccctcccttcccaggttccccgtcccgttcaccagccgccgcttccctccgctaggctctacgcgacgcaaaaacttacgagagggcccggagatggcgatggttctgcggcgcctcgccggcgcatcaggctcgccttcggcggctgcactgctgctccggccggcgctgacccgcccgatctccaccggcttccgcgaggagcgcgacacgttcggccccatccgcgtgcccaacgacaagttgtggggcgcgcagacacagagatcgctgcaaaatttcgacattggcggcgagcgcgagcggatgcctgtgcctatcatccgcgcctttggcgtgctaaaaaagtgcgccgctaaggtgaatatggagtatggccttgatccaacaattgggaaggcaataatgcaggcggccgaggaggttgcagagggaaagttggatgatcactttccgcttgttatctggcaaactggcagtggcacacaaagcaacatgaatgccaatgaggtaattgcaaatagggctgctgagatacttggacataagcgtggtgacaagtttgtacaccctaatgaccatgtgaacaggtcacagtcctcgaatgatacatttcccactgttatgcacatagcagcagctgtagagatcaattcaaggtttatcccaagtctggagcagttgcataagtcacttcattcaaagtctgatgagtttaaagacatcattaaaattggccgtacacatacccaagatgccaccccactgactcttggtcaagagttcagtggttatgctacacaggtgaaatatggaattgaccgaattgcatgtaccttaccaaggatgtatcagcttgctcaaggtgggactgcagttggtactggcttgaacacgaagaaaggatttgatggcaaaattgcagctgctgtggctgaggaaacagaactacctttcgtgacagcagagaacaagtttgaagctttggcagcacatgatgcttttgttgagagcagtggtgctgtgaacacaatttctgcatctcttatgaagatagcaaatgacatacgcttgctgggaagtggccctcgttgtggacttggtgaacttatcctaccagaaaatgagcctgggagcagcattatgcctggaaaggttaatcctacccagtgtgaggctctgaccatggtttgtgctcaggttatgggcaatcatgtcggtgttacaataggtggttcaaatgggcattttgaactgaacgtttataagccaatgattgctgctggattgcttcgatcattgagattattaggggatgcatctgtatcctttgagaaaaactgtgtcaggggaatagaagcaaaccataagagaatttcacaattgttgcacgagtctttgatgttggtgacatcgttgaaccccaaaattggctatgacaatgctgcagccgttgctaagaaagctcacaaagaaggaacaacactgaaggaagctgctttaagccttggagttttgacggaaaaggaattccatgaactcgttgttccagagaaaatgattggcccttctgattaaaagcatcctgttagttatacttctcatcgaagcgttcaggttaccacttcgtggttcctagcccatccgtaaataaggcaagccagatttaacatcttcatttcctcgcccactgggagagttaattttgcgcaactaatggtgccggagaaaaacattttttcctgttaatcgtacaggaagtgtgttttgatttattggaaccttattggaaatagttttttttctccttggatattatcagcacgccaacttttacccaacgtggcgaatgttcatgtaataagtgctacgtatattgtaa

SEQ ID NO: 1780 - DNA, 1945 bp, Triticum aestivum
ccttcttctactcctccctccctccctcccttcccaggttccccgtcccgttcaccagccgccgcttccctccgctaggctctacgcgacgcaaaaacttacgagagggcccggagatggcgatggttctgcggcgcctcgccggcgcatcaggctcgccttcggcggctgcactgctgctccggccggcgctgacccgcccgatctccaccggcttccgcgaggagcgcgacacgttcggccccatccgcgtgcccaacgacaagttgtggggcgcgcagacacagagatcgctgcaaaatttcgacattggcggcgagcgcgagcggatgcctgtgcctatcatccgcgcctttggcgtgctaaaaaagtgcgccgctaaggtgaatatggagtatggccttgatccaacaattgggaaggcaataatgcaggcggccgaggaggttgcagagggaaagttggatgatcactttccgcttgttatctggcaaactggcagtggcacacaaagcaacatgaatgccaatgaggtaattgcaaatagggcggctgagatacttggacataagcgtggtgacaagtttgtacaccctaatgaccatgtgaacaggtcacagtcctcgaatgatacatttcccactgttatgcacatagcagcagctgtagagatcaattcaaggtttatcccaagtctggagcagttgcataagtcacttcattcaaagtctgatgagtttaaagacatcattaaaattgggcgtacacatacccaagatgccaccccactgactcttggtcaagagttcagtggttatgctacacaggtgaaatatggaattgaccgaattgcatgtaccttaccaaggatgtatcagcttgctcaaggtgggactgcagttggtactggcttgaacacgaagaaaggatttgatggcaaaattgcagctgctgtggctgaggaaacagaactacctttcgtgacagcagagaacaagtttgaagctttggcagcacatgatgcttttgttgagagcagtggtgctgttaacacaatttctgcatctcttatgaagatagcaaatgacatacgcttgctgggaagtggccctcgttgtggacttggtgaacttatcctaccagaaaatgagcctgggagcagcattatgcctggaaaggttaatcctacccagtgtgaggctctgaccatggtttgtgctcaggttatgggcaatcatgtcggtgttacaataggtggttcaaatgggcattttgaactgaacgtttataagccaatgattgctgctggattgcttcgatcattgagattattaggggatgcatctgtatcctttgagaaaaactgtgtcaggggaatagaagcaaaccataagagaatttcacaattgttgcacgagtctttgatgttggtgacatcgttgaaccccaaaattggctatgacaatgctgcagccgttgctaagaaagctcacaaagaaggaacaacactgaaggaagctgctttaagccttggagttttgacggaaaaagaattccatgaactcgttgttccagagaaaatgattggcccttctgattaaaagcatcctgttagttatacttctcatcgaatcgttcaggttaccacttcgtggttcctagcccatccgtaaataaggcaagccagatttaacatcttcatttcctcgcccactgggagagttaattttgtgcaactaatggtgctggggaagaaacattttttcctgttaatcgtacaggaagtgtgttttgatttattggaaccttattggaaatagttttttttctccttggatattatcaggacgccaacttttacccaacgtggcaaatgttgatctaataagtgctacgtatattgtaatcatgttcttgaaaaataattaactttcatctcgaggac

SEQ ID NO: 1781 - DNA, 1954 bp, Hordeum vulgare
cggcacgaggcattcccctcctccccccttccccggttctcatcagccgccgcttccctccgctaggctctacgcgacgcgaaaacttacgagaaggcctcgagatggcgatggttctgcgacgcctcgcgggcgcatcaggctcgccgtcggcggctgcactgctgctccgtccggcgctgacccgcccgatctccaccgacttccgcgaggagcgcgacacattcggccccatccgcgtacccaacgacaagttgtggggcgcgcagacacagagatcgctgcaaaattttgacattggcggcgagcgcgagcggatgcccgtgcctatcatccgcgcctttggcgtgctaaaaaagtgcgctgctaaggtgaatatggagtatggacttgatccaacaattgggaaggcaataatgcaggcggctgaggaggttgcagagggaaagttggatgatcactttccgcttgttatctggcaaactggcagtggcacacaaagcaacatgaatgccaatgaggtaattgcaaacagggcagctgagatacttggacataagcgtggtgacaagtttgtacaccctaatgatcatgtgaacaggtcacagtcctcaaatgatacatttccaactgttatgcacatagcagcagctgtagagatcaattcaaggtttatcccaagtctggagcagttgcataagtcacttcattcaaagtctgatgaatttaaagacattattaaaattgggcgtacacatacccaagatgccaccccactgactcttggtcaagagttcagtggttatgctacacaggtgaaatatggaattgaccgaattgcatgcaccttaccaaggatgtatcagcttgctcaaggtgggactgcagtcggcactggcttgaacacgaagaaaggatttgatggcaaaattgcagctgctgtggctgaggaaacagaactacctttcgtgacagcagagaacaagtttgaagctttggcagctcatgacgcttttgttgagagcagtggtgctgtgaacacaatttctgcatctcttatgaagatagcaaatgacatacgcttgctgggaagtggccctcgttgtggacttggtgaacttatcctaccagaaaatgagcctgggagcagcattatgcctggaaaggtcaatcctacccagtgtgaagctctgaccatggtttgtgctcaggttatgggtaatcatgtcggtgttacaataggtggttcaaatgggcattttgaactgaacgtttataagccaatgattgctgctggattgcttcgatcattgagattattaggggatgcatctgtatcctttgagaaaaactgtgtcaggggaatagaagcaaaccataagagaatttcacaattgttgcacgagtctttgatgttggtaacatcgttgaaccccaaaattggctatgacaatgctgcagctgttgctaagaaagctcacaaagaaggaacaacactgaaggaagctgctttaagcctcagagttttgacggaaaaggaattccatgaactcgttgttccagagaaaatgattggcccttctgattaaaagcatcctgttagttacacaagcgttcaggttaccacttcgtggttcctaccccatctgtaaataaggcaagccagattaaacatcttcatttccccatgaggagagttaattttgcacaactaatgatgccggagaaaaacattttttcctgttaatcatacaggaagtgtgctttgatttattcgaatagttttttttcttggatattatcagcatgccaacttttacccaatgcggcgaatgttcatgtaataagtgctgcgtatattgtaatcatgttcttgaaaaacaattagcattcatctatagaggacaaatagaaggaaagatgtacatgaattccgtttttttataagaacgca

SEQ ID NO: 1782 - DNA, 1955 bp, Hordeum vulgare
cggcacgaggcattcccctcctccccccttccccggttctcatcagccgccgcttccctccgctaggctctacgcgacgcgaaaacttacgagaaggcctcgagatggcgatggttctgcgacgcctcgcgggcgcatcaggctcgccgtcggcggctgcactgctgctccgtccggcgctgacccgcccgatctccaccgacttccgcgaggagcgcgacacattcggccccatccgcgtacccaacgacaagttgtggggcgcgcagacacagagatcgctgcaaaattttgacattggcggcgagcgcgagcggatgcccgtgcctatcatccgcgcctttggcgtgctaaaaaagtgcgctgctaaggtgaatatggagtatggacttgatccaacaattgggaaggcaataatgcaggcggctgaggaggttgcagagggaaagttggatgatcactttccgcttgttatctggcaaactggcagtggcacacaaagcaacatgaatgccaatgaggtaattgcaaacagggcagctgagatacttggacataagcgtggtgacaagtttgtacaccctaatgatcatgtgaacaggtcacagtcctcaaatgatacatttccaactgttatgcacatagcagcagctgtagagatcaattcaaggtttatcccaagtctggagcagttgcataagtcacttcattcaaagtctgatgaatttaaagacattattaaaattgggcgtacacatacccaagatgccaccccactgactcttggtcaagagttcagtggttatgctacacaggtgaaatatggaattgaccgaattgcatgcaccttaccaaggatgtatcagcttgctcaaggtgggactgcagtcggcactggcttgaacacgaagaaaggatttgatggcaaaattgcagctgctgtggctgaggaaacagaactacctttcgtgacagcagagaacaagtttgaagctttggcagctcatgacgcttttgttgagagcagtggtgctgtgaacacaatttctgcatctcttatgaagatagcaaatgacatacgcttgctgggaagtggccctcgttgtggacttggtgaacttatcctaccagaaaatgagcctgggagcagcattatgcctggaaaggtcaatcctacccagtgtgaagctctgaccatggtttgtgctcaggttatgggtaatcatgtcggtgttacaataggtggttcaaatgggcattttgaactgaacgtttataagccaatgattgctgctggattgcttcgatcattgagattattaggggatgcatctgtatcctttgagaaaaactgtgtcaggggaatagaagcaaaccataagagaatttcacaattgttgcacgagtctttgatgttggtaacatcgttgaaccccaaaattggctatgacaatgctgcagctgttgctaagaaagctcacaaagaaggaacaacactgaaggaagctgctttaagcctcagagttttgacggaaaaggaattccatgaactcgttgttccagagaaaatgattggcccttctgattaaaagcatcctgttagttacacaagcgttcaggttaccacttcgtggttcctaccccatctgtaaataaggcaagccagattaaacatcttcatttccccatgaggagagttaattttgcacaactaatgatgccggagaaaaacattttttcctgttaatcatacaggaagtgtgctttgatttattcgaatagttttttttcttggatattatcagcatgccaacttttacccaatgcggcgaatgttcatgtaataagtgctgcgtatattgtaatcatgttcttgaaaaacaattagcattcatctatagaggacaaatagaaggaaagatgtacatgaattccgtttttttataagaacgcaa

SEQ ID NO: 1783 - DNA, 2041 bp, Brachypodium distachyon
tccccagtcccgttcaccagccgccgcttccctgcgctccgctccacgaggcgcggaaacctacgagagggccccgagatggcgatggttctgcggcgcctcgcgggcgcgtccggctcgccgtcggcggccgcactgctgttccgcccggcgctgacccgcccgatctccaccggcttccgcgaggagcgcgacacattcggccccatccgtgttcccagcgacaagctgtggggggcgcagacgcagagatcgctgcagaattttgacatcggtggcgagcgcgagcggatgccggtgcctatcatccgcgcctttggcgtgctcaaaaagtgcgccgctaaggtgaatatggagtatggccttgatccaacaattgggaaggcaataatgcaggcagctgaggaggtcgcggaaggaaagttggatgatcactttccgcttgttatctggcaaactggcagtggcacacaaagcaacatgaatgccaatgaggtaattgcaaatagggcagctgagatacttggacataagcgtggtgataagtttgtacaccctaatgaccatgtgaataggtcgcagtcctcaaatgatacatttcccacggttatgcacatagcagcagctgtagagatcaattcaaggtttatcccaagcttggagcagttacataagtcactccactcaaagtctgatgagtttaaagacattatcaaaattggacgtacacacacccaagatgccacccctttgactcttggtcaagagttcagtggttatgctacacaggtgaaatatggaattgatcgaattgcatgtaccttaccaaggatgtatcagcttgctcaaggtgggactgcagttggaactggcttgaacactaagaaaggatttgattgcaaaattgctgctgcagtggccgaggaaaccgatttacctttcgtgacagcagagaacaagtttgaagctctggcagctcacgatgcttttgttgagagcagtggtgccgttaacacaatttctgcatcacttatgaagatagcaaatgacatacgtttgctgggaagtggccctcgatgtggacttggtgaacttagcctaccagaaaatgagcctgggagcagcattatgcctggaaaagtcaatcctacccagtgtgaggctctgaccatggtttgtgctcaggttatgggtaatcacgttggtgttacaataggtggttcaaatggccattttgaactgaatgtttttaagccaatgattgcagctggattgcttcgatcgttgagattattaggggatgcatctgtgtccttcgagaaaaactgtgtgaggggaatagaagcaaaccacaagagaatttcacaattattgcacgagtctttgatgctggtgacatctttgaaccctaaaattggctatgacaacgctgcagccgttgctaagaaagcccacaaagaaggaacaacactgaaggaagctgctttaagccttggagttttgacggaaaaagaattccatgaactcgttgttccagagaaaatgattggcccttctgattgatagcatccaggttggcacttggttcctaaacctgtggtagtgtcatgcctgtgccgtggactgtcatactacctcaagctcatccgtaaataaagcaagccgatttcacaccttcaattcttcctcgcgcccattggagagttaattttgcattaacaatggtttgattaattggaatagatgccatccatttcttcgatatcagcatgccatcttttcccccccacatggcatgtaataagtgatatacggtgttgtgtccatggaaaatattaccattcatcttaagaacaaatgaaagcagagggataacatgctacttttctatctgtattttgatagaaaggaaagagaataattaccatgcttagtttattttagcatattttgattggcacaatcctttgaccaacaattgtgtcactaatatgcaatttatgtgacatgaaattgaggcagctagattcttgttaaaaat

SEQ ID NO: 1784 - DNA, 2001 bp, Oryza sativa
cccctccgtcgtccaccaacctgcctgcctttctctctctgacttctctccccacattcgccagccgccgcttccctcgccgccgtacgacacctcctagtaggagggagagagagagaggcggcgcacgagatggcgatggtcctgcggcgcctcgcgggcgcgtccgccggtggcgccccgtcgccggcggcggcagcggccgcggccgcgctgctgctccgcccggcgctggctcgcccgatctccaccggcttccgcgaggagcgcgacaccttcggccccatccgagtccccaacgacaagctgtggggcgcgcagacgcagaggtcgctgcagaacttcgacatcggcggcgagcgcgagcggatgccggtgcccatcatccgcgcctttggggtgctcaaaaagtgcgccgctaaggtgaatatggagtatggccttgatccaacaatcgggaaggcaataatgcaggctgctcaggaggttgctgaaggacagttagatgaccactttccacttgttatctggcaaactgggagtggcacacaaagcaacatgaacgccaatgaggttattgcaaatagggccgctgagattcttggacataagcgtggcgagaagtttgtacaccctaatgatcatgtgaacagatcacagtcctcaaatgatacatttcccactgtcatgcacatagcagcagccacagagatcaattcaaggtttgtcccaagcttgcaacagttgcataagtcacttgattcaaagtctgttgaatttcaagacataattaaaattgggcgtacacatacccaagatgccaccccattgacccttggccaagagttcagcggttacgccacacaagtgaaatatggaattgatagaattgtttgtaccttaccacggatgtatcagcttgctcaaggtggaactgcagttggaacgggcttgaacactaagaaaggatttgatgtcaaaattgctgctgcagtagctgaggaaacggaactacctttcgtgacagctgagaacaagttcgaagctttggcagcgcatgatgcttttgttgagagcagtggtgctgtaaacacaatttctgcatctcttatgaagatagcaaatgacatacgcttgttaggaagcggcccccgatgtggacttggtgaacttatcctacctgaaaatgagcctgggagcagcattatgcctggaaaagttaaccctacccagtgtgaggccttgaccatggtttgtgctcaggttatgggtaatcatgttggtgtcacagtaggtggttcgaatggacattttgagttgaatgtctttaagccaatgattgcagctggattacttagatcactgagattgctaggggatgcctctgtgtcctttgagaaaaactgtgtcaggggaattcaagcaaaccataagagaatttcacaattattgcacgagtctttgatgttggtgacatctttgaaccctaaaattggctatgacaatgctgcagctgttgctaagaaagcacacaaagaaggaagcacattgaaggaagctgctctagacctcggagtattgacagaatcagaattccatgagcttgttgttccagagaaaatgattggtccttctgattgatagcgactaatgtattcctgtcctgtggatttcctagctctagctcacccgtaaataaagcaagccagacatttacatcttcagttccttatcgtattgaagagtttgtttttgcactgcaaatggtgccggagaaaacaagattccattcctgttactgaaatagtaaacagtatattttgattcattgaagtagatgctttttatttctagggcatgccatccttttcccaatggcgaatctgcatgtaataagttaatgtagcaaccatgcccgtggaaatattatcacatttgacttgagaacaaatgaatgaaatatatttggattatgtttattttttaagaaaatagattaaa

SEQ ID NO: 1785 - DNA, 2176 bp, Aristolochia fimbriata
cgcgagtccgcaaaagcgtacgcagtgtcgcagtctacgttctaaaattttccaaataaagcggagccgccgctaactaggagactgagcgctattggagggcgtcgagtcgattctcagctacctgccttttgtaaaccatctctgcgcctagtccggatcagtgggatccgaagctcgaaaatggcaatgtttatcgcctccaggcgcttgtcaggcttctcaaccttccgtacaactggagtaagatggatgtcaacttccttcagggaggaaagagacacgtttggacccatacaagtgccttctgacaagctatggggtgctcaaactcaaagatcattacaaaattttgacattggtggggagcgtgagcagatgccagaaccaattatccgtgcctttggaattttaaagaagtgtgctgccaaggttaatatggagtatggtcttgatccatcaatcggaaaagctataatgcaagctgctcaggaagttgctgaaggaaagttgaatgatcatttcccactagtgatatggcagactggcagcgggacccaaagtaacatgaatgctaatgaggtgattgctaatagggctgctgagattttggggcataagcgtggagaaaagcttgtccatccaaacgatcatgtcaataggggtcaatcttctaatgacacgtttcctactgtcatgcacattgctgcaggagttgaaataaattcaaggtttattccgagcttgaaacaattacatacctccctgcattcgaagtctatcgagttcaaggacattataaagattggacgtactcacactcaagatgcaacacctctaactcttgggcaggaatttagtggctacaccactcaagtgaaatatggaattgatagagtcatggttactctaccacggatgtaccagttagcacagggtggtactgctgtaggaactggattgaacactaaaaaggggtttgatgtgaaaattgctgctgcagtagctgaagaaactaatttgccatttgtcacagctgaaaacaaatttgaagctttggctgcacacgatgcatttattgaaaccagtggagctttaaacacaatatctgcatctctcatgaagattgccaatgatataaggctgctcggaagtggacctcgatgtggtcttggagaacttatcttaccagaaaatgagccagggagcagcatcatgcctggaaaggttaaccctacacagtgtgaggctctcactatggtttgcgctcaggtcatgggtaatcatgtagctatcactgttggtgggtccaatggtcattttgaacttaatgtattcaagccaatgattgccagcgggcttttgaggtcattgagattgcttggagatgcatcggcatcctttgagaaaaactgcgtaagaggaatcaaggctaatacagaaaggatttcaaagttattgcatgagtccctcatgcttgtcacatccttgaaccctaaaattggttatgacaaggctgcagctgtggccaagaaagcgcacaaggaaggaagcaacttaaaggaagcggcgctgaaccttggcgtgctcacagcccaggaatttgatgagctcgtagttcctgagaagatgattggtccctcggattgagagggagatgatccaataatgaccccatttaacttacctggaggtaccatttttcatcctcttttgttcggcgcctcagtccaataaaatgccatttgtttcctaggtcatagccaagtgccctttttggggcaatttttgtgttgtactagtgagcaactaccgactgcagctggtagccacacgcatgattattttaaggggaccaagaggccaagcacccttttgtagtgagaagcaaggaatgacagaagaggaaatattacattcatccgaataatcctttggcaatacgaaattttttgggcagaatccctttttgtttgattgcagatatttgtgatagtaatcctagctggttatatgcgtggatccaattcgagagatgagagaagagaagacgcttctgtttgagtacctatttcctgccttttaatttattataaatttaaaatgtttaataatttatttcattctcctcttgtttcgagaagttttttattaataaaaattcgaaatagagttg

SEQ ID NO: 1786 - DNA, 1898 bp, Aquilegia formosa
ctcacactccacgtttccatttctttctctccggcgacgagcagccacttttatcccagttctccgacaatcttccattaatcccggcgaggattcaaaatggcactgcttaccgcttctcggcgaatctcatcgtctacattagcaactacgttgcgttatgcttgtttcagatcattctcaactgtgtttcgggaggagagagatacttttggaccgattcaagttccttctgataagttgtggggagctcagacacaaagatcattgcagaattttgatattggtggagagcgtgaacaaatgcctgaaccaattattcgtgctttcggcgtccttaagaaatgtgctgccaaggtgaacatggactatggtcttgatcctactatagggaaggcaataatgcaagctgctcaagaagtttccgagggaaaattgaatgatcagtttccacttgtcatatggcagactggtagtggaactcagagtaacatgaatgccaatgaggtgattgcaaatagagcttctgagattcttggtcacaaacgtggtgaaaaatttgtgcatcccaatgaccatgtcaatcgctcacaatcttcaaatgatacatttccaactgtcatgcacattgcttcagcagtcgagataaattcaagctttattccaaaattaaagcagttacacacttcattagagtccaagtcttttgaattcaaagatattattaagatcggacgtacacacactcaagatgcaacacccttaactcttgggcaagagtttagtggttatactactcaagttaagtatggacttgatcgtgtcatgtgtaccctaccccgcatgtatcagcttgcgcaaggtggtactgctgtaggtactggactgaacacaaagaaggggtttgatgtgaagattgccaatgccgtggcggaggagactaatctaccatttattacggctgaaaacaaatttgaagctctggctgctcatgatgcttttgttgaaactagtggagccttgaacacagtttcagtttctcttatgaagattgcaaatgacatacgtcttctaggaagcggtccacgttgcggccttggtgaattaattctacctgaaaatgagccaggaagcagtattatgcctggaaaggttaaccctactcaatgtgaggcacttaccatggtttgtgcccaggttatgggaaatcatgttgccattacagtgggtggatctaatggtcattttgaactcaatgtatacaagccaatgattgccagtggtcttctacgttcattgaggttgctaggagatgcatctgcatccttcgagaaaaactgtgtaaggggaattcaagccaaccgtgataggatttcaaagttactgcatgaatcactgatgcttgttacttctttgaaccctaaaattggctatgacaatgctgctgcagttgccaagaaagcacacaaggaaggaagtactctaaaggatgcggcattaatgctgggtgtacttacatctgaagaatttgaccagcttgttgtacctgagaagatgattggtccctctgactgaatgacgacatgcttacagctgatggattttggcattttttcctcccgtcgatcatctaaaaaaagacgacaaggggtgctcaattctaataagcctatttcatgaacttcataacaatttagctgattttggggagcttgagtcatgcttgtagtttattgagctaatgagaaagctccactcattttgtaaagggaacaacaaacaccaaaggatatagagaattgaacataaaataatattttttcggagcaaataaagcttttgtaaatgaaagagaatagcaaaattccgaggcctgctatgcctatgaaatcttgacc

SEQ ID NO: 1787 - DNA, 2100 bp, Eucalyptus grandis
cggaaatggcggcctacgtcgtgtccaggcgcctctcgagcggatcggcggcgccgtcgcacctcgccggcgcgctgcgctacgcggcttgctggagatcgtattcgactggcttccgggaggaaagggacacttttggacccatcctcgtcccctccgacagattgtggggagcgcagacgcagaggtcgctgcagaatttcgacatcgggggcgagcgggagcggatgcccgagccgattgtgcgagctttcggggtcctgaagaagtgtgctgccaaggttaacttggaatatggtcttgatccttccataggagaagccataatgcaagcagctcaagaagtagctgagggaaagttgaatgatcattttccccttgtcatatggcagactggcagtggcactcaaagtaacatgaatgccaatgaggtgattgcaaacagagcagctgaaattcttggccgtaagcgtggagaaaagtttgtgcacccaaatgaccatgtgaaccgatctcaatcttctaacgacactttcccaactgtgatgcatattgcggctgcaatggaaataaattcaagattattgccaagtctggggaacttgcattcttctcttcactcaaagtccatcgaatttaaggatattgttaagattggacgaactcacactcaggatgcaactcctttgacactggggcaagagtttagtggctatagtacccaagttaagtatggaattgaccgtgtcaactgcactctacctcgtatgtaccagcttgcacaaggcggtactgctgtaggtaccggtctgaatacaaagaaagggtttgatgtaaagatagctgcagcagtagctgaggaaactagtttacctttcatcactgcagaaaacaagtttgaagccttggctgcacatgatgcttttgtggagacaagtggtgcccttaacacagtagctacttctctcatgaagattgctaatgacattcgttttttgggaagtggtccccgttgtggccttggggaacttattcttccagaaaatgagcctggcagcagtattatgccggggaaagtcaaccctacccaatgcgaggctcttaccatggtttgtgcacgggttatgggaaatcatgtagccgttacagtgggcggatcaaatggccattttgagctgaatgttttcaagccaatgattgctagtggtctcttacaatcactaagactactgggggatgcctcttcttcctttgacaagaattgcgtccatggaattcaagctaacagggaaagaatttcaaagttactgcatgagtcattaatgcttgtcacatccttgaaccccaaaattgggtatgataatgctgctgcagttgccaagaaagcccacaaggagggatctactttgaaggaagctgctctaaaacttggagtccttacaagtgaagagttcgacaatcttgtcgtgcctgagaaaatgattggaccatctgactgaaaagaacaatagattctcaagacaatcgatactcttaactaacggaagattagctattattacaattttccccggcatttttgtctgctccctatgaagggtagagggcttatcggatcattaatttaagaactctattattgagtgggattctatcgattggtctcaagctcttattagtgacgcagttgataaggttctcttcatctctgcttgtcgaggtttgtactgttgacacaagcagtaaacagaggcaataaggaggcctacaatgagcatgttgtatcctagaatttttttgatgcctgaataaaaagggggttcttctcaacccggggatgggggatgccctccttggattgtggcatcaggacgttttttattgtcttatccatctttgacatagaattacattctgcttgagagtcttcctagagattggcagtttttacttagtgggttatttactttttagcggtttgtgtacatgcataaaaagtcttagcactaacaagcagatcaaaagcaaccttactatttaattaaaatttcttcatggaactgtagagttattcttgttgagaacatttgcctcacttaa

SEQ ID NO: 1788 - DNA, 1931 bp, Prunus persica
atttttttatattaaaaaaaaccagtccaaaagcatcccactttctggcacgccgcccaatcatttggactcagccagccaatcacccaacttccattccctacttcgctcgccctctctatcatctctggcccttcaccactccgatcactgactcgtttatccccaaaccgcatcctgcctcgttttccagctcaagctcctgcttatggcgatgtacatcatatcgcggcgagtagtaggtggatcgacgccgtcaactgcgttccgttatgctacttgttggagaccctattcgacgtcgtttagagaggaaagagacacctttggacccattctcgttccctcagacaagttgtggggggcgcaaactcaaagatcgttgcagaatttcgatatcggtggcgagcgtgaacgaatgcccgaacctattgttcgcgcctttggcgtactcaaaaaatgtgctgccaaggtgaacatggagtatggtcttgatccaactataggcaaagcaataatgcaagctgcccaagaagtcgccgagggaaagctaaaccagcactttccacttgttgtatggcaaactggcagtggaacccaaagtaacatgaatgccaatgaggtcattgcgaacagagcagctgagatacttggccataagcgtggtgaaaagattgtccacccaaatgaccatgttaatagatcacagtcttctaatgacacttttccaactgtcatgcacattgcgtctgcagtggaaattaattcaagactaataccaaatttgagaacattgcatacttctctacattcaaagtcagatgaattcaaagatattgttaaaattggacgcactcacacgcaagatgcaacacctttgactcttgggcaagaattcagtggctattcaacacaagtgaagtatggaattgaccgagtcttgtgcactctaccccgcatgtatcagcttgcacagggtggtactgctgttgggactggattgaacacaaagaagggatttgatgtaaagatagctgcggcagtagctgaggaaacaaacttaccatttgtcaccgccgaaaacaagtttgaagctttggctgcacatgatgcttttgttgaaactagcggagccctaaatacagttgctacttctctgatgaaaattgcaaatgacatacgtttattaggaagtggtccacgttgcggccttggtgaactcattctccctgaaaacgagcctggcagcagcattatgcctggcaaggttaaccctactcagtgtgaggctctcacaatggtctgtgctcaggtttttggtaaccatgtggccattacagtaggtggatcaaatggtcactttgaacttaatgtattcaagccaatgattgctagtggtctcctacattctgtgagattgcttggggatgcatcagcttcctttgaaaagaactgtgtaagaggaatcaaagctaatagggaaagaatttcaaaattacttcatgagtcactaatgttggtcacatcgttgaatcctaaaattggttatgacaatgctgcttcagttgcaaagaaagcccacaaggagggatccactttgaaggaagctgcattgaaacttggagtgctaaccagtgaagaatttgatacacttgtggtgcctgagaagatgattggcccatctgactgactgaccgacaggtttagaagctgttgaaaattgatttcccggcatgaattgccttgatgattcgtctttgcattgtctcgccgggtgaaataaggattaaaagtgatgtatgtaattcataacgtttacgaacgatattgttgaggctttttgtaatttgggttaattttgtttacaaaaacagccgccaactgggtcacagaggaggagaatgcctccacaaatttttgtaacaatgtca

SEQ ID NO: 1789 - DNA, 1960 bp, Gossypium hirsutum
ggcttgctttggaacctcctcattggctgctttgctcaccctccgaaactccagaaaagccagagattccccgacaactccggcgataactgtaccccataccctatctctgcccttctcgactaccgcaccctcgttactaagccctttctttgatctgagtaagaaatggcgatgtatatcgtatctcggcgactctccgctggatccaccacctcccagctggtcacctctctccgttatgccacctgctggagatccttctccacgtcttttagggaggaacgagacactttcggccccattaacgttccctccgataaattgtggggagcgcagactcagagatcgttacagaattttgaaattgggggagagcgtgaacggatgcctgaacctattattcgggcctttggtgttctcaagaaatgtgctgccaaggttaacatggaatatggtcttgatccaaccattgggaaagccataatgcaagcagctgaagaagtagccgaaggaaaactcaacgatcactttccgcttgtcgtttggcaaactggtagtggcacccagagtaacatgaatgccaatgaggtaattgctaatagagcagctgagatccttggacatcagcgtggtgaaaagtttgtgcacccaaatgatcatgtgaacagatctcaatcttctaacgacacattccccactgtaatgcacattgcagctgctatggaaataaactcaagattaataccaaaattgaaaattttgcattctactttacattcaaagtctattgaattcaaagatattgttaaaattggtcgcactcacactcaagatgcaacacctttgactcttggtcaagagttcagtggctatactacacaagtcaagtatggaattgatcgagttttgtgcacccttccacgcatgtatcagctagcacaaggtggtactgccgttgggacaggattgaacacaaagaaagggtttgatgcaaaaattgctgctgctgtagcagatgagacaaacttgccatttgtcacagcagaaaataagtttgaagctttggctgcacatgatgcctttgttgaaactagcggagccctaaacactgttgctacatccctgatgaaggttgcaaatgacatacgcttactgggaagtggtccccgatgtggccttggtgagctcattcttcctgaaaacgagccaggcagcagtataatgcctgggaaggtaaaccctacccagtgtgaggctatcactatggtctgtgcccaggtaatgggtaaccatgttgctatcacagtgggcggatccaatggccactttgaattgaatgtgttcaagccaatgattgctaatgcactcctgcattcattaagattgctgggtgacgcatctgcttcatttgagaagaactgcgtgaggggaattcaagccaatagggaaagaatttctaaattactgcatgagtctctaatgcttgtcacatctttgaaccctaaaattggttacgacaatgctgcagcagttgccaagaaagcacacaaggaggggtccactttgaaggaagcagcattgagccttggtgtgctcacaagcgaagaatttgacactcttgtggtgcctgagaaaatgattggcccatctgactgaattttttttttgctagaggagacttaagcagcaattgcttagattttaattaattttaagaccatttttctcagtcggattacaaaatagaatccgaccgcgattttcttcatattccgattatggaaaacaatattattgaggtttcccatttgcttggaattgtttatgcagtttatgtagtgaaaaaaagaatagtcgtggattgactaataaggggaaaacctccctcatttgtaaggagactgattgaagtaaagttgaaggcaaaataaaagagatggcatcgagttttggtaca

SEQ ID NO: 1790 - DNA, 1501 bp, Aquilegia formosa
gattcaaaatggcactgcttaccgcttctcggcgaatctcatcatctacatcagcaactacgttgcgttatgcttatttcagatcgttcttaactgcgtttcgagaggagagagatacttttggaccgattcaagttccttccgataagttgtggggtgctcagacacaaagatcattgcagaattttgatattggtggagagcgtgaacaaatgcctgaaccaattattcgtgctttcggcgtccttaagaaatgtgctgccaaggtgaacatggactatggtcttgatcctactatagggaaggcgataatgcaagctgctcaagaagtttccgaggggaaattgaatgatcagtttccacttgtcatatggcagactggtagtggaactcagagtaacatgaatgccaatgaggtgattgcaaatagagcttctgagattcttggtcacaaacgtggtgaaaagtttgtgcatcccaatgaccatgtcaatcgctcacaatcttcaaatgatacatttccaactgttatgcacattgcttcagcagtcgagataaattcaagttttattccaaaattaaagcagttacaaacttcattagagtccaagtcttttgaattcaaagatattattaagatcggacgtacacacactcaagatgcaacacccttaactcttgggcaagagtttagtggttatactactcaagttaagtatggacttgatcgtgtcatgtgtaccctaccccgcatgtatcagcttgcgcaaggtggtactgctgtaggtactggactgaacacaaagaaggggtttgatgtgaagattgccaatgccgtggcggaggagactaatctaccatttattacggctgaaaacaaatttgaagctctggctgctcatgatgcttttgttgaaactagtggagccttaaatacagtttcagtttctcttatgaagattgcaaatgacatacgtcttctaggaagcggtccacgttgcggccttggtgaattaattctacctgaaaatgagccaggaagcagtattatgcctggaaaggttaaccctactcaatgtgaggcacttaccatggtttgtgctcaggttatgggaaatcatgttgccattacagtgggtggatctaatggtcattttgaactcaatgtatacaagccaatgattgccagtggtcttctacgttcattgaggttgctaggggatgcatctgcatccttcgagaaaaactgtgtaaggggaattcaagccaaccgtgaaaggatttcaaagttactgcatgaatcactaatgcttgttacttctttgaaccctaaaattggctatgacaatgctgctgcagttgccaagaaagcacacaaggaaggaagtactctaaaggatgcggcattaatgctcggtgtacttacatctgaagaatttgaccagcttgttgtacctgagaagatgattggtccctctgactgaatgacgacatgcttaca

SEQ ID NO: 1791 - DNA, 2120 bp, Unknown
  Sequence found in Organisms: Citrus clementina, Citrus sinensis
ggattgaccaaaaggtccaaaactaacccctctcgctgactctcgacgcgcgcagacgcagtcacgactgaccgaccgtttttatctccagtattttctatttgatacctcgattactgcatcgacgccgtctctggatcgcgggtattcactaactggcggttttagacatcttattttgcgtgtgtatttggtagagaaacaaatggcagtttatgttatatcacggcgcctcttgggtggcggatcaacaacttcgcagctggcaggaaccttgcgttatggcgcttgctggagatcctactcgacgtcgtttagagaggaaaaagacactttcggcccaatcctagttccctccgataaactgtggggggcacaaactcaaaggtcgttgcagaactttgatattggcggcgagcgggagcgaatgcccgaaccaattgttcgtgcctttggcatcctcaagaaatgtgctgccaaggtgaacatggagtatggtcttgatccagccatagggaaagcaattatgcaagcagcgcaagaagtagctgaggggaagctaaatgatcactttccacttgttgtctggcaaactggcagtggcactcagagtaatatgaatgctaatgaggttattgctaatagagcagctgagattcttggccataagcgtggtgaaaagatcgtgcacccaaatgaccatgtaaacagatctcaatcttcaaatgacacgttcccaactgtaatgcatatcgcagctgcaatggaaacaaattcaagattaattccaaatttgaaagttttgcataactcactacattcaaagtctgttgaattcaaggatattgttaaaattgggcgcactcacactcaagatgcgacacctttgactcttgggcaagaatttagtggctatactacacaagtgaagtatggcattgaccgagtcatatgctgtctaccccgtatgtatcagcttgcgcagggtggcactgctgtaggaactggactgaacacaaagaaagggtttgatgtgaagatagcttcagctgtagctgaagaaacaagtttgccatttgtcactgcagaaaacaagtttgaagctttggctgcgcatgatgcttttgttgaaactagtggagcccttaacacagttgctgcttctctaatgaagattgccaatgatgtacgcttattgggaagcggtcctcgttgtggtctcggtgaacttattcttcctgaaaatgagcctggcagcagtattatgccggggaaggttaatcctactcaatgtgaagctctcacaatggtctgtgctcaggttattgggaaccatgtggccatcacagtgggtggatcaaatggccattttgaactaaatgtattcaagccaatgattgctagtggtctcctacattcactgagattgctgggagatgcatctgcttcttttgagaagaactgtgtgagaggaattcaagctaatagggaaaggatttccaaattgctgcacgagtcattgatgcttgtcacatccttgaatcctaaaattggttatgacaatgctgcggcagttgccaagaaggctcacaaggagggaactacacttaaggatgctgcattgaaactcggagtactcaatagtgaagaatttgataatcttgtggtacctgagaaaatgattggcccatccgactaaccagcttatgtgggttaaactcctgggatttgcttttggcttttgtatcattttgcgggatatctgtttctgcgccgtttctctccctcaaggcctcaactgaatcacttgatagggatccaaatagtgattttgcttttatttaaaaaaaacaaagaaaggggcaaccaaaaaaaaactatattcttgaggttttcccaggaggaggcttcagtgatatgtcatttcacgtggtgacagaatagcgattggtaggccaacaaagggaagacctccctcatttttttgtgcgacagtgtaataaagaaatgttagatacaagaataaatgagaataattttgaggctaaaaggaaccctaaaatgagcactcaagatcttattcaattgaacaaatttttcgaataatacgtatttggact

SEQ ID NO: 1792 - DNA, 1878 bp, Gossypium hirsutum
ttgcttaccctccgaaactccagaaaagccagagattccccgacaactccggcgccaactgtactccataccctatctccgcccttctcgactaccgcaccctcgttactaagccctttctttgatctgagaaatggcgatgtatatcgtatctcggcgactctccgctggatccaccacctcccagctggtcacctctctccgttatgccacctgctggagatccttcttcacgtcttttagggaggaacgagacacgtttggccccattaacgtcccctccgataaattgtggggagcgcagactcagagatcgttacagaattttgaaattgggggagagcgtgaacggatgcctgaacctattattcgggcctttggtgttctcaagaaatgtgctgccaaggttaacatggaatatggtcttgatccaaccattgggaaagccataatgcaagcagctgaagaagtagccgaaggaaaactcaacgatcactttccgcttgtcgtttggcaaactggtagtggcacccagagtaacatgaatgccaatgaggtaattgctaatagagcagctgagatccttggacatcagcgtggtgaaaagtttgtgcacccaaatgatcatgtgaacagatctcaatcttctaacgacacattccccactgtaatgcacattgcagctgctatggaaataaactcaagattaataccaaaattgaaaattttgcattctactttacattcaaagtctattgaattcaaagatattgttaaaattggtcgcactcacactcaagatgcaacacctttgactcttggtcaagagttcagtggctatactacacaagtcaagtatggaattgatcgagttttgtgcacccttccacgcatgtatcagctagcacaaggtggtactgccgttgggacaggattgaacacaaagaaagggtttgatgcaaaaattgctgctgctgtagcagatgagacaaacttgccatttgtcacagcagaaaataagtttgaagctttggctgcacatgatgcctttgttgaaactagcggagccctaaacactgttgctacatccctgatgaaggttgcaaatgacatacgcttactgggaagcggtccccgatgtggccttggtgagctcattcttcctgaaaatgagccaggcagcagtataatgcctgggaaggtaaaccctacccagtgtgaggctatcactatggtctgtgcccaggtaatgggtaaccatgttgctatcacagtgggcggatccaatggccactttgaattgaatgttttcaagccaatgattgctaatgcactcctgcattcattaagattgctgggtgacgcatctgcttcatttgagaagaactgcgtgaggggaattcaagccaatagggaaagaatttctaaattactgcatgagtctctaatgcttgtcacatctttgaaccctaaaattggttacgacaatgctgcagcagttgccaagaaagcacacaaggaggggtccactttgaaggaagcagcattgagccttggtgtgctcacaagcgaagaattcgacactcttgtggtgcctgagaaaatgattggcccatctgactgaatatttttttgctagaggagacataaagcaattgcttagattttaattaattttaagaccatttttctcagtcggattacaaaatagaatccgactgcaattttcttcatattctgattatggaaaacaatattattgaggtttcccatttgcttggaattgttgtaggcagtttatgtagtgaaaaaaagaatagtcgtggattgactaataagggaaaaacctcctcatttgttaaggagactgattgaagt

SEQ ID NO: 1793 - DNA, 2005 bp, Quercus alba
atggggagaccaaactagctttcatttctattccatttctctgttcctcgacagaacgaagctgagctagctcctctgccttttctcctcgtctctttgaattgtcgtctctcaggtccaagtccagcaacaacaaccctcctcagaaatggcgatgtacgcgttgccgcgccgactctcaatctcgggtggatcagcgatcggtgctctgcgttacattactactactgttttgaaacctttacccacatcctttcgagaggagcgtgacacttttggcccaatcctcgttccctctgacaagttgtggggggcacagactcaaagatcgttgcagaactttgacattggaggcgaccgtgaaagaatgcctgagccaattattcgtgcctttggtattcttaagagatgcgctgccaaggtgaatatggagtatggtcttgacccaatggtagcgaaagcaataatgcaagctgcccaagaagtagcagagggaaagctaaacgatcatttcccacttgttgtatggcaaactggaagtggaacccaaagcaacatgaatgccaatgaggtcatcgccaatagagcagcagagatccttggccataagcgtggtgaaaaggttgtgcaccctaatgaccatgtgaacagatcacaatcttctaatgacaccttccccactgtgatgcatattgcagctgcaatggaaataaattcaagattgataccaaatttgaaacatctgcatacctcactaaattcaaagtctgttgaattcaaagatattgtaaaaatcggacgcactcacactcaagatgctacacctttgactcttgggcaagagtttagtggctattctacacaagtaaaatatggaattgaccgtgtcttttgcactctacctcggatgtatcagcttgcacagggtggtactgctgtaggcactggattgaacacaaagaaagggtttgatgtgaagatagctgcagcagtagctgaggaaacaaacttaccctttgttactgcagaaaacaagtttgaagctttggctgcacatgatgcttttgttgaaaccagtggagcccttaacacaattgctgcttctctgatgaagattgcaaatgacatacgcttattaggaagtggtccacgttgtggccttggtgaactcattcttcctgaaaatgagccaggcagcagtattatgcccggaaaggtcaatcctacacagtgtgaagctctcaccatggtctgtgctcaggttatgggaaaccatgtggccatcacagtaggtggttccaacggtcacttcgaacttaatgtgtacaaaccattgattgccagtggtcttctacattctgtgagactgcttggagatgcatctgcctcctttgaaaagaactgtgtgagaggaattcaagctaatagggaaagaatttcaaaattgctgcatgagtcactgatgcttgtcacatctttgaaccctaaaattggttatgacaatgctgctgcggttgccaaaaaagcacacaaggaaggaagtactctgaaggaagctgcattgaacctaggagtgttaaccagtgaagaatttgatactcttgtggtgccagaaaaaatgattggcccatctgattgatgagattatcaagatcttgaagctcctgaaatttcccgatgcttcattttgtgcattatttctcccaatcagtttgattaggaattagaaatctgatcttcagcaacccaaataaataaataaaagaagaagaaactcgatagatttattttttcaacttacaaaaacaatattcttgaggttttctccatggctggcttgggtctttggcagggtgacaacagcagttgattgggaaaatgagtggagagcctcccccattttgtaatgattgtatcaaagaaaccaacagaatttatgatattgtgttaagacgtaaattgggattattttgtctgcgctctggaatcattttaaagtaatgtc

SEQ ID NO: 1794 - DNA, 1951 bp, Gossypium hirsutum
ggcttgctttggaacctcctcattggctgctttgctcaccctccgaaaccccagaaaagccagagattccccgacaactccggcgataactgtaccccataccctatctctgcccttctcgactaccgcaccctcgttcctaagccctttctttgatctgagaaatggcgatgtatatcgtatctcggcgactctccgctggatccaccacctcccagctggtcacctctctccgttatgccacctgctggagatccttctccacgtcttttagggaggaacgagacactttcggccccattaacgttccctccgataaattgtggggagcgcagactcagagatcgttacagaattttgaaattgggggagagcgtgaacggatgcctgaacctattattcgggcctttggtgttctcaagaaatgtgctgccaaggttaacatggaatatggtcttgatccaaccattgggaaagccataatgcaagcagcccaagaagtagccgaaggaaaactcaacgatcactttccgcttgtcgtttggcaaactggtagtggcacccagagtaacatgaatgccaatgaggtaattgctaatagagcagctgagatccttggacatcagcgtggtgaaaagtttgtgcacccaaatgatcatgtgaacagatctcaatcttctaatgacacattccccactgtaatgcacattgcagctgctatggaaataaactcaagattaataccaaaattgaaaattttgcattctaccttacattcaaagtctattgaattcaaagatattgttaaaattggtcgcactcacactcaagatgcaacacctttgactcttggtcaagagttcagtggctatactacacaagtcaagtatggaattgatcgagttttgtgcacccttccacgcatgtatcagctagcacaaggtggtactgccgttgggacaggattgaacacaaagaaagggtttgatgcaaaaattgctgcggctgtagcagatgagacaaacttgccatttgtcacagcagaaaataagtttgaagctttggctgcacatgatgcctttgttgaaactagcggagccctaaacactgttgctacatccctgatgaaggttgcaaatgacatacgcttactgggaagtggtccccgatgtggccttggtgagctcattcttcctgaaaacgagccaggcagcagtataatgcctgggaaggtaaaccctacccagtgtgaggctatcactatggtctgtgcccaggtaatgggtaaccatgttgctatcacagtgggcggatccaatggccactttgaattgaatgtgttcaagccaatgattgctaatgcactcctgcattcattaagattgctgggtgacgcatctgcttcatttgagaagaactgcgtgaggggaattcaagccaatagggaaagaatttctaaattactgcatgagtctctaatgcttgtcacatctttgaaccctaaaattggttacgacaatgctgcagcagttgccaagaaagcacacaaggaggggtccactttgaaggaagcagcattgagccttggtgtgctcacaagcgaagaatttgacactcttgtggtgcctgagaaaatgattggcccatctgactgaatttttttttttgctagaggagacttaagcagcaattgcttagattttaattaattttaagaccatttttctcagtcggattacaaaatagaatccgaccgcgattttcttcatattccgattatggaaaacaatattattgaggtttcccatttgcttggaattgtttatgcagtttatgtagtgaaaaaaagaatagtcgtggattgactaataaggggaaaacctccctcatttgtaaggagactgattgaagtaaagttgaaggcaaaataaaagagatggcatcgagtttt

SEQ ID NO: 1795 - DNA, 2101 bp, Citrus sinensis
aactaacccctctcgctgactctcgacgcgcgcagacgcagtcacgactgaccgaccgtttttatctccagtattttctatttgatacctcgattactgcatcgacgccgtctctggatcgcgggtattcactaactggcggttttagacatcttattttgcgtgtgtatttggtagagaaacaaatggcagtttatgttatatcacggcgcctcttgggtggcggatcaacaacttcgcagctggcaggaaccttgcgttatggcgcttgctggagatcctactcgacgtcgtttagagaggaaaaagacactttcggcccaatcctagttccctccgataaactgtggggggcacaaactcaaaggtcgttgcagaactttgatattggcggcgagcgggagcgaatgcccgaaccaattgttcgtgcctttggcatcctcaagaaatgtgctgccaaggtgaacatggagtatggtcttgatccagccatagggaaagcaattatgcaagcagcgcaagaagtagctgaggggaagctaaatgatcactttccacttgttgtctggcaaactggcagtggcactcagagtaatatgaatgctaatgaggttattgctaatagagcagctgagattcttggccataagcgtggtgaaaagatcgtgcacccaaatgaccatgtaaacagatctcaatcttcaaatgacacgttcccaactgtaatgcatatcgcagctgcaatggaaacaaattcaagattaattccaaatttgaaagttttgcataactcactacattcaaagtctgttgaattcaaggatattgttaaaattgggcgcactcacactcaagatgcgacacctttgactcttgggcaagaatttagtggctatactacacaagtgaagtatggcattgaccgagtcatatgctgtctaccccgtatgtatcagcttgcgcagggtggcactgctgtaggaactggactgaacacaaagaaagggtttgatgtgaagatagcttcagctgtagctgaagaaacaagtttgccatttgtcactgcagaaaacaagtttgaagctttggctgcgcatgatgcttttgttgaaactagtggagcccttaacacagttgctgcttctctaatgaagattgccaatgatgtacgcttattgggaagcggtcctcgttgtggtctcggtgaacttattcttcctgaaaatgagcctggcagcagtattatgccggggaaggttaatcctactcaatgtgaagctctcacaatggtctgtgctcaggttattgggaaccatgtggccatcacagtgggtggatcaaatggccattttgaactaaatgtattcaagccaatgattgctagtggtctcctacattcactgagattgctgggagatgcatctgcttcttttgagaagaactgtgtgagaggaattcaagctaatagggaaaggatttccaaattgctgcacgagtcattgatgcttgtcacatccttgaatcctaaaattggttatgacaatgctgcggcagttgccaagaaggctcacaaggagggaactacacttaaggatgctgcattgaaactcggagtactcaatagtgaagaatttgataatcttgtggtacctgagaaaatgattggcccatccgactaaccagcttatgtgggttaaactcctgggatttgcttttggcttttgtatcattttgcgggatatctgtttctgcgccgtttctctccctcaaggcctcaactgaatcacttgatagggatccaaatagtgattttgcttttatttaaaaaaaacaaagaaaggggcaaccaaaaaaaaactatattcttgaggttttcccaggaggaggcttcagtgatatgtcatttcacgtggtgacagaatagcgattggtaggccaacaaagggaagacctccctcatttttttgtgcgacagtgtaataaagaaatgttagatacaagaataaatgagaataattttgaggctaaaaggaaccctaaaatgagcactcaagatcttattcaattgaacaaatttttcgaataatacgtatttggacta

SEQ ID NO: 1796 - DNA, 1934 bp, Gossypium hirsutum
tcattggctgctttgcttaccctccgaaactccagaaaagccagagattccccgacaactccggcgccaactgtactccataccctatctccgcccttctcgactaccgcaccctcgttactaagccctttctttgatctgagaaatggcgatgtatatcgtatctcggcgactctccgctggatccaccacctcccagctggtcacctctctccgttatgccacctgctggagatccttctccacgtcttttagggaggaacgagacactttcggccccattaacgttccctccgataaattgtggggagcgcagactcagagatcgttacagaattttgaaattgggggagagcgtgaacggatgcctgaacctattattcgggcctttggtgttctcaagaaatgtgctgccaaggttaacatggaatatggtcttgatccaaccattgggaaagccataatgcaagcagcccaagaagtagccgaaggaaaactcaacgatcactttccgcttgtcgtttggcaaactggtagtggcacccagagtaacatgaatgccaatgaggtaattgctaatagagcagctgagatccttggacatcagcgtggtgaaagtttgtgcacccaaatgatcatgtgaacagatctcaatcttctaacgacacattccccactgtaatgcacattgcagctgctatggaaataaactcaagattaataccaaaattgaaaattttgcattctactttacattcaaagtctattgaattcaaagatattgttaaaattggccgcactcacactcaagatgcaacacctttgactcttggtcaagagttcagtggctatactacacaagtcaagtatggaattgatcgagttttgtgcacccttccacgcatgtatcagctagcacaaggtggtactgccgttgggacaggattgaacacaaagaaagggtttgatgcaaaattgctgctgctgtagcagatgagacaaacttgccattgtcacagcagaaataagtttgaagctttggctgcacatgatgcctttgttgaaactagcggagccctaaacactgttgctacatccctgatgaaggttgcaaatgacatacgcttactgggaagcggtccccgatgtggccttggtgagctcattcttcctgaaaacgagccaggcagcagtataatgcctgggaaggtaaaccctacccagtgtgaggctatcactatggtctgtgcccaggtaatgggtaaccatgttgctatcacagtgggcggatccaatggccactttgaattgaatgtgttcaagccaatgattgctaatgcactcctgcattcattaagattgctgggtgacgcatctgcttcatttgagaagaactgcgtgaggggaattcaagccaatagggaaagaatttctaaattactgcatgagtctctaatgcttgtcacatctttgaaccctaaaattggttacgacaatgctgcagcagttgccaagaaagcacacaaggaggggtccactttgaaggaagcagcattgagccttggtgtgctcacaagcgaagaatttgacactcttgtggtcccagagaaaatgattggcccatctgactgaatttttttttctttttttttgctagaggagacttgagcagcaattgcttagattttaattaatttaagaccatttttctcagtcaaattacaaaatagaatccgacccgattttcttcatattctgattatggaaaacaatattattgaggtttcccatttgcttggaattgtttatgcagcttatgtagtgaaaaaaataacagtcgcggattgactaataaggggaaaacctccctcatttgtaaggagactgattgaagtaaagttgaaggcaaaataaaagagatggcatcgagtttt

SEQ ID NO: 1797 - DNA, 2019 bp, Cucumis melo
tattttgttcttccaaataaatcgccgtattctctcacgacacctacaaccttttgacgtcacccgccatttctccggcgccttatctccgtccattcctccgttcgaggattccactttccccaatctccacttgttagtcttctctcctcctctttccggatcactctcacattcttcttcccaaactcatattcgcttttacctccaaaaaatggcggccgtctatgttttgtcccggcgatcctccccttcacacctctttgggatggctcgttatgctactacgtcattgagatcttactccacgtcttttcgcgaggaaagggatacttttggacctatcaacgttccctccgatagattatggggagctcaaacgcagagatcattgcagaactttgagatcggaggcgaccgtgagcgaatgcctgaacctataattcgtgcctttggcgttcttaaaaagtgtgctgccaaggtaaacatggagtacggtcttgatccaacaattggaaaagccataatgcaagcagctcaagaagtagcggagggaaagttgaatgatcattttccacttgttgtatggcaaactggaagtggtactcagagtaacatgaatgcgaatgaggttattgctaacagagcatctgagattcttggccataaacgtggtgagaagtttgttcacccaaatgaccatgttaaccggtcccagtcttctaatgatacattcccaactgtaatgcacatagcagctgcaacagaaattaattccaaattcataccaaaattgaaaactttacattcatcactatactcgaagtctatagaattcaaagatatcgtgaaaattggacgcacccatactcaagatgccacacctctaactcttggacaagagttcagtggctacaccacccaagtgaagtatggtattgatagagtcttgtgtactctgcctcgaatgtatcagcttgcccaaggtggaactgctgttggaactggattgaacacaaagaaaggatttgatgtgaaaatagcggcagcagtagctgaagaaacaaatttgccatttgtgacagccgaaaacaagttcgaagccttggctgcacatgatgccttcgttgaaactagtgggtctcttaacacagttgctgcttctttgatgaagattgccaatgacatacgcctgttgggaagtggtcctcgttgtggtcttggtgaacttattcttcccgaaaacgaaccaggcagtagtattatgccagggaaggtgaaccctactcaatgtgaggctctcactatggtctgcgctcaggttatgggaaaccatgtggcaataactgttggagggtcaaatggtcactttgaacttaatgtatataaaccaatgatagccaatgctcttttgcattcattgagattattaggggatgcttctgcttcatttgagaagaactgtgtgaggggaattcaagctaacagggaaagaatttcgaaattactccatgagtctctgatgctcgtcacagctttaaatcctaaaattggttacgacaatgctgccgcagttgcaaagaaagcacacaaggaagggtgtactttgaaggaagctgcactgaagcttggagttctatgcgaggaagagtttgataaacatgtggtgcccgagaaaatgattggtccatccggttgacaatagagagctaaagcttccttcttctgtgtttggatcccatcaaaaccatttttataggtactctcatttttcccctaaaaggaacaacaaatccatttttatgaggattgaattggataataaaatgaccacacagatagagtgtctggcggttctcttctactttagaagtatcgtcaaaaaatagttttcttgcgggaagtgattaataatttcttttggagactgttcttgtgtacgtctacgtccattattgggtctctttgagaatttgacctttgttcccttttttatatgaagtatatgatattcatcaa

SEQ ID NO: 1798 - DNA, 1790 bp, Malus domestica
tcggctcccgttccatacttctctccatcggtccgaggtcaaccacctgcaaatggcgatgtacatcgtgtcacggcgggcagccggcggatcgacgccgatggcggcgttgcgctacgctacttctttgagaccgtattcgacgaagtttagggaggaaagggacacttttggacccatcaacgttccctcagacaagctgtggggggcgcagactcagagatcgctgcagaatttcgatatcggcggcgagcgggagcgaatgcccgaacccattgttcgtgcttttggggtgctcaaaaaatgcgctgcaaaggtgaacatggagtatggtcttgatccaactattgggaaagcagtaatgcaagccgcccaagaagtcgcggaggggaagctcaacgaacactttccacttgttatctggcagactggcagtggaacccaaagcaacatgaatgccaatgaggtcattgcgaacagggccgctgagatacttggccatcagcgcggcgaaaagtttgtgcacccgaatgaccatgttaatagatcacaatcttctaatgacactttcccaaccgtcatgcacattgcatctgcaatggaaattaactcaagactgataccaaatttgaaaactttgcatgctgccctacattcgaagtctgaagaattcaaagatattgttaaaattggacgcactcacacacaagatgcgacgcctttaactcttgggcaagagttcagcggctattcaacacaagtgaaatatggaattgaacgagttttgcttactctacctaggatgtatcagcttgcacagggtggtactgctgttgggactggattgaacacaaagaagggatttgatgtaaagatagctgcagcagtagctgaggaaacaaagttaccatttgtcactgcagaaaacaagtttgaagctttggctgcacatgatgcttttgttgaaactagcggagccctgaacacagttgctacttctttgatgaagattgcaaatgatatacgtttactaggaagtggtccacgttgtggcctcggtgaactcattctccctgaaaacgagcctggtagcagcataatgcctgggaaggtaaaccctacccagtgtgaggctctcacaatggtctgtgctcaggttatgggtaacaatgtggccattacggtaggtggatcaaatggtcacttcgaacttaatgtgttcaagccaatgattgctagtggtctcctgcattcggtgagattgcttggggatgcatctgcttcctttgaaaagaactgcgtgagaggaattcaagctaatagggaaagaatttcaaagttacttcatgagtcacttatgttggtcacgtccttgaatcctaaaattggttatgataatgctgcggcagttgcaaagacagcccacaaggagggatccactttgaaggaagctgcattgaaactaggaatgctatccagcgaagaattcgatactcttgtggtgccagagaagatgattggcccaaccgactgactgactgacagattttgaagctgttgaaaattgaagtcctgatttcagcggcatcggttaccttttgcgttttgtctttgcattttgtctcttcgggtgacacaaggattagaagcgatacgtatgtaattcataacgtgtttacgaacgatattcttgaggctgtctcatccatggctggccggccggccctgttatttgggtcaattcattgggtcgctgaataaaataaagtagaaagttactatctttgcat

SEQ ID NO: 1799 - DNA, 1937 bp, Populus trichocarpa
attcctagcaattagcatagcacagcattcgcagcctttttattccattctcctctcctctcgtctcctctcttgatatttatatatatacacataaaaagagcttgatatctcctcgatcttcgcattctgcaaatcaattgagggattgagtaaattggaatggcgatgtatatcgtgtcacggcgcctctctacaggatccacgacttggcgttatggaaactggttgaggtcttattcaactgccttcagagaggagagagacacttttggtcccattagtgtccctgctgataagctatggggtgctcagacgcaaagatctttgcagaattttgatataggcggcgatcgcgagcgaatgcccgaacctatcattcgagcctttggtatactcaagaaatgtgctgccaaggtgaatatgcagtatgggcttgatccttccatagggaaagcgataatgcaagctgcccacgaggtagctgaagggaagctaagcgatcattttccactggttgtgtggcagactggcagtggtactcaaagtaacatgaatgctaatgaggttattgccaatagagcagctgagatccttgggcataagcgtggggaaaagtttgtgcaccctaatgaccacgtgaacagatcacaatcttctaatgacacatttccaactgtaatgcatattgcagctgcaacggagataaattcaagattaatcccaaaattgaaaactttgcacttgacactccattcaaagtcagttgaattcaaagatattgttaaaattgggcgcacgcacactcaagatgcaacaccattgacacttgggcaagagtttagtggctacacgacacaagtgaagtatggaattgatcgtgtcatgtgcacgctaccccacatgtatcagcttgcacaaggtggaactgctgtggggactggattaaacacaaagaaagggtttgatgtaaagatagcttcagcagtggctgaggaaacaaacctgccatttgtcacagcggaaaacaagtttgaagctttggctgcacatgatgcttttgttgaaactagtggagcactcaacacagttgctacttctctgatgaagattgcaaatgacatacggttattaggaagcggtccacgatgtggtcttggtgaactcattcttcctgaaaatgagccaggaagtagtataatgccgggaaaggttaatcccacccaatgtgaggctctcacaatggtctgtgctcaggttatgggaaatcatgttgccataacagttggtggatcaaatggtcactttgaactaaatgtattcaagccaatgatcgctagtggcctcctacattcaataaggttgcttggtgatgcatctgcttcctttgaaaagaactgtgtgaggggtattcaagccaatagggaaagaatttcgaaattactgcatgagtcgctgatgcttgtcacatcattgaaccctaaaattggttatgacaatgctgcagcagttgccaagctggcccacaaggagggaagtactctgaaggaagctgcactaaaactcggaatgctcaccagtgaagaatttgatacactcgtagtccctgaaaaaatgatcgggccaactgactgacaaagttgcaaagagtttccagcttctgagaattgatttcccaaaatttcaagcatcgaacaaggttatccgttttagctttgcaacatgttaaatcatttgatgtggaataatgcgatcagtagtgaacattattttgttaaacaatattcttagaggtttcccgccaactggcttctctcatttttcaaaaatgcagcagtaacccttgatgaggttaataatgggaatcttccctcattttgtagcggacatgtgagaaattcacatgctagaatgaaagaaatgattttcttttggca

SEQ ID NO: 1800 - DNA, 2356 bp, Theobroma cacao
agagtaccatccgaaaagccaattccaaaggactacaaaaaacgaacaaaatgaaaaatctccgttacacgaagtcactgcccacctttgaccataccgcagccattcagcccaggcaagcaagctaccgaacggttctttcttttactggctgctcgcttaccctccaaaaaccaatgccaaagttttcccacaactccggctttacatggcaaacagcccccagcccaatttaattagttattaacttattatactattctaatgaattgacccaaacccctactctctttctctctcacatcctatctctgtccctctcgaaccctttctccggtctcattccttccctccgcttgatcaggattatagattttgaagtgaaagacgagaaatggcgatgtatatcgtatctcgtcgactttccgccggatccaccacctcccagctggtcacctctctccgttacgccacttgctggaggtcctactcgacgtcgtttagggaggaacgagacactttcggccccattaatgtcccctccgataaattgtggggagcgcaaactcagagatcgttacagaatttcgaaataggcggcgagcgtgaacggatgcctgaacctattattcgtgcctttggtattctcaagaaatgtgctgctaaggtgaatatggactatggtcttgatccaaccattgggaaagcaataatgcaagctgcccaagaagtagctgaagggaaactcaatgatcactttccgcttgttgtttggcaaactggcagtggcactcagagtaatatgaatgccaatgaggttattgctaatagagcagctgagatccttgggcataaacgtggtgacaaatttgtgcacccaaatgatcatgttaatagatctcagtcgtctaatgacacattcccaactgtaatgcacattgcagctgcaatggaaataaactcaagattaacacctaagttgaagattttgcgttccacattacattcaaagtctattgaattcaaagatattgttaaaattggtcgcactcacactcaagatgcaacacctttgactcttgggcaagagtttagtggctatacaacacaagtcaagtacggaattgatcgggttttgtgcaccctgccacgcatgtatcagcttgcacaaggtggtactgcagtggggacaggattgaatacaaagaaagggtttgatgaaaaaatggcggctgctgtagctgacgaaacacaattgccgtttgtcaccgcagaaaacaagtttgaagctttggctgcacatgatgcctttgttgaaactagcggagcgctaaacactattgctacttccctgatgaaggttgcaaatgacatacgcttgctgggaagtggtccccgatgtggccttggtgagctcattcttcctgaaaatgagccaggcagcagtattatgcctgggaaggtgaatccaacccagtgtgaggctcttactatggtgtgtgcccaggttatgggtaaccatgtggctatcaccgtgggtggatcaaatggccactttgaattgaatgtgttcaagccaatgattgctagtgcactcctacattcagtgagattgctgggtgatgcatctgcttcctttgagaagaactgtgtgaggggaattcaagctaatagggaaagaatttcaaaattacttcatgagtctctaatgcttgtcacatccttgaaccctaaaattggttatgataatgctgcagctgttgccaagaaagcccataaggaggggtccactttgaaggaagcggcattgaaacttggtgtgctaactagcgaagaatttgacaatcttgtggtgcctgagaaaatgattggcccatctgactgacaagctattttgctacccagattttagttttgaaaccatttttctcgacagttggatttataagtccaataaaatccaacggcgattttcttcatgttctgatttggaaactgatattcttgaggttttcccattgggtttgtattgtttatgcatttgacagtgaaagagtggcccttaattggccaataaggggaaagcctccctcattttgtaaggagacagtgtactgaaggaaagttaaatgtagaataaaagagatgatatcaagttgccagcaaagctgaatgtgacatacttcttaaatgacacggcctttttgctgtagtacgtacagaaattctcttgaatcatgatgtgtaaccaggggcgttttctctcatatcaagaacgattactgtagttagttatagtttgaccctactaagaccttcgcatgaccaactgttataatcaaagtcgattttctaa

SEQ ID NO: 1801 - DNA, 1992 bp, Phaseolus coccineus
gcagtattttattgaattctattggtctcactacaactattctccggtgactcctccgccgcctcagccaccgcacatccaaactgaaccatggcgttgtacgcggcgtctcgtcgtttatcaactggatccaactcgacgacgctccttgctttgcgttttgcttcctcttccagatcctactcctcttccttcagagaagaaagagacaccttcggacccattcaagtcccctccgacaaattatggggggcacaaactcaaagatcgttgcagaacttcgatatcggtggcccccgcgaacgcatgcccgaacccatcgtccgcgcttttggcgtcttgaagaaatgcgctgctaaggtaaacatggagtatggtcttgatcccaacgttggaaaagcgataatgcaagcagctcaagaagtggcagagggaaaactaaacgatcattttcctctcgttgtatggcaaactggaagtggcactcagagtaacatgaacgctaacgaggttattgcaaaccgggcggcagagattcttggccacaagcgtggtgagaaggttgtgcacccaaatgaccatgttaatagatcgcagtcttctaatgatacattcccaaccgtaatgcacattgcagctgcaatggaaataaactcgagattaatccctagcctgaaaaccttacatggcaccctaaactcaaagtcaattgaattcaaagatattgtcaagattggacgcactcatactcaagatgcaacacctttgactcttggccaagagtttagtgggtattcaacacaagtgaagtatggtattgatcgagtaattagcacattgccgcacatgtatcagcttgcccagggtggtacagctgtagggactggattgaatacaaagaaggggtttgatgctaagatagcagcagctgtggcagacgaaacaaatctgccttttgttacggcagaaaataagtttgaggccttggctgcccatgatgcttttgttgaaaccagtggagccctaaacaccattgcggcttctttgatgaagattggtaatgatatacggttattaggaagtggtccacgttgtggtcttggtgaactcattcttcctgaaaatgaaccgggaagcagtattatgcctgggaaggttaaccctacccaatgtgaggctttgacaatggtgtgtgcacaggtcatgggaaaccatgttgcagttacagtgggtggatcaaatggtcactttgagctcaatgtgttcaagccaatgattgccagttgtctcctgcattcgctgagactgcttggagattcatctgcttcctttgaaaagaattgcgtgagaggtattcaagctaatagggaaagaatttcaaaattactgcatgagtcacttatgcttgtcacatccttgaatccaaaaattggttatgacaaagcagcggcagtggccaagacagcccacaaagaggggactactctgaaggaagccgcactgaaactcggagtgctgagctcagaagagtttgacaagcttgtggtacctgagaaaatgcttggaccgtccgattgactggctcgtaatgttttgacattgaggtagaattttttagccatacccattgactggattgagaaatggcaatccaatattcaataattttggcttccttagttgagattcctgagggaagagctcttccacatttgtaacgggacaatgtattgcagaaacgtcctgacccaaataaagggaaaaattttatttattttccttgcactgtatttgcaatgttttttggattgcaaatttgtaataattttaaaacttttcatgtttttgtcttgcttaggcgacgaatctgttagttgataaagaaggaaaggcgaggtaaaagcgggtgtttaataatgtttatatagatacaaatctttaagttcgctgtcatttttatttcccgtcatgtgtgtttctaaaataatattt

SEQ ID NO: 1802 - DNA, 1876 bp, Vigna unguiculata
ggcgcagacgcgttgtaactttattggctacttttccctgttctttctgcagtattgtatcgaattctattgctctcccactactactattctccggtgactcctccgccaccccagccaccgcacactcaaactgaaccatggcgttgtacgcggtgtcgcgtcgtttatcagctggatccaactcaacgacgctccttgctctgcgttttgcttcctcttccagatcctactcctcttcattcagagaagaaagagacaccttcggacccattcaagtcccctccgacaaattatggggggcacaaactcaaagatcgttgcagaacttcgatatcggtggccctcgcgaacgcatgcccgaacccatcattcgcgcttttggcgtcttgaagaaatgcgctgccaaggtgaacatggactatggtcttgatcccaacgttggaaaagcgataatgcaagcggctcaagaagtggcagaaggaaaactaaacgaccattttcctctcgttgtatggcaaactggaagtggcactcagagtaacatgaacgctaacgaggttattgcaaaccgagcagcagagattcttggccataagcgtggtgacaagtttgtgcacccaaatgaccatgtcaatagatcacagtcttctaatgatacattcccaaccgtaatgcacattgcagctgcaatggaaataaactcaagattaatccccagcctgaaaaccttacatggcaccctgaactcaaagtcaattgaattcaaagatattgtcaagattggacgcactcatactcaagatgcaacacctttgactctaggccaggagtttagtgggtatacaacacaagtgaagtatggtattgatcgagtaattggcacattgccgcgcatgtatcagcttgcccagggtggtacagctgtagggactggattgaatacgaagaaggggtttgatgctaagatagcagcagctgtagcagacgaaacaaatctgccttttgttacggcagaaaataagtttgaggccttggctgctcatgatgcttttgttgaaaccagtggagcccttaacaccattgcagcctctttgatgaagattgctaatgatattcggttattaggaagtggtccacgttgcggtcttggtgaactcattcttcctgaaaatgaaccgggaagcagtattatgcctgggaaggttaaccctacccagtgtgaggctttgacaatggtgtgtgcacaggtcatgggaaaccatgttgcagttacagtgggtggatcaaatggtcattttgagctcaatgtgttcaagccaatgattgccagttgtctcctgcattcactgagactgcttggagattcatctgcttccttcgaaaagaattgcgtgagaggtattcaagctaatagggaaagaatttcaaaattgctgcatgagtcacttatgctcgtcacatccttgaacccaaaaattggttatgacaaggcagcggcagttgccaagacagcccacaaagaggggactactctaaaggaagctgcactgaaactcggagtgctgagctcagaagactttgacaagcttgtggtacctgagaaaatgcttggaccatccgattgaccggctcataatgttttgttctgataattccttgtctcatcatcggctacgttgaggtagaatttttttagccatacccattgactggattgataaatggcaatccaatattcaataattttagcttccttatttgatattcgtgagggaagagctcttccaaatttgtaacgagacaatgtattgaagaaacatacaaacttacccacataaagagaaaaaatgttatttattgtccttgcacttta

SEQ ID NO: 1803 - DNA, 1906 bp, Mimulus guttatus
cttcatttcggctaaaagaaattggtagaggctgcgcactaactaaacaaatcaaactacgattcaaggttctaattttcaattctttttttccggcggtgactggcagaaaccgttttccgatcgcgggtggcctaccattgattccggcaatggcgatgctcataatcagccgtcgtctatcgggtcgatccccgatgacgtcgtccatcgcggcgaacctcagatggtactcgacgtccttcagagaagagagggataccttcggccccattcaagttccttccgacaaattatggggtgctcaaactcaaagatccttacagaacttcgaaattggaggtgaccgggaaagaatgcctgaaccaattgtacgagcatttggaattctcaagaaatgtgctgctaaggtaaacatggaatacggccttgacccttccatagggaaagcaattatgcaagctgcacaagaagttgctgatggaaaattaaacgatcattttccgttggttgtttggcaaactggcagtggtactcagagtaacatgaatgccaacgaggttattgcaaatagagcagctgaaattcttggccacaagcgcggtgaaaaggtggttcatccaaatgaccatgtaaacaggtcacaatcttctaatgacacatttccaactgtcatgcacattgcagctgcgatggagataaattccctattaatcccaaaattgaaacagttacacacgactctacattcaaagtctgttgaattcaaagacatcgtgaaaattggccgtacgcacacccaagatgctacacccttgacacttggacaagaatttagtggctatactacacaagtgaagtacgggattgatcgagtctcgtgcactctcccccgaatgtatcagctcgcacaggggggcactgctgtgggaactggtctgaacacaaggaaaggatttgatgtaaagattgctgcggcagtagctgaggaaactaatttgccatttgtgacggctgaaaataaatttgaagccctggctgcccatgatgcttttgctgaaacaagtggtgccttaaacacaattgctgtttcactcatgaagatagcaaatgacatacgtttcttaggaagtggtccacgttgtggtctaggagaactcatactccctgaaaatgaacctggcagcagtataatgccggggaaggtgaaccctacacagtgcgaagccatcactatggtttgtgctcaggttatgggcaacaatgtcgctataacagtgggtgcatccaatggccattttgaactgaatgtatttaagcctgtcattgccagtaatctattacactcattgagattgcttggcgatgcctctgcttcctttgaaaagaattgtgtacggggaattcaagcaaacaaagaaagaatagctaaattattacatgagtccctcatgctcgtgacatctttgaatcccaaaatcggctatgacaatgctgccttagttgccaagacagctcacaaggagggaagtaccttgaaggatgctgccttaaaactcggtgtcctcagttctgaagaatttgatacgcttgtagtgccggaaaagatgattggcccatctgattaaatatatatctagcagagcttcttatgtcttgttcacgagacactatgaaaattatcgggacaacacattgtttttttccgtaaggtggttttatcctgttatggagacaacattcttgaggtttttctcggttgtgtggtttttgcctccagactaaaaaggttattggtgagaaaagcctcctcattgttataacttagaataaatatgctccaggggaataataatatgtaatcctaatttttgaagtaatattaatcacataggtttacttgctc

SEQ ID NO: 1804 - DNA, 1821 bp, Triphysaria pusilla
gctcacactcagattaataacagcacaaaacaaccaaaccacaacaattccttttataatcttcatttttctcgatcgccgttagctgttattgattccggcaatggcgatgctcgtaatccgccgtcgtctaaccagtcgatcccaaacgagctcgtacctttcagcgaccttcagatgctactccacatcctttagagaagagagagacacttttggccccattcaagtcccatctgacaaattatggggagctcaaactcaaagatcgttgcagaattttgaaattggaggggaacgcgagagaatgcccgaaccaattatacgtgcctttgggattcttaagaaatgtgctgccaaggtgaacatggaatatggacttgatccctccataggaaaagcagttatgcaagctgcacaggaagtggctgaggggaaactaaacgatcattttccgctggttgtttggcaaactggcagtggtactcagagcaacatgaatgccaatgaggttattgcaaatagagcagctgagattcttggtcacaagcgtggtgcaaaagttgttcatccaaatgaccatgtgaaccgatcacaatcttctaacgacacgtttccaactgtaatgcacattgcagctgcaatggaaatcaattcaagtttaattccaaaactgaaacagttacacacaacacttcattcaaagactgccgaattcgaagacattgtaaaaatcggtcgaactcacacacaagacgccactcctttgacacttggacaagaatttagtggctacacgacacaggtcaagtatgggattgatcgagtttcacgcactcttcccagcatgtatcagctggcacagggtggcactgctgtgggaactggtttgaacacaaagaaagggttcgatgtaaagattgctgcagcagtagctgaggaaactaatttgccatttgtgactgccgaaaacaaatttgaggcactggctgcacatgatgcttttgttgaaacaagtggttccttaaacacaattgctgtttctctcatgaagattgcaaatgacatacgtttcttaggaagtggtccacgatgtggtttaggagaactcatacttcctgaaaatgaacctggcagcagtataatgccggggaaggtgaaccccacacaatgtgaggctctcacaatggtttgtgctcaggttatgggcaatcatgtggcgattacagttgggggatcaaatggccattttgagttgaatgtattcaagcctgtcattgccagtaatctattacactcattgagattgcttggcgacgcttctgcttcatttgaaaagaattgtgtgaggggtattcaagccaaccgagaaagaatttctaaattgttacatgagtccctcatgcttgttacatcattaaacccaaaaattgggtacgataacgctgcattagtcgctaaaacagctcataaggagggaagcaccttgaaggatgctgctttgaaacttggggtgctcagttccgaagaattcgatactcttgtagtgccggaaaagatgattggcccgtccgactaaatgtatccgggctgtccctttcctatagagacgaatattcttgaggttttctcatgattgacttttttgctttaaattctgcactgttgattttgtgggtgagaaaaaatccctcattgttttaactgctacttagagaataaattttgcagcaggtaataagacatgtaactaattgtcagttattcttttcccttttgaaggcttgatttcttccaatgtgaaatgaaggttgagaatac

SEQ ID NO: 1805 - DNA, 1787 bp, Lotus japonicus
gtcttcatcagattgatcaacaatggcgttgtacgttttgtcacgtcgtttatcatctggatcaacctccacgacggcgctcgccttgcgtttcgtctccgcttccagatcctactcctcctcctccttccgggaagaacgagataccttcggacccatccaagttccctccgacaaattatggggagcacagactcagcgatcgttgcagaacttcgacatcggcggcccccgcgaacgcatgccggagccaatcattcgcgccttcggtatcttgaagaaatgcgctgccaaggtgaacatggagtatggtcttgatccaacgattgcgaaagcggttatgcaagcggcgcaagaagttgcagagggaaagctcaatgatcattttccgcttgttgtgtggcaaactggcagtggcactcagagtaacatgaatgctaatgaggttattgctaacagagctgcagagattcttggccataagcgcggggagaagcatgtgcaccccaatgatcatgtcaatagatctcaatcttcaaatgatactttcccaactgtaatgcacattgcagctgctatggagataaactcaagagtgatccccagcttgaaaaccttgcattcgacactaaactcaaagtcaattgaattcaaagatattgtcaagattggacgcacacatactcaagatgcaacgccgttgactcttggacaagagtttagtgggtatactacacaagtgaagtatggtattgatcgagtgatttctactttgccgcacatgtatcagcttgcccagggtggtaccgctgtagggactggattgaatacgaagaaggggtttgatgttaagatagcaaatgcagtagctgacgaaacacatctgccttttgtgaccgcagaaaataagttcgaggccttggctgcccatgatgcttttgttgaaactagtggagccctcaataccgttgcaacttctttaatgaaggttgctaatgatatacggttattaggaagtggtccccgttgtggtcttggtgaactcattctacctgaaaacgaaccagggagcagtattatgcctgggaaggttaatcctacccagtgcgaggctttgacaatggtctgtgcacaggtcatgggaaaccatgttgcaatcacagtgggtggatcaaatggtcattttgagctcaatgtgttcaagccaatgatggccagttgtcttctgcattcactgagactgcttggagatgcatccgcttccttcgaaaagaattgtgtaagaggaattcaagctaatagggaaagaatttcaaaattactgcatgagtcactaatgcttgtcacatcgttgaacccaaaaatcggttatgacaatgcagcagcagttgccaagaaagcccacaaagaagggactactctcaaggaagctgcattgaagcttggagtactgagctctgaagatttcgacaatcttgtggtgcctgaaaaaatgattggcccatctgagatctgattgactagcatgtgatgcttagttcctattaattcttggttcatccatcagctgcattgaattagtatttttgaagcgtgccctttgattagattgagcaatggcaatccgaataaccaataattttgactacctcaattgatattttgagggaagagctcctgcaatttgtaacgagacactaaatttactgacccaaaatcccaaataagcggaaaagtttttgtttattactttatacttctcactactttaagagttttttttttgt

SEQ ID NO: 1806 - DNA, 1828 bp, Helianthus annuus
gtacgcgggagccatctctgggcatacacacccttctgcaattcattacattcattccggttaatttgtaggaaaaagaaatggcgatggttcaagcatatcgtcgaatatctggcggatcggtcgtttgtgcagattcgcttcggctcacgacgtgttggagatatttttctactggttttagagaggaaagagacacgtttggaccgattcaagttccatctgataagttatggggtgcgcaaacgcaacgatctttgcagaattttgaaatcggtggtgaccgtgaaagaatgcctgaaccgatcattcgttcttttggaatcctcaaaaagtgtgctgctaaggtaaacatggaatacgggcttgatccatctatagggaaagcaataatggaagctgcacaagaagtggcagaagggaagttaaacgatcactttccattggttgtatggcagactggcagtggcacgcaaagcaatatgaacgccaacgaggttattgcaaatagagcggctgaaattctcggccacaaacgtggcgataagtttgtgcatccaaatgaccatgtgaacagatcacagtcttcaaatgatacattcccaaccgttatgcatattgcagctgcaacagaaatcaactcaaggcttatcccaaaacttaagcagttacatacttccctacaagcaaagacaaatgagttctcggatatagttaaaatcgggcgtacacacacccaagatgcaacacccttgactctcggacaagagtttagtggctataccacacaagtgaagtatggaattgatcgggttatatgcactcttcctcgcatgtatcagcttgcacaaggtggtactgctgtagggacaggattaaacacaaagaaaggatttgatgtaaagattgctgcagcagtagctgatgaaacaagattaccatttgtaacagctgaaaataagtttgaggcgctggctgcgcatgatgcctttgttgaagctagtggagccttgaacacgattgctgcttcacttatgaagattgcaaatgatatacggttcctaggaagtggtccacgttgcggtcttggggaacttattcttcctgagaatgaacctgggagcagcatcatgcctggaaaagtgaatcctacacagtgtgaagctctgactatggtctgtgctcaggcaattggaaaccatgttgcccttacagtgggtggttcaaatggccattttgagctaaatgttttcaagccgatgatcgctagttcgcttttacactcaataagacttctagcggacgcatctgcttctttcgaaaagaattgcgtgagaggaattcaagcaaacaaagataggatttccaagttattacacgagtcacttatgcttgtgacatctttgaatcccaaaattggctatgataatgctgcagcggttgccaagactgcccacaaacagggatgtacactcaaggaagctgctctccaattgggagtgttgactagtgaagaattcgagcaacttgtagttccggaaaagatgattggtccaactgattaaagcaacatgttgaagatatggttgcattgttgaagccattttgctgtaagttatttagataggaaataaaagatcactggtctcatcatatttcgggaattcattgaagtgttgtattcttctgagtgacgtgaacttgtcgagaaaaaactacatgtcgccaacaatatttttgccggataaaggtttcttactttgttgtttacttcagatgataaaaaatcacttaaaccccataatgagatatcacagggtgtttgggt

SEQ ID NO: 1807 - DNA, 1910 bp, Fragaria vesca
aataatttcgacccgactgactcgcagtccctcccatatttctcgcccatcatctctctcacattccccaactcactccgatcactccgatcacttcaaaccccaaccaccaccctgctccgcctccatggccatgtacgtcatttcacggcgagtaaccgccggatcgacgccgttccgctacgccgctactacttgctggagaaactactcgacgtcgtttcgcgaggaaagggacacctttggacccattctcgtcccctcagacaaactatggggagctcagactcagcgatcgctgcagaacttcgatatcggcggcgagcgcgaacgcatgccggagcctatcattcgcgccttcggcgtcctcaagaaatgtgctgccaaggtgaacatggagtatgggcttgaccagtctatagggaaagctataatgcaggctgcacaagaagtggccgaggggaagctgaatcagcattttccacttgttgtgtggcaaactgggagcggaacacaaagcaacatgaatgccaatgaggtgattgcaaacagagcggctgaaatacttggccataagcgtggcgataagtttgtgcacccgaatgaccatgttaatagatcacagtcgtcaaatgacactttcccaactgtcatgcacattgccagtgcaatggaaataaactcaagactgataccaaatttgaaagctttgcattcttctctacattcaaagtcagatgaattcaaagatattgttaaaatcggacgtactcacacgcaagatgcaacacctttgactcttgggcaagagtttagcggttactctacacaagtcaagtatggaatcgagcgagtcttgtgcactctaccccgcatgtatcagcttgcacagggtggtactgctgttgggactggattgaatacaaagaagggatttgatgtgaagatagctgcagcagtagctgatgaaacaaacttaccatttgtcactgcagaaaacaagtttgaagctttggctgcacatgacgcttttgtggaaactagcggagccttgaatacagttgctacttctctgatgaaaatagcaaatgacatacgtttattaggaagtggtccgcgatgtggccttggtgaactcatccttcctgaaaatgagcctggaagcagcattatgccggggaaggttaacccaacccagtgtgaggctatcacaatggtttgtgctcaggttatgggtaacaatgtggccattacagtaggtggatctaatggtcattttgaactaaatgtattcaagccaatgattgctagtgctctcctacattctgttagattgcttggtgatgcatctgcttcctttgaaaagaactgtgttagaggaattgaagccaatagggaaagaatctcaaagttacttcatgagtcactgatgttggtcacatccttgaatcctaaaattggttatgacaatgctgcggcagttgcgaagaaagcccacaaggagggctctactttgaaggaagctgcattgaaacttggggtgctaacgagtgaagagtttgatactcttgtggtgcccgagaagatgattggcccgaccgactgaccgactgactgacagtttctcaggatcaagcctttatgtttcatctttgcttttcctctctccagatgaaataaggattcaagtttgatatgattcatattgattacaaactatattcttgaggatttccccacagttgaattgggtctcagggaaatgcctccaaattttgtaacaatacaggtactcggaataaaatagaggaaggttactttaccgtattgaacagaaacatgtgatgaacccatttctcatttgtatcaacacagtgaatagaagatcaggtatctaccatctttttcaa

SEQ ID NO: 1808 - DNA, 1932 bp, Orobanche aegyptiaca
atttcaaagctacgaattccggttctgatcttcattttttcaggtagccggctggcttttatcgattccggcaatggcgatgctcgtaatcggccgtcgtctaacgactcgattgcaaacgacgtcttactttccggcgagcttcagatggtactccacatccttcagagaagaaagagacacgtttggccccattcaagttccatcggacagattatggggcgctcaaactcaaagatcgttgcagaactttgaaattggaggcgagcgggaaaggatgccagaaccaattatacgtgcattcgggattcttaagaaatgtgcagcgaaggtaaacatggaatatggccttgatccatccatagggaaggcaattatgcaagcagcacaagaagtggctgagggaaaattaaacgaccatttcccgttggttgtttggcaaactggcagtggtactcagagtaacatgaatgccaatgaggttattgcaaatagagcagctgaaattcttggccacaagcgtggtgaaaaaattgttcatccaaatgaccatgtaaacagatcacaatcttctaacgacacgtttcctactgtaatgcacattgcagctgcaatggaaatcaatcgtggattaataccaaaattgaaacagttacacacgacacttcattctaagtccgtcgagttcaaagacatagttaaaattggccgcactcacacacaagatgcaacacctttgactcttggacaagaatttagtggctataccacacaggtgaagtacgggattgaccgagtctcttgcacccttcctcgcatgtatcagttggcacaagggggcactgctgtaggaactggtttgaataccaaaaaagggtttgatgtgaaaattgcaactgcagtagcggaggaaactaatttgcccttcatcactgctgaaaacaaatttgaagcattggctgcacatgatgcttttgtcgaaacaagtggtgccttaaacacaatcgctgtttcacttatgaagattgcaaatgacgtacgtttcttaggaagtggtccacgatgtggtcttggagaacttatacttcctgaaaatgaacctggcagcagtataatgccaggaaaggtgaaccctacgcagtgcgaggctcttacaatggtttgcgctcaggttatgggcaatcatgtggcgatcacagtggggggatccaatggccattttgaactgaatgtatttaagcctgttattgccagtaatctattacagtcattgagattgcttggggatgcctctgcttcctttgaaaagaattgtgtcaggggaattcaagcaaatagagaaagaatttctaaattgttacatgagtccctcatgctcgtcacatctttaaatccaaaaattgggtacgacaatgctgcattagttgccaagacagctcacaaggaaggaagtaccttaaaggatgctgccctaaaacttggagtgctcaattctgaagaattcgatactcttgtggtgccacataagatgattggcccttctgactgactaaaataggtctgactggggacattcaacagaggcttttcggaattttggtgagtcccttatggagacaaattcttggggttttctcagttttgtgaggtttattttggctataaattctccagactggattgtgggtgagaatgcccctcattgtttgtcttaacgaataaatatgcagcagagaataagatgtaactgtgagaaagaaattccttttgaagtcattttttgtgaaattacaaaaggttaattaaacggatggttggttactaaaactatcctgaggtttaatgtgatggaaaaaagttccattatcattgatactgtaaaccttttcaaatattacaaatggttgctgttatttgaattttgcttgctgt

SEQ ID NO: 1809 - DNA, 1957 bp, Zostera marina
ggaattttccttcgttttcttatccgccaacttcgccgcctgtcaccacactcccttcgacgatccgatcaaccggagaggagagatgacgatgatgcttgcagccttgcgcgggctgtcgtctcgatcaaccggatcggtgatggacgttttgttaaggtcgtgcagtagtcgatacctgtctactggttttagggaggagaaggataccttcggtccgatcctcgttccgttggaaaagtattggggtgctcaaactcaaagatcattgcaaaattttgatattggtggtgagcgtgaaaagatgcccgaacccgtcattcgtgcttttggcgttcttaagaaatgtgctgctaaggttaacatggaatatggtcttgataaaacaattggaaaagcaataatgcaagcttcacaagaagtagctgatggtaaactgaatgaccattttccgctggtcatatggcaaactggcagtgggacacagagcaatatgaatgcgaatgaggttattgcaaatagagccggtgagattctgggccatcaacgtggagataaatttgtgcatcctaatgaccatgttaatagagcacaatcatcgaatgacacatttccgacagtaatgcatattgcttcagccacagaaataaattccagtttcataccaagcatggagaagttgcacagctcactccattcaaagtctgttgaattcaaagatatcatcaaaataggccggactcatactcaggatgccactcctctaactcttggtcaagagtttagtggttatacaacacaggtaaaatatggaattaatcgaatcaaagacaccctacctcgaatgtatcagcttgcacagggtgggactgctgtaggaactggtcttaactcaaaaaagggctttgacgtaaagattgctgctgcagtagccgaggaaactggtctgccatttgtcacagctgaaaataagtttgaagctttggccgcacatgatgcttttatcgaaacaagtggtgctctgaacacaatttctgcttctcttatgaaagtgggcaatgacatacgtcttcttggaagtggcccacgctgtgggcttggagagcttattttaccagaaaatgagccaggcagcagtatcatgccaggaaaagttaatccaactcagtgcgaggctcttactatggtttgtgcacaggttatgggtaatcatgtggcaattacaattggcggatccaatgggcattttgaattaaatgtatacaaaccaatgattgccagtggtcttcttaggtcattgaggttgcttggagatgtttcgctttcttttgagaagaattgtattcgaggaattgaagctaatcatggaagaatatcaaaattactttatgagtcgttgatgcttgttacatctttgaatcctaaaattggctatgataaggcagcagcagttgcaaagaaagcacataaagaaggaacaacactgaaggaatctgctatgcaacttggggttctcactgctcaagagtttgacgacctggtggtaccggggaaaatgatcggtccctctgactagaagacattaccattatttttgcctgcctacctacctaatttataacagaccgtattggctttactcttgtaacaccattgaattgggttcaagaattttccgtggctcaataaacttgtcgtatcgcctgcaaagatggcgggcagaagaagctcttcacggccaccacattctttttcttgttatgagagatctaagtatctagtaaataatcccccattcatgactccagatggcaataatctgtagaagaattcagatatggttggttgcacacttgcacctcatttttattgaatgtgtatttctttgtggatggaatgataggagaaaactgtcctaaaaataaaaaatggaaatccggttgtttagaatttaaac

SEQ ID NO: 1810 - DNA, 1769 bp, Arabidopsis lyrata
ttttttttttctttgtgttgccctatctcctccctctctctgtgctcttctgcgacttgatccgtcgtcttctctcaactctccatcttcgtcttccaagttttacagtcaggtagaagaatccatggcgatttacgtcgcgtcgcggcggctctccggcggaacaactgcgacggcgctgcgttatgccacctcgctgagatcttattcgacctcgtttagggaggagagggataccttcgggccgatccaagttccttccgataaattgtggggagcccagacgcagaggtcgctgcagaacttcgaaatcggtggtgagcgcgagcgaatgcctgaaccaattgtccgcgcttttggagtcttgaagaaatgcgctgccaaggttaacatggagtatggtcttgatccaactattgggaaagctattatgcaagctgctcaggaagtagctgagggacagctcaatgatcatttcccccttgttgtctggcaaactggtagtgggactcagagtaatatgaatgctaatgaggtcattgctaacagagcagctgagattcttggtcgcaaacgtggtgagaaatgtgtgcacccaaatgaccatgtcaatagatcacaatcttctaacgacacttttccaaccgtcatgcacattgcagctgcaaccgagattaattcgaggctcatccctagtttaaaaactttgcatagcactttggaatctaagtccttcgagttcaaagatattgtgaaaattggaagaactcacacccaagatgctacacctttgacactaggacaagaatttggtggctatgctactcaggttaagtatggactaaatagagtcacctgcactcttcctcgcctctatcagcttgcacaaggtggaactgcggttgggacaggattaaacactaagaaaggatttgatgtaaagatagctgctgcagtagctgaagaaacaaacttgccatttgtcaccgcagaaaacaagtttgaagctctggctgcacacgatgcttgtgttgaaaccagtgggtcacttaacacaatcgccgcatcgctaatgaaaatcgccaatgatatacgttttcttggaagtggcccaagatgtggtcttggtgaacttgttctacctgaaaatgagccaggaagcagtatcatgcctgggaaggtaaatcctacacagtgtgaggccttgactatggtttgtgctcaggttatgggaaaccatgtagctgtgacagttggtgggtcaaatggtcatttcgaattgaatgtattcaagccggtgatcgcaagcgctcttttgcattccgtcagattaatagcagatgcttcagcttcgttcgagaaaaactgtgtgaggggcattgaggccaacagagaaaggatctcaaagctattgcacgagtctcttatgctcgtgacatcattgaatccgaaaatcggctatgacaatgctgcagcagttgccaagaaagctcacaaagaaggatgtacattgaaggacgcggctctgaagctaggcgttcttactgcggaagagtttgatactcttgttgttcctgagaagatgattggtccctccgattgatagttctttttggagccaaagcttctttatttaggttataataaaaatgagcaaatccgacaaactatataattcaaattttcttgggagggcaacatcctatcatcttctttatgtatcaatttttttgtgttgaataagagtaaactcagcgagaagaatgtct

SEQ ID NO: 1811 - DNA, 1773 bp, Glycine max
gtattggtgattggtcagactagtgttattctccggtggctccttccttccttcgccatggcgttctacgtgctctcgcgtcgtttatcagctggatccaactcaacgacgctcctcgccctgcgttttgcttcctcttccagatccttctcctcttccttcagggaagaaagagatacctttggacccattcaagttccctccgacaaattatggggagcacaaactcaaagatcgttgcagaacttcgacatcggtgggccccgcgaacgcatgcccgaacccatcattcgcgcttttggcgtcttgaagaaatgcgctgctaaggtgaacatggagtatggtcttgatcccatcgtgggagaagcaataatgcaagcggcacaagaagtagccgagggaaaactaaacgaacattttcctctcgttgtatggcaaactggcagtggcactcaaagtaacatgaatgctaacgaggttattgcaaaccgagcagcagagattcttggccataagcgcggtgggaagttcgtgcacccaaatgaccatgtcaatagatcgcagtcttctaatgatacattcccaaccgtaatgcacattgcagccacaatggaaataaactcaagactaattcccagcttgaaaaccttacacggtacactaaactcaaagtcaattgaattcaaagatattgtcaagattggacgcactcatactcaagatgcaacacctttgactcttgggcaagagtttagtgggtatactacacaagtgaagtacggtattgatcgagtaattggcactttgccgcacctgtatcagcttgcccagggtggtacagctgtagggactggattgaatacaaagaaggggtttgatgccaagatagcagcagcagtagctgaggaaacaaatctgccttttgttacggcagaaaataagtttgaggccttggctgcccatgatgcttttgttgaaactagtggagcacttaacactattgcggcttctttgatgaagattgctaatgatatacggttgttaggaagtggtccacgctgcggtcttggtgaactcattcttcctgaaaacgaaccaggaagtagtatcatgcctgggaaggttaaccctacccagtgtgaggctttgacaatggtgtgtgcccaggtcattggaaaccatgttgcagttacagtgggtggatcaaatggtcattttgagcttaatgtgttcaagccaatgattgccagttgtctcctgcattcgctgagactgcttggagattcatctgcttcctttgaaaagaattgtgtgagaggcattcaagctaatagggaaagaatttcaaaattactgcatgagtcactgatgctcgtcacatccttaaacccaaaaattggttatgacaaggcagcagcagttgccaagacagcccacaaagaggggtgtactcttaaggaagctgcattgaaactcggagtgctcagctctgaagattttgacaagcttgtggtacctgagaaaatgcttggaccgtctgattgactaactcgcaatgttttgttctaataattccttgtttcatcatatcggctacatttgaggtagtatttttttagctacacccgttgattggtttgagaaatggcaacccaatgaacaataatttggcttcctcagttgatattcgcgagggaagagttcttccaaatttgtaacgagacaatgtattgcagaaatttactgagccaaataaagggaaattttttattc

SEQ ID NO: 1812 - DNA, 1787 bp, Glycine max
ccatggcgttctacgtgctctcgcgtcgtttatcagctggatccaactcaacgacgctcctcgccctgcgttttgcttcctcttccagatccttctcctcttccttcagggaagaaagagatacctttggacccattcaagttccctccgacaaattatggggagcacaaactcaaagatcgttgcagaacttcgacatcggtgggccccgcgaacgcatgcccgaacccatcattcgcgcttttggcgtcttgaagaaatgcgctgctaaggtgaacatggagtatggtcttgatcccatcgtgggagaagcaataatgcaagcggcacaagaagtagccgagggaaaactaaacgaacattttcctctcgttgtatggcaaactggcagtggcactcaaagtaacatgaatgctaacgaggttattgcaaaccgagcagcagagattcttggccataagcgcggtgggaagttcgtgcacccaaatgaccatgtcaatagatcgcagtcttctaatgatacattcccaaccgtaatgcacattgcagccacaatggaaataaactcaagactaattcccagcttgaaaaccttacacggtacactaaactcaaagtcaattgaattcaaagatattgtcaagattggacgcactcatactcaagatgcaacacctttgactcttgggcaagagtttagtgggtatactacacaagtgaagtacggtattgatcgagtaattggcactttgccgcacctgtatcagcttgcccagggtggtacagctgtagggactggattgaatacaaagaaggggtttgatgctaagatagcagcagcagtagcagacgaaacaaatctgccttttgttacggcagaaaataagtttgaggccttggctgcccatgatgcttttgttgaaactagtggagcacttaacactattgcggcttctttgatgaagattgctaatgatatacggttattaggaagtggtccacgttgcggtcttggtgaactcattcttcctgaaaatgaaccaggaagcagtattatgcctgggaaggttaaccctacccagtgtgaggctttgacaatggtgtgtgcacaggtcatgggaaaccatgttgcagttacagtgggtggatcaaatggtcattttgagctcaatgtgttcaagccaatgattgccagttgtctcctgcattcactgagactgcttggagattcatctgcttccttcgaaaagaattgtgtgagaggtattcaagctaatagggaaagaatttcaaaattactgcatgagtcacttatgctcgtcacatccttgaacccaaaaattggttatgacaaggcagcagcagttgccaagacagcccacaaagaggggtgtactcttaaggaagctgcattgaaactcggagtgctgagctcagaagattttgacaagcttgtggtacctgagaaaatgcttggaccgtccgattgactaactcgtaatgttttgttctaataattccttgtttcatcatatcggctacatttgaggtagtatttttttagctacacccgttgattggtttgagaaatggcaacccaatgaacaataatttggcttccttatttgatattcgtgagggaagagttcttccaaatttgtaacgagacaatgtattgcagaaatttactgagccaaataaagggaaattttttattcattgtccttgcattatattttcaatgatttctggattgtaaatttgtcataatagagttattagttttt

SEQ ID NO: 1813 - DNA, 1793 bp, Helianthus annuus
  misc_feature (199)..(199): n is a, c, g, or t
  misc_feature (1333)..(1333): n is a, c, g, or t
  misc_feature (1379)..(1379): n is a, c, g, or t
  misc_feature (1522)..(1522): n is a, c, g, or t
  misc_feature (1545)..(1545): n is a, c, g, or t
  misc_feature (1589)..(1589): n is a, c, g, or t
  misc_feature (1607)..(1607): n is a, c, g, or t
  misc_feature (1626)..(1626): n is a, c, g, or t
  misc_feature (1643)..(1643): n is a, c, g, or t
  misc_feature (1673)..(1673): n is a, c, g, or t
  misc_feature (1691)..(1691): n is a, c, g, or t
  misc_feature (1697)..(1697): n is a, c, g, or t
  misc_feature (1737)..(1737): n is a, c, g, or t
  misc_feature (1740)..(1741): n is a, c, g, or t
  misc_feature (1745)..(1745): n is a, c, g, or t
  misc_feature (1748)..(1748): n is a, c, g, or t
  misc_feature (1751)..(1751): n is a, c, g, or t
  misc_feature (1753)..(1755): n is a, c, g, or t
  misc_feature (1758)..(1758): n is a, c, g, or t
  misc_feature (1761)..(1763): n is a, c, g, or t
ttctgcattcattacattcattccggttaatttgtaggaaaaagaaatggcgatggttcaagcatatcgtcgaatatctggcggatcggtcgtttgtgcagattcgcttcggctcacgacgtgttggagatatttttctacgggttttagagaagaaagagacacgtttggaccgattcaagttccatctgataagttntggggtgcgcaaacgcaacgatctttgcagaattttgaaatcggtggtgaccgtgaaagaatgcctgaaccgatcattcgttcttttggaatcctcaaaaagtgtgctgctaaggtaaacatggaatacgggcttgatccatctatagggaaagcaataatggaagctgcacaagaagtggcagaagggaagttaaacgatcactttccattggttgtatggcagactggcagtggcacgcaaagcaatatgaacgccaacgaggttattgcaaatagagcggctgaaattctcggccacaaacgtggtgataagtttgtgcatccaaatgaccatgtgaacagatcacagtcttcaaatgatacattcccaaccgttatgcatatcgcagctgcaacagaaatcaactcaaggcttatcccaaaacttaagcagttacatacttccctacaagcaaagacaaatgagttctcggatatagttaaaatcgggcgtacacacacccaagatgcaacacccttgactctcggacaagagtttagtggctataccacacaagtgaagtatggaattgatcgggttatatgcactcttcctcgcatgtatcagcttgcacaaggtggtactgctgtagggacaggattaaacacaaagaaaggatttgatgtaaagattgctgcagcagtagctgatgaaacaagattaccatttgtaacagctgaaaataagtttgaggcgctggctgcgcatgatgcctttgttgaagctagtggagccttgaacacgattgctgcttcacttatgaagattgcaaatgatatacggttcctaggaagtggtccacgttgcggtcttggggaacttattcttcctgagaatgaacctgggagcagcatcatgcctggaaaagtgaatcctacacagtgtgaagctctgactatggtctgtgctcaggcaattggaaaccatgttgcccttacagtgggtggttcaaatggccattttgagctaaatgttttcaagccgatgattgctagttcgcttttacactcaataagacttctagcggacgcatctgcttctttcgaaaagaattgcgtgagaggaattcaagcaaacagagataggatttcnaagttattacatgagtcacttatgctcgtgacatctttgaatcccnaaaatggctatgataatgctgcagcggttgccaagactgcccacaaacagggatgtacactcaaggaagctgctctccaattgggagtgttgactagtgaagaattcgagcaacttgtagttccggaaaagatgattggtccnactgattaaagcaacatgttgangatatggttgcattgttgaagccattttgctgtaagttatttanataggaaataaaagatcnctggtctcatcatatttcnggaattcattgaagtgntgtattcttctgagtgacgtgaacttgtcnagaaaaaactacatgtcnccaacnatatttttgccggataaaggtttcttactttgttgtttcncanntganaanaantnnnttnaannncataatgagatatcacagggtgtttgggtc

SEQ ID NO: 1814 - DNA, 1806 bp, Glycine max
ggaagaagactgcggaatcgcgtatcctgattggtcagacaagtgttatgctccggtgactccttccttcgccacccccactcaaattcaaccatggcgttgtacgtgctctcgcgtcgtttatcagctggatccaactcaaccacgctcctcgccttgcgttttgtttcctctaccagatcctactcctcttccttcagggaagaaagagatacctttggagccattcaagttccctccgagaaattatggggagcacaaactcaaagatcgttgcagaacttcgatatcggtgggccccgcgaacgcatgcccgaacccatcattcgcgcctttggcgtcttgaagaaatgcgctgctaaggtgaacatggagtatggtcttgatcccgccgttggaaaagcgattatgcaagcggcacaagaagtggccgagggaaaactaaacgaccattttcctctcgttgtatggcaaactggcagtggcactcaaagtaacatgaatgctaacgaggttattgcaaaccgagcagcagagattctttggcataagcggggtgggaagttagtgcacccaaatgaccatgtcaatagatcacagtcttcaaatgatacattcccaactgtaatgcacattgcagccgcaatggaaataaactcaagactaattcccagcctgaaaaccttacatggtacactaaactcaaagtcaattgaattcaaagatattgtcaagattggacgcactcatactcaagatgcaacacctttgactcttggacaagagtttagtgggtatactacacaagtgaagtatggtattgatagagtaattggcactttgccgcacatgtatcagcttgcccagggtgggacagctgtagggactggattgaatacaaagaaggggtttgatgccaaaatagcagcagcagtagctgaggaaaccaatctgccttttgttacggcagaaaataagtttgaggccttggctgcccatgatgcttttgttgaaactagtggagcccttaacactattgcggcttctttgatgaagattgctaatgacatacggttgttaggaagtggtccacgctgcggtcttggtgaactcattcttcctgaaaacgaaccagggagcagtatcatgcctgggaaggttaaccctacccagtgtgaggctttgacaatggtgtgtgcccaggtcataggaaaccatgttgcagttacagtgggtggatcaaatggtcattttgagcttaatgtgttcaagccaatgattgccagttgtctcctgcattcactgagactgcttggagattcatctgcttcctttgaaaagaattgcgtgagaggcattcaagctaacagggaaagaatttcaaaattactgcatgagtcactaatgcttgtcacatccttaaacccgaaaattggttatgacaaggcagcagcagttgccaagacagcccacaaagaggggtgtactcttaaggaagctgcattgaaactcggagtgctcagctctgaagattttgacaagcttgtggtacctgagaaaatgcttggaccatctgattgactggctcgtaatgttttgttctaattattccttgttttatcatcggctacattgaggtagtattttttagccacacccgttgataggtttgagaaatggcaatccaatgaacaataatttggcttcctcagttgatattcgcgagggaagagctcttccaaatttgtaatgagacaatgtattgcagaaatttactgacccaaataaagggaaaatttgtattca

SEQ ID NO: 1815 - DNA, 1748 bp, Taraxacum officinale
gcgggggctcaaccagcgtgcttgcttttctttcttttttccgccatctggggctacacttctgcaatcgattgcattctggttaaaatataggaaaagaaaatggcgatggttcatgcatatcgtcgaggtggatcggtaattgtggcagattcattacgtttcacgacgagctggagacatttttcgacggggttcagagaggaaagagatacgtttggaccaattcaagtcccatctgataagttatggggagctcaaactcaaagatctttgcagaattttgaaatcggaggcgaccgtgaaagaatgccagaaccaatcatccgttcatttggaatccttaagaaatgcgctgccaaggtgaacatggaatatggtcttgatccatccatcggaaaagcaataatggaagctgcacaagaagtggcagaagggaagttaaacgatcacttcccattggttgtatggcagactggaagtggcactcaaagtaatatgaatgccaacgaggttattgcaaatagagcagctgaaattcttggccacaaacgtggtgataaatttgtgcatccaaatgaccatgtcaacagatcacagtcctcaaatgatacatttccaactgtgatgcatattgcagctgctacagaaatcaactcaagacttattccaaaacttaaacagctacacacctccctacaatcaaagacaaatgagttctcagatatagttaaaattgggcgtacccatactcaagatgcaactccattgactcttggtcaagaattcagtggctataccacacaagtgaagtatggaattgaacgggttttatgcactctacctcgcatgtaccagcttgcacaaggtgggacagctgtagggacaggattgaacacaaagaaagggtttgatgttaagattgctgcagcagtagctgatgaaacaagattaccatttgtaacagctgaaaataagtttgaagccctcgctgcacatgatgcttttgttgaggctagtggtgccttgaatacaattgctacttctcttatgaagattgctaatgacatacggtttttaggaagtggtccacgatgtggtcttggtgaacttattctgcctgaaaatgaacctggtagcagcatcatgcctgggaaagtaaaccctactcaatgtgaggcaatgactatggtttgtgctcaggcaattggaaaccatgttgcacttacagttggtggttcaaatgggcattttgagctcaatgttttcaagccaatgatgccagcactcttttacattcataaggcttcttgctgatgcatctgcttcatttgaaaagaactgtgtaagaggtattcaagccaacagggacagaatctcaaagctcttgcatgagtcacttatgcttgtgacatctctgaatccaaaaattgggtatgacaatgctgcagcagttgccaagactgcccacaaggaaggaagtacactgaaggaagctgctttgaaattgggagtgttgacaagtgaagagtttgatcaacttgtagtgccagaaaagatgattggtccatccgattgaaccaattatagacaataaaagatgaacaacatttcagaggttcctttgaggaaactatttttgaaaactaattttgttatacctaataatctctacttattccacagtttccacaacggaaaatttgagatttgattttacatgtaatataaaatgtatcttctttggg

SEQ ID NO: 1816 - DNA, 1826 bp, Arabidopsis thaliana
gaatccgtttctcgaatattataattttatttttgttgtttgccctatctttctttctccctctgctcttgtgcaacttgatccgtcgtcttctctcagctctccatctccgtcttccaagttttactgtcaggtagaagaatccatgtcgatttacgtcgcgtcgcgacggctctccggcggaacaactgtgacggcgctgcgttatgccacctctctgagatcttattcgacctcgtttagggaggagagggacaccttcgggccgattcaagttccttccgataaattgtggggagcccagacgcagagatcgctgcagaacttcgaaatcggtggtgagcgcgagcgaatgcctgaaccaattgtccgcgcttttggcgtcttgaagaaatgcgctgccaaggttaacatggaatacggtcttgatccgacgattgggaaagcaattatgcaagctgctcaggaagtagctgagggaaagctcaatgatcatttcccccttgttgtctggcaaactggtagtgggactcagagtaatatgaatgctaatgaggtcattgctaatagagcagctgagattcttggtcgcaaacgtggtgagaaatgtgtgcacccaaatgaccatgtgaacagatcacaatcttctaacgacacttttcctaccgtcatgcacattgcagctgcaaccgagattaattcgaggctcatccctagtttaaaaactttgcatagcactttggaatctaagtccttcgagttcaaagatattgtgaaaattggaagaactcacactcaagatgctacacctttgacactaggacaagaatttggtggctatgctactcaagttaagtatggactaaatagagtcacctgcactcttcctcgcctctatcagcttgcacaaggtggaactgcggttgggacaggattaaacactaagaaagggtttgatgtaaagatagctgctgcagtagctgaagaaacaaacttgccatttgtcactgcagaaaacaagtttgaagctctggctgcacacgatgcttgtgttgaaaccagtgggtcacttaacacaatcgccacatcgctgatgaagatcgccaatgatatacgttttcttggaagtggcccaagatgtggtcttggtgaacttgtactacctgaaaatgagccaggaagcagtatcatgcctgggaaggtaaatcctacacagtgtgaggccttgactatggtttgtgcacaggttatgggaaaccatgtagctgtgacagttggtgggtcaaatggtcatttcgaattgaatgtattcaagccggtgatcgcgagtgctcttttacattccgtcagattaatagcagatgcttcagcttcgttcgagaaaaactgtgtgaggggcattgaggccaacagagaaagaatctcaaagctattgcacgagtctcttatgcttgtgacatcattgaatccgaaaatcgggtatgacaatgctgcagcagttgccaagaaagctcacaaagaaggatgtacattgaaggaagcggctctgaatttaggcgtgcttactgcggaagagtttgatacacttgttgttcctgagaagatgattggtccctccgattgatagttgtttttggagccaaagcttcaagtaccattattcttctgatgcttttatttaggttataataaaaatgagcaaatccagaaacaattcaaattttcttgggagggcaacattgttcttcatcttacggctaaactatgatcttctttatgtatcaattttttttttgtgttgaataagagagtgagtactcagcgag

SEQ ID NO: 1817 - DNA, 1859 bp, Arabidopsis thaliana
gaatccgtttctcgaatattataattttatttttgttgtttgccctatctttctttctccctctgctcttgtgcaacttgatccgtcgtcttctctcagctctccatctccgtcttccaagttttactgtcaggtagaagaatccatgtcgatttacgtcgcgtcgcgacggctctccggcggaacaactgtgacggcgctgcgttatgccacctctctgagatcttattcgacctcgtttagggaggagagggacaccttcgggccgattcaagttccttccgataaattgtggggagcccagacgcagagatcgctgcagaacttcgaaatcggtggtgagcgcgagcgaatgcctgaaccaattgtccgcgcttttggcgtcttgaagaaatgcgctgccaaggttaacatggaatacggtcttgatccgacgattgggaaagcaattatgcaagctgctcaggaagtagctgagggaaagctcaatgatcatttcccccttgttgtctggcaaactggtagtgggactcagagtaatatgaatgctaatgaggtcattgctaatagagcagctgagattcttggtcgcaaacgtggtgagaaatgtgtgcacccaaatgaccatgtgaacagatcacaatcttctaacgacacttttcctaccgtcatgcacattgcagctgcaaccgagattaattcgaggctcatccctagtttaaaaactttgcatagcactttggaatctaagtccttcgagttcaaagatattgtgaaaattggaagaactcacactcaagatgctacacctttgacactaggacaagaatttggtggctatgctactcaagttaagtatggactaaatagagtcacctgcactcttcctcgcctctatcagcttgcacaaggtggaactgcggttgggacaggattaaacactaagaaagggtttgatgtaaagatagctgctgcagtagctgaagaaacaaacttgccatttgtcactgcagaaaacaagtttgaagctctggctgcacacgatgcttgtgttgaaaccagtgggtcacttaacacaatcgccacatcgctgatgaagatcgccaatgatatacgttttcttggaagtggcccaagatgtggtcttggtgaacttgtactacctgaaaatgagccaggaagcagtatcatgcctgggaaggtaaatcctacacagtgtgaggccttgactatggtttgtgcacaggttatgggaaaccatgtagctgtgacagttggtgggtcaaatggtcatttcgaattgaatgtattcaagccggtgatcgcgagtgctcttttacattccgtcagattaatagcagatgcttcagcttcgttcgagaaaaactgtgtgaggggcattgaggccaacagagaaagaatctcaaagctattgcacgagtctcttatgcttgtgacatcattgaatccgaaaatcgggtatgacaatgctgcagcagttgccaagaaagctcacaaagaaggatgtacattgaaggaagcggctctgaatttaggcgtgcttactgcggaagagtttgatacacttgttgttcctgagaagatgattggtccctccgattgatagttgtttttggagccaaagcttcaagtaccattattcttctgatgcttttatttaggttataataaaaatgagcaaatccagaaacaattcaaattttcttgggagggcaacattgttcttcatcttacggctaaactatgatcttctttatgtatcaattttttttttgtgttgaataagagagtgagtactcagcgagaagaatttctgagtttcgttagtctctctctcc

SEQ ID NO: 1818 - DNA, 1881 bp, Raphanus sativus
  misc_feature (120)..(120): n is a, c, g, or t
  misc_feature (122)..(122): n is a, c, g, or t
  misc_feature (137)..(137): n is a, c, g, or t
  misc_feature (140)..(141): n is a, c, g, or t
  misc_feature (192)..(192): n is a, c, g, or t
ggaacgtgatacatcccccgcaactctccattttcgtctcccaaggccaaagccaaggcagaagaagaacacatgtcgatctacgtcgcgtcacggcgactttccgccagaacaaccgcngngacgctgcgttatgncanngctctgagatcttattcaacgtcgtcgtttagggaggagagggacaccttngggccgatccaagttccttccgataaattgtggggagcccagacgcagagatcgctacagaacttcgaaatcggtggtgagcgggagcgtatgcccgaacctatcgtccgcgctttcggcgtcttgaagaagtgcgctgccaaggtaaacatggagtatggacttgatccaacgattgggaaagcgattatggaagcagctcaggaagtagctgagggcaaactcaatgatcatttcccccttgttgtttggcaaactggtagtggcactcagagtaacatgaatgctaatgaggtcattgctaacagagcagctgagattcttggtcgcaaacgtggtgaaaaatgcgtccaccctaatgaccatgtcaaccgttctcaatcttctaacgacactttccctactgtcatgcacattgcagctgcaaccgagattaattcaaggctcattcctagtttgaaaactttgcattccactctcgactctaagtccttcgagttcaaagatattgtcaaaattggaagaactcacactcaagatgctactcctttgaccctaggacaagaatttggtggctatgctactcaagttaagtatggacttaatcgagtcacatgcactctaccccgcctctatcagcttgcacaaggtggaactgctgttgggacaggactaaacaccaagaaagggtttgatgtaaagatagctgctgcagtggcagaagaaacaaacctgccgttcgtcactgcagaaaacaagttcgaagctctggctgcacacgatgcttgtgttgaaaccagtgggtcacttaacacaatcgccacgtcgttgatgaaaattgccaatgatatacgttttcttggaagtggtccaagatgtggtcttggtgaacttgttctgcctgaaaatgagccaggaagcagcatcatgcctgggaaggtaaatcctacacagtgtgaggccttgaccatggtttgtgctcaggtaatgggcaaccatgtcgctgtgacagttggtgggtcaaatggtcatttcgaattgaatgtatttaagccggtgatcgcaagctctctcttgcattccgtaagattgatagcagatgcttcagcttcgtttgagaaaaactgtgtgaggggcattgaggccaacagagaaaggatctcaaagctattacacgagtctcttatgcttgtgacatcattgaatccgaaaatcggatatgacaatgctgcagcagttgccaagaaagctcacaaagaaggatcgacattgaaggaagcggctctgaagttaggtgttcttacctctgaagagtttgatacgcttgtcgtccccgagaagatgatcgggccctccgattgatgttgagctaaaagcttcatttcacatgtcttattcttgttaagggtgtaatgacaaataagcaaatcccagaaactcaaattcagattttgcattggaaggattcaattcttgatgtatcagttatttttgttgaataaaagagtaactattcatgtttagaccagaaagaaagagtaactagtcatgtcaggatgaaggaaggagagaactaaacatgtgtagtgtgttatgtaatacgggtgatggctgctgtggtatgggactcgacgatgtggacttggccaatattgtgttggaaggcctttcgtggcttcaggatttaca

SEQ ID NO: 1819 - DNA, 1912 bp, Glycine max
cggaatcgcgtatcctgattggtcagacaagtgttatgctccggtgactccttccttcgccacccccactcaaattcaaccatggcgttgtacgtgctctcgcgtcgtttatcagctggatccaactcaaccacgctcctcgccttgcgttttgtttcctctaccagatcctactcctcttccttcagggaagaaagagatacctttggagccattcaagttccctccgagaaattatggggagcacaaactcaaagatcgttgcagaacttcgatatcggtgggccccgcgaacgcatgcccgaacccatcattcgcgcctttggcgtcttgaagaaatgcgctgctaaggtgaacatggagtatggtcttgatcccgccgttggaaaagcgattatgcaagcggcacaagaagtggccgagggaaaactaaacgaccattttcctctcgttgtatggcaaactggcagtggcactcaaagtaacatgaatgctaacgaggttattgcaaaccgagcagcagagattctttggcataagcggggtgggaagttagtgcacccaaatgaccatgtcaatagatcacagtcttcaaatgatacattcccaactgtaatgcacattgcagccgcaatggaaataaactcaagactaattcccagcctgaaaaccttacatggtacactaaactcaaagtcaattgaattcaaagatattgtcaagattggacgcactcatactcaagatgcaacacctttgactcttggacaagagtttagtgggtatactacacaagtgaagtatggtattgatagagtaattggcactttgccgcacatgtatcagcttgcccagggtggtacagctgtagggactggattgaataccaagaaggggtttgatgccaagatagcagcagcagtagctgaggaaacaaatctgccttttgtcacggcagaaaataagtttgaggccttggctgcccatgatgcttttgttgaaactagtggagcccttaacactgttgtggcttcattgatgaagattgctaatgatatacggttattgggaagtggtccacgctgcggtcttggggagctcattcttcctgaaaacgaaccaggaagcagtattatgcctgggaaggttaacccgacccagtgtgaggctttgacgatggtgtgtgcacaggtcatgggaaaccatgttgcaatcacagtgggtggatcaaatggtcattttgagctcaatgtgttcaagccaatgattgccaattgtctcctgcattcgctgagactgcttggagattcgtctgcttcctttgaaaagaattgtttgagaggtattcaagctaatagggaaagaatttcaaaattactgcatgagtcacttatgcttgtcacatccttaaacccaaaaatcggttatgacaaggcagcaacagttgccaagacagctcacaaagaggggactactcttaaggaagctgcattgaaactcggagtgctctgctctgaagattttgacaagcttgtggtacctgagaaaatgcttggaccatctgattgattggctcgaatgttttgttcttataattccttgtttcatcatcggctccattgaagtattaagtattatttatacgaaagcaaaaagcttatatacatatatcctagaacaatgcaccaaagaccttagggtcaaggtttataaaattgtggttatgattgcagatgcgattatcgcgattgtggttattgcagcagctacagcgggaaataatcttatgtttgtacctgatactaaaaacatgtaattctttatgtaccttttatttagaatgttatataaacttcttctttttttttaacagaatgttgtataaacttttataatattagtataattaacc

SEQ ID NO: 1820 - DNA, 1901 bp, Centaurea maculosa
  misc_feature (157)..(157): n is a, c, g, or t
  misc_feature (161)..(161): n is a, c, g, or t
  misc_feature (163)..(163): n is a, c, g, or t
  misc_feature (168)..(168): n is a, c, g, or t
  misc_feature (188)..(188): n is a, c, g, or t
  misc_feature (863)..(863): n is a, c, g, or t
  misc_feature (878)..(878): n is a, c, g, or t
  misc_feature (901)..(901): n is a, c, g, or t
  misc_feature (935)..(935): n is a, c, g, or t
  misc_feature (947)..(947): n is a, c, g, or t
  misc_feature (952)..(952): n is a, c, g, or t
  misc_feature (976)..(976): n is a, c, g, or t
  misc_feature (1057)..(1057): n is a, c, g, or t
  misc_feature (1069)..(1069): n is a, c, g, or t
  misc_feature (1238)..(1238): n is a, c, g, or t
  misc_feature (1269)..(1269): n is a, c, g, or t
  misc_feature (1284)..(1284): n is a, c, g, or t
  misc_feature (1302)..(1302): n is a, c, g, or t
  misc_feature (1332)..(1332): n is a, c, g, or t
  misc_feature (1389)..(1389): n is a, c, g, or t
  misc_feature (1510)..(1510): n is a, c, g, or t
cgggggccaaaccttgctttttcttcccttttctcccccatcactgcaattgattgcattcattctggtacaatcatagaggaaatcggaaatggcgatggttcaggcatatcgtcgaatatatggcggatcgaccattgtttcagattcgattagnttcncnacganctggagacatttctctacgncgtttagagaggaaagagatacgtttggaccgattcaagtcccaaacgataagttatggggagctcaaacgcaaagatctttacagaattttgaaatcggaggtgaccgtgaaagaatgccagaaccaatcattcgttcttttgggatcctcaaaaagtgtgctgctaaggtgaacatggaatatggtcttgatccctccatagggaaagcgattatgcaagctgcacaagaagtggctgaggggaagttaaatgatcactttccactagttatatggcagactggaagtggcactcaaagcaatatgaatgccaacgaggtcattgcaaatagagcagctgaaattcttggccataagcgtggtggaaagtttgtgcatccaaatgaccatgtaaacagatcacagtcctcaaatgatacattcccaactgtaatgcatattgcagcggcaacagaaatcaactcaagacttattccaaaattgaagcagttacatacttccctacaagcgaagacaaccgagttctctgacatagttaagattggacgtactcacactcaagacgcaacacccttgactcttgggcaagagttcagtggttataccacacaagtgaagtatggaattgatcgggtcatgtgcactctccctcgcatgtatcagcttgcacaangtggcactgctgtanggacaggattgaacacaaagaangggtttgatgcaaagattgctgcagcagttgctnatgaaacaagantaccntttgtaacagctgaaaataagttngaggcattggctgcacatgatgcttttgttgaagctagtggagccctgaacacacttgctacttctctcatgaagatcgcnaatgacatacgnttcctaggaagtggtccacgctgcggtcttggtgaacttattcttcccgagaatgaacctggtagcagcatcatgcctggaaagtgaatcctacacaatgtgaggccctgactatggtctgtgctcaggcaattggaaaccatgttgcccttacagtgggtggttcaantggccattttgagctcaacgttttcaagccnatgattgctagctcnctcttacactcgataagncttcttgcggatgcatctgcttcttttganaagaactgtgtgagaggcattcaagccaatagggataggatttcaaagttattacangagtcacttatgctcgtgacatctttgaatcctaaaattggttatgacaatgctgcagcggttgccaagactgcccacaaggagggaagtacactcaaggaagctgctctgaaattggganttctaactagcgaagaattcgatcaacttgtagtgccagaaaagatgatcggtccctctgattaacaagtggcttgaagctcgcaactaatttattttggcgcgttttatgaactcgaagccatcgtgttttcggatagaaaataaagagggtcacttgggctatatcaatatttagaggtggactcaagtactgcattcttccaatacattcttctttttgggttatgggggggtcttttgtaagaagacttgttgagaaaaaaaacttgatttaaccctcaattgtttggtagatgaggggctttatttttatttttttaatgcaaatgagataaatctcttgaatttttctaaggatgaaatgtatacccaataatgagaggttttac

SEQ ID NO: 1821 - DNA, 1877 bp, Lactuca sativa
ttttttcttttctccgccatctggggctacacttctgcaatcgattgcattcgttctggttattttataagaaaagaaatgacgatagttcaggcatatcgtcgaatatctggcggatcggtgattgttgcagattcattacggttcacgacgtgctggagacatttttcgacggcgtttagagaggaaagagatacgtttggaccaattcaagtcccatctgataagttatggggagctcaaacacaaagatctttgcagaattttgaaattggaggcgatcgcgaaagaatgccagaaccaatcattcgttcttttggaatccttaaaaaatgtgctgctaaggtgaacatggaatatggtcttgatccatccatagggaaagcaataatgcaagctgcacaagaagttgcagaggggaagttgaatgatcactttccattggttgtttggcaaactggcagtggcactcaaagcaatatgaatgccaatgaggtgattgcaaatagagcagctgaaatccttggccacaagcgaggtgataagtttgtgcatccaaatgatcatgtgaacagatcacagtcttcaaatgatacatttccaactgtaatgcatattgcagctgctacagaaatcaattcaagacttattccaaaacttaagcagttacatacttccctacaagcaaagacaaacgagttctctgatatagttaaaattgggcgtacacatactcaagatgcaacacccttgacccttggtcaagaattcagtggctataccacacaagtgaagtatggaattgaacggatcatatgtactctccctcgcatgtatcagcttgcacaaggtggcactgctgtagggacaggattgaacacaaagaaaggatttgatgtgaagattgctgcagcagtagctgatgaaacaaagttgccatttgtaacagctgaaaataagtttgaggcactggctgcacatgatgcttttgttgaagctagtggagccctgaacacaattgctacttcccttatgaagattgctaatgacatacgtttcttaggaagtggtccacgatgtggtcttggtgagcttattctccctgagaatgaacctggaagcagcatcatggctgggaaagtgaaccctactcaatgtgaggctatgactatggtttgtgctcaggcatatggaaaccatgtggctcttacagttggtgggtcaaatggtcattttgagctcaatgttttcaagccaatgattgccagtaatcttttacattcgataaggcttattgcggatgcatctgcttcgtttgaaaagactgtgtaagaggcattcaagccaacagagacagaatttcaaaagtattgcatgagtcgcttatgcttgtgacatctttgaatcctaaaattggatatgacaatgctgcagcagttgccaagactgcccacaaggagggaagtacactgaaggaagctgctctgaaattgggagtgttgacaagtgaagaatttgatcaacttgtagtgccagaaaagatgattggtccatctgattgatattaatgatattcatataaaaataataatatcttcatgtaggcatacatatatgttatatgatgaacttgaagccgttttatttactccaagttgagataagaaataaatgatcactgctggaggggctatatcagcatttcatttcagaggtttgttcggagtcataaattaagtgtgaaatttgtaagagaagttgttgaggagactagggcttcttatgattatttttttttgctagataaaaaccatttgaatcagatctctaaatggtccaacagtttacacagggagccaaatcttgagatttacaag

SEQ ID NO: 1822 - DNA, 1915 bp, Podocarpus macrophillus
gtggtgtaatataatggcattacttttagcatctcggcgctatctatcagcagtctttccgtcttctgcatattcattggtgcacagcatatcatttataagcagcagatcactttcagttttgagggaggaaagggacacctttggtcccatcaatgtaccagcagacaaactatggggtgctcagactcaaagatctctgcagaactttgacattggtggggagcgtgagcagatgcctgaaccaattatacgagcatttggtgttctaaaaaaatgtgctgctaaggtaaatatggagtatggccttgacccaaccattggcaaagcaataatgcaagctgctcaagaagttgctgaaggaaagttgaatgatcatttccctttggtcatttggcagactggcagtgggactcaaagtaacatgaatgctaatgaggttatagcaaatcgtgcttctgagattcttggaaagaaacgggagaaaattttgtacatccaaatgatcatgtcaataggtcacaatcctcaaatgatacgtttcctacggtaatgcatattgctgcagcagttgaaacgaactcaaagttcataccaaacttgcgacagttacgttctacattggaggccaagagtgttgaattcaaggacattgttaaaattgggcgcacacatacccaagatgcaactcctttgactctggggcaagagtttagtggctatgttacacaggtgaaatatggcattgaacgagtcacaaacacgttaccttttatgtaccagcttgcgcaaggagggactgcagttggaactggtcttaataccaaaaaagggtttgatgtcaaaattgctgcggctgtagctgaagaaaccaagttaccgtttgttacagctgagaacaagtttgaagctctggcagcacatgatgcttttgttgaaactagtggggccttgaacactgtttcagcttctctcatgaagatagcaaatgatatacgctttctaggaagtggtcctcgctgcgggttaggtgaacttattctgccagaaaatgaacctggtagcagtataatgcctggaaaagtgaaccctactcaatgcgaggctttgacaatggtttgtgcccaggtcatgggtaaccatgttgcaattactattggtggctcaaatggccacttcgagctgaatgtttttaagccattgattgcaagttctctacttcggtctttgagattactaggagatgcagtggcttcattcgagaagaattgtgtgagaggaacccaggccaattgtcagaggatatcacaacttttgcaagaatcattgatgcttgtcacagctctgaaccctaaaattggatatgataaagcagcagcaactgcaaagaaagcccataaggaggggacaactttgaaggaagccgcattgcaacttggagtgcttacatctgaggaatttgatgaattggtcgtcccagagaagatgcttggcccatcggactaatttaatttaagttctattgatttgtagaagttccagccgtaaattttgatattgaataataatgaaagagctaaatcaaaggtgttcaaagtcaattgagatgttcttttcatctttgatcactttttgcatttggtgaaaaaattgaaatgagttgaacctgaaagtcctaaattttcttttatattagttcaagagaactgaccatttctttgtaggatgacaatgtcattagcttcttgcgtgggaatttgagtgaactttgggagatcatttcctcttgagcatttgtaaaagagattcacatactttcccacaaaatcaagttatgttaatggaattttattgcaaagccaaccaaatgaatggttgctatcatcttactgacaattctgttttttgatggcag

SEQ ID NO: 1823 - DNA, 1576 bp, Helianthus annuus
aaaaagaaatggcgatggttcaggcatttcgtcgaacacctggtggatcggccatcgttgcagattcggttcggtttattacatgctggagacatttctctacggcttttagagaggaaagagatacgtttggaccaattcaagtcccgtctgataagttatggggagctcaaacacaaagatctttacagaattttgaaattggaggtgaccgtgaaagaatgccagaaccaatcattcgttcttttggaatcctcaaaaagtgtgctgctaaggtaaacatggaatacggccttgatccatccatagggaaagcaataatggaagctgcacaagaagtggcagaggggaagttaaacgatcactttccactagttatatggcagactggcagtggcactcaaagcaatatgaatgccaacgaggtcattgcaaatagagcagctgaaatacttggccataagcgcggtgacaagtttgtgcacccaaatgaccatgttaacagatcacagtcttcaaatgatacattcccaactgttatgcatattgcagctgcaaccgaaatcaactcaagacttatcccaaaacttaagcagctgcatacagccctacaagctaagacaaatgagttctctgatatagttaaaattgggcgtactcatactcaagatgcaacacccttgactctcggacaagagttcagcggctataccacacaagtgaagtatggaattgatagggtcatgtgcactcttcctcgcatgtatcagcttgcacaaggtggcactgctgtagggacaggattgaacacaaagaaaggatttgatgtaaagattgctgcagctgttgctgatgaaacaagattaccatttgtaacagctgaaaataagtttgaggcgctggctgcgcatgatgcctttgttgaagctagtggagcgttaaacacaattgccacttctcttatgaagattgcaaatgatatacggttcctaggaagtggtccacgttgcagtcttggggaacttattcttcctgagaatgaacctgggagcagcatcatgcctgggaaagtgaatcctacgcagtgtgaagctctaactatggtttgtgctcaggcaattggaaaccatgtagcccttacagtgggcggttcaaatggacattttgagcttaatgttttcaagccgatgattgctagtactcttttacactcaatcagacttctagccgatgcatctgcttcttttgaaaagaattgtgtgagtggcattcaagcaaatagggaaaggatatcaaagctattgcacgagtcacttatgcttgtgacatccttaaatcctaaaattggctatgacaatgctgcagcggttgccaaaaccgcccacaagcagggatgcacactcaaggaagctgctcttaaactgggagtgttgaatagtgaagaattcgatcagcttgtagtgccggaaaagatgattggccccagtgattgaagcaacatgtgattgaatgtgttacgaagctgaaaccatttcacaggaagttattgagataggaaataaatgatgatttgtgt

SEQ ID NO: 1824 - DNA, 1823 bp, Capsicum annuum
gttttgtttgtgtgtatctgtattgatctagtttagagctgcagagaaataaatggctatgttagtagcagcccgtcgattatcagctgtatcagattcactgcgttattcttatagctggaggtttttctcaacgtctttcagagaggaaagagatacatttggtcctattcttgttccatctgacaagttatggggggcacaaactcaaagatcattgcagaattttgaaattgggggtgatcgtgaaagaatgcctgagccaatcatacgtgcattcggtattcttaaaaagtgtgcagccaaggtgaacatggactatggccttgaccaatctattggaaaagcaataatgcaagcagctgaagaggttgcagaaggaaaattgactgaccattttcctttggtggtttggcaaactggcagtggcactcaaagtaacatgaatgctaacgaggttattgcaaatcgagcagctgaaatacttggccataagccaggagacaaacatgtgcatccaaatgaccatgtaaatagatcgcaatcttcaaatgatacatttcctacggtgatgcacattgctgcagcgatggagctaaataaaagattagtaccaaacttgaagcagttgcatacttcactaaattcaaagtcagtcgaattcaaggacattatcaagattgggcgaacccacacacaagatgcaacacctttgactcttggacaagagtttagtggctatgcaactcaagtgaaatatggaatcgatagagttttatgcacccttccacgcatgtatcagctcgcacaagggggcacagcagtggggacgggattgaatacaaagaaagggtttgacataaaaattgctgcagcagttgcagaggaaacaaatttgccatttgtgacagctgaaaacaagtttgaagcattggcggctcatgatgcatttgctgaaactagtggagccttaaataccgtggctgcttcccttatgaagattgggaatgatatacgcttcttgggaagtggtccccgctgtggtcttggcgagcttattcttcccgaaaatgaacctggaagcagtataatgcctggcaaggtaaatcctactcagtgtgaggctctcaccatggtctgtgctcaggttatggggaatcatgtggctgttactgttggtgcatcaaatggccattttgagctgaatgtcttcaagccgatgattgctaatgctctcctacagtcagtaagattgctaggtgacgcatctgcttcttttgaaaagaattgtgtgaggggtatccaagctaacagagagagaattgctaaattgttgcacgagtcactcatgctcgtcacatgtttgaacccaaaaattggttatgataatgctgcggcagttgccaagaaagcccacaaggagggaaccagtttaaaggatgctgctctcaatctagcagttctcaactgtgaagagtttgatcaacttgtagtccctgagaaaatgatcggtccaactgactgatctgattcagttgttctttgtaatgggagatagaggaccatggctgtggccagtgggtgcatcatacttagcttcttttgtccatcaaattcgacgacggaaataaacatttgacacaattcttgaggttttctcattcctttgcaatttatcagcaattggctgagggaatgcctccatttttgtaatgataccctgagcaaaagccaggtaaataatgaactgaaaattattttttgaggttgagcagtgaacgatgagggagaaaaatatcttttatgaaatggaaacctttgac

SEQ ID NO: 1825 - DNA, 1482 bp, Cajanus cajan
ggggactcttcgccacccctcactcaaattgaagaatggcgttgtacgcactgtcgcgtcgtttatcagctggatccaactcaacgacgctcctcgccttgcgttttgcttcctcttccagatcctactcctcttctttcagggaagaaagagataccttcggacccattcaagttccctccgacaaattatggggagcacaaactcaaagatctttacaaaacttcgatatcggtggcccccgcgaacgcatgcccgaaccaatcattcgcgccttcggcatcttgaagaaatgcgctgcgaaggtgaacatggagtatggtcttgatcccgacgttggaaaagcgataatgcaagcagcacaagaagtagctgagggaaaactaaacgaacattttcctcttgttgtatggcaaactggaagtggcactcaaagtaacatgaatgctaacgaggttattgcaaatagagcagcagagattcttggtcataagcgtggtgagaagtttgtacacccaaatgatcatgtcaatagatcacagtcttctaatgatacattcccaactgtaatgcacattgcagctgcaatggaaataaactcaagactaatccccagcttgaaaatcttacatggcacactgaactcaaagtcaattgaattcaaagatattgtcaagattggacgcactcatactcaagatgcaacacctttgactcttggacaagagtttagtgggtatactatacaagtgaagtatggtattgatcgtgtaattggtactttgccgcgtatgtatcagcttgcccagggtggtaccgctgtagggactggattgaatacaaagagggggtttgatgctaagatagcagcagcagtagctgatgaaacaaatctgccttttgttacggcagaaaataagtttgaggccttggctgcccatgatgcttttgttgaaactagtggagcccttaacactattgcagcttctttgatgaaaattgctaatgatatacggttattaggaagtggtccacgctgcggtcttggtgaactcattcttcctgaaaacgaaccaggaagcagtattatgcctgggaaggttaaccctacccagtgtgaggctttgacaatggtgtgtgcacaggtcatggggaaccatgttgcagtcacagtgggtggatcaaatggtcattttgagctcaatgtgttcaagccaatgattgccagttctctccttcattcgctgagactgctaggagattcatctgcttcttttgaaaagaattgcgtgagaggtattcaagctaatagggaaagaatttcaaaattactgcatgagtcactgatgctcgtcacatccttgaacccaaaaattggttatgacaaggcagcagcagttgccaagacagcccacaaagagggaactactctaaaggaagctgcattgaaactcggagtgctgagctctgaagagttcgaca

SEQ ID NO: 1826 - DNA, 2051 bp, Solanum tuberosum
ggattcgatttgttggcttcattcaacttccttttttgtagcctacaaaaactaatatcacctctgctgattgctctctcagactcagcatcaacattcccaccaactcgcatacaggcggcggcgcattgactgctgagatatggcgatgttaaatgcggctcgtcgattatcagctggatcagctttatcagattcactgcgttatacttcttcctggaggtttttctctacgtctttcagggaggaaagagatacgtttggtcctattctcgttccatcggacaagttatggggggctcaaactcaaagatcattgcagaattttgaaattgggggtgatcgtgaaagaatgcctgagccaatcatacgtgcattcggtattattaaaaagtgtgcagccaaggtgaacatggactatggccttgaccaatctattggaaaagcaataatgcaagcagctgaagaggttgcagaaggaaatttaaatgaccattttcctttggtggtttggcagactggcagtggcactcaaagtaacatgaatgctaacgaggttattgcaaatcgagcagctgaaatacttggccataaccgcggagacaaacatgtgcatccaaatgaccatgtaaataaatcgcaatcttcaaatgatacatttcctacggtgatgcacattgctggagcaatggagctaaataaaagattagtaccaaacttgaaacagttgcatacttcactaaattcaaagtcagtcgaattcaaggacattatcaagattgggcgaacccacacacaagatgcaacacctttgactcttggacaagagtttagtggctatgcaactcaagtgaaatatggaatcgatagagtcttatgcacccttccacgcatgtatcagctcgcacaagggggcacagcagtagggacaggattgaatacaaagaaagggtttgacataaaaattgctgcagcagttgcagaggaaacaaatttgccatttgttacagctgaaaacaagtttgaagcattggctgctcatgatgcatttgctgaaactagtggagccttaaataccctggctgcttcccttatgaagattgggaatgatatacgcttcttgggaagtggtccccgctgtggtcttggcgagctcagtcttcctgaaaatgaacccggaagcagtataatgcctggcaaggtaaatcctactcagtgtgaggctctcaccatggtctgtgctcaggttatggggaatcatgtggctgttactgttggtgcatcaaatggccattttgagctgaatgtcttcaagccgatgattgctaatgctctcctacattcagtaagattgctaggcgatgcatctgcttcctttgaaaagaattgtgtgagggatatccaagctaacagagacagaattgctaaattgttgcacgagtcactcatgctcgttacatgtttgaacccaaaaattggttatgataatgctgctgcagttgccaagaaagcccacaaggagggaaccagtttgaaggaagctgctctcaatctaggagtcctcaccagtgaagagtttgatcaacttgtagtccctgagaaaatgattggtccaactgactgatctgattcattagctcttcgaaatgagaaagaggaccatggctagcttcttctgtccatcagattcgacgagggaaataaacatttgacacaattcttgaggttttcttattcctggtaatttatcagtgttttttactgtgagaatgcctccatttttttttttgtaatgagtccctggagcgatagccaagtaaataatgaactgaattagtattttttatgaggttgggccatgaataatgagggagaaaatcatcttttatgaaatggagacggggaaatgatcaaaatggtcttaatgtatgggttttgattccatttggtccttaatatatgaacttcatggaaatggtcctttatgtatcataaattgtgatcaatttggtccttaaccctaaaattaatatttatttatttttgccatc

SEQ ID NO: 1827 - DNA, 2154 bp, Solanum phureja
ggattcgatttgttggcttcattcaacttcctaacttgtagcctacaaaaactaatatcacctctgctgattgctctctcagactcagcatcaacattcccaccaactcgcatacaggcggcggcgcattgactgctgagatatggcgatgttaaatgcggctcgtcgattatcagctggatcagctttatcagattcactgcgttatacttcttcctggaggtttttctctacgtctttcagggaggaaagagatacgtttggtcctattctcgttccatcggacaagttatggggggctcaaactcaaagatcattgcagaattttgaaattgggggtgatcgtgaaagaatgcctgagccaatcatacgtgcattcggtattattaaaaagtgtgcagccaaggtgaacatggactatggccttgaccaatctattggaaaagcaataatgcaagcagctgaagaggttgcagaaggaaatttaaatgaccattttcctttggtggtttggcagactggcagtggcactcaaagtaacatgaatgctaacgaggttattgcaaatcgagcagctgaaatacttggccataaccgcggagacaaacatgtgcatccaaatgaccatgtaaataaatcgcaatcttcaaatgatacatttcctacggtgatgcacattgctggagcaatggagctaaataaaagattagtaccaaacttgaaacagttgcatacttcactaaattcaaagtcagtcgaattcaaggacattatcaagattgggcgaacccacacacaagatgcaacacctttgactcttggacaagagtttagtggctatgcaactcaagtgaaatatggaatcgatagagtcttatgcacccttccacgcatgtatcagctcgcacaagggggcacagcagtagggacaggattgaatacaaagaaagggtttgatataaaaattgctgcagcagttgcagaggaaacaaatttgccatttgttacagctgaaaacaagtttgaagcattggctgctcatgatgcatttgctgaaactagtggagccttaaataccctggctgcttcccttatgaagattgggaatgatatacgcttcttgggaagtggtccccgctgtggtcttggcgagctcagtcttcctgaaaatgaacccggaagcagtataatgcctggcaaggtaaatcctactcagtgtgaggctctcaccatggtctgtgctcaggttatggggaatcatgtggctgttactgttggtgcatcaaatggccattttgagctgaatgtcttcaagccgatgattgctaatgctctcctacattcagtaagattgctaggcgatgcatctgcttcctttgaaaagaattgtgtgagggatatccaagctaacagagacagaattgctaaattgttgcacgagtcgctcatgctcgttacatgtttgaacccaaaaattggttatgataatgctgctgcagttgccaagaaagcccacaaggagggaaccagtttgaaggaagctgctctcaatctaggagtcctcaccagtgaagagtttgatcaacttgttgtccctgagaaaatgattggtccaactgactgatctgattcattagctcttcgaaatgagaaagaggatcatggctagcttcttctgtccatcagattcgacgagggaaataaacatttgacacaattcttgaggttttctcattcctggcaatttatcagtgtttttttactgtgagaatgcctccattttttttttgtaatgagtccctggagcgatagccaagtaaataatgaactgaattagtattttttatgaggttggaccatgaataatgagggagaaaatcatcttttatgaaatggagacctcatcattagtaatgcagggttggaagttgaaagtcacttgactggaaggagaggataaccaaactgagcattgttgtgtcatttcgttagtgaaaatcatttgtcctctttatccctgccaaacagggtttaagttaagggatcaagggttccatccaaaactttttcgtcctacaattatattgtaaaaataaaattaaaatttatactttgaattattttaatgaaaatttgaactatgctactttagtc

SEQ ID NO: 1828 - DNA, 1662 bp, Solanum lycopersicum
taaaaactaattctttacatattcagtttacttcaaaatctccattgatctaatcgcgtaaagagctatggcgatgctcgtagcatcccgtcgattatcaacgattattgtacgttattcgtcttcctccaggttttgctcaacgtctttcagggaggaaagagatactttcggtcccattctcgttcccgacgataagttatggggggcacaaacccaaagatccctgcaaaactttgaaattggaggtgagcgtgaaagaatgcctgaaccaatcatacgagcatttggcattcttaaaaagtgtgctgccaaggtgaacatggagtatggccttgacccatctatagggaaagcggtgatgcaagctgcccaggaagtagcagaaggaaaattgaatgaccattttcctttggtggtttggcagactggtagtggaactcaaagtaacatgaatgcaaatgaggttattgcaaatagagcatctgaaattcttggccataagcgtggcgaaaagcacgttcacccaaatgaccacgtgaacagatcacaatcttcaaatgacacatttcctactgtgatgcatattgctgctgctatggagataaataaaagactagtaccaaacttaaaacagttgcatacttcactacactcgaagtcagctgaattcaaggacattattaagattgggcgaacccacacacaagatgcaacacctttgactcttgcacaagaatttagtggctacgtcactcaagtaaaatatggtattaatcgagtcttgtgcactcttccacgcatgtatcagcttgcacaaggaggcacagcagttggaacaggattaaacacaaaaaaggggtttgatattaaaattgcagcagcagtggcggaggaaacaaatttaccttttgtaacagctgaaaataagtttgaagcattggctgctcacgatgcatttgttgaaaccagtggagccttaaatacggtagctgtttctcttatgaagattgggaatgatatacgtttcttaggaagtggcccacgctgtggtcttggcgaactcattcttcctgaaaatgaacctggaagcagtatcatgcctggtaaggtgaaccctactcagtgtgaggctcttacaatggtctgtgctcaggttatgggaaatcatgtagctgttacagttggtggatcaaatggtcattttgagctgaatgtgttcaagcctatgattgcaaatgctctccttcattcagtgagattgctaggggatgcatctgcttcttttgaaaagaattgtgtaagaggaattcaagccaatagagagaggattgcaaaattgttgcacgagtcgctcatgcttgtcacatgtttgaacccaaaaattggttatgacagtgcggcagcagttgccaagaaagcccacaaagagggaaccagtctaaaggaggctgcccttaatctgaatgtcctcacaggtgatgagttcgataaacttgtagttcctgagaaaatgattggtcctactgactgattagcgtcagtagttttagaaattggtgagatgaccaacaggattgagctattcattctttcctcaaaatcaaactagagaataaagattacatgaaattcttgaggttttcattctcctccccacca

SEQ ID NO: 1829 - DNA, 1919 bp, Solanum lycopersicum
gaaaggtgtgccgttacgaaatagcccatactatggccctatttgacaattgggattcgatttgttggtttcattcaacttcctaaatatcagctctgctgactgctgctacgctctctcttagactcagcaatcagcatcaacattcgcatacaggcggcggcgcattgactgctgagatatggcgatgttaaatgcggctcgtcgattatcagctggatcagctttatcagattcactgcgttatacttcttcttcctggaggtttttctctacgtctttcagggaggaaagagatacgtttggtcctattctcgttccatcggacaagttatggggggctcaaactcaaagatcattgcagaattttgaaatagggggtgatcgtgaaagaatgcctgagccaatcatacgtgcattcggtattattaaaaagtgtgcagccaaggtgaacatggactatggccttgaccaatctattggaaaagcaataatgcaagcagctgaagaggttgcagaaggaaaactaaatgaccattttcctttggtggtttggcagactggcagtggcactcaaagtaacatgaatgctaacgaggttattgcaaatcgagcagctgaaattcttggctataaccgcggagacaaacatgtgcatccaaatgaccatgtaaataaatcgcaatcttcaaatgatacatttccaacggtgatgcacattgctgcagctatggagctaaataaaagattagtaccaaacttgaaacagttgcatacttcactaaattcaaagtcagtcgaattcaaggacattatcaagattgggcgaacccacacacaagatgcaacacctttgactcttggacaagaatttagtggctatgcaactcaagtgaaatatggaatcgatagagtcttaggcacccttccacgcatgtatcagctcgcacaagggggcacagcagtaggcacaggattgaatacaaagaaagggtttgacataaaaattgctgcagcagttgcagaggaaacaaatttgccatttgttacagctgaaaacaagtttgaagcattggctgctcatgatgcatttgctgaaactagtggagccttaaataccgtggctgcttcccttatgaagattgggaatgatatacgcttcttgggaagtggtccccgctgcggtcttggcgagctcagtcttcctgaaaatgaacctggaagcagtataatgcctggcaaggtaaatcctactcagtgtgaggctctcaccatggtctgtgctcaggttatggggaatcatgtggctgttactgttggtgcatcaaatggccattttgagctgaatgtcttcaagccgatgattgctaatgctctcctacattcagtaagattgctaggcgatgcatctgcttcctttgaaaagaattgtgtgagggatatccaagctaacagagacagaattgctaaactgttgcacgagtcgctcatgctcgtcacatgcttgaacccaaaaattggttatgataatgctgctgcagttgccaagaaagcgcacaaggagggaaccagtttgaaggaagctgctctcaatctagcagtcctcaccagtgaagagtttgatcaactcgtagtccctgagaaaatgattggtccaactgactgatctgattcattagctcttcgaaatgagtaagaggaccatggctagcttcttctgtccatcaaattcgacgagggaaataaacatttgacacaattcttgaggttttctcattcctattaattagttttttgactgtgagaatgcctccatttttttgtaacgagtccctgagcaatatccaagtaaataatgaactgaattattttttatgagttgagccgtgaataacaaaggagaagatttatcttttgtg

SEQ ID NO: 1830 - DNA, 1746 bp, Taraxacum officinale
  misc_feature (1241)..(1241): n is a, c, g, or t
  misc_feature (1270)..(1271): n is a, c, g, or t
  misc_feature (1673)..(1673): n is a, c, g, or t
gcgggggctcaaccagcgtgcttgcttttctttcttttttccgccatctggggctacacttctgcaatcgattgcattctggttaaatataggaaaagaaaatggcgatggttcatgcatatcgtcgaggtggatcggtaattgtggcagattcattacgtttcacgacgagctggagacatttttcgacggggttcagagaggaaagagatacgtttggaccaattcaagtcccatctgataagttatggggagctcaaactcaaagatctttgcagaattttgaaatcggaggcgaccgtgaaagaatgccagaaccaatcatccgttcatttggaatccttaagaaatgcgctgccaaggtgaacatggaatatggtcttgatccatccatcggaaaagcaataatggaagctgcacaagaagtggcagaagggaagttaaacgatcacttcccattggttgtatggcagactggaagtggcactcaaagtaatatgaatgccaacgaggttattgcaaatagagcagctgaaattcttggccacaaacgtggtgataaatttgtgcatccaaatgaccatgtcaacagatcacagtcctcaaatgatacatttccaactgtgatgcatattgcagctgctacagaaatcaactcaagacttattccaaaacttaaacagctacacacctccctacaatcaaagacaaatgagttctcagatatagttaaaattgggcgtacccatactcaagatgcaactccattgactcttggtcaagaattcagtggctataccacacaagtgaagtatggaattgaacgggttttatgcactctacctcgcatgtaccagcttgcacaaggtgggacagctgtagggacaggattgaacacaaagaaagggtttgatgttaagattgctgcagcagtagctgatgaaacaagattaccatttgtaacagctgaaaataagtttgaagccctcgctgcacatgatgcttttgttgaggctagtggtgccttgaatacaattgctacttctcttatgaagattgctaatgacatacggtttttaggaagtggtccacgatgtggtcttggtgaacttattctgcctgaaaatgaacctggtagcagcatcatgcctgggaaagtaaaccctactcaatgtgaggcaatgactatggtttgtgctcaggcaattggaaaccatgttgcacttacagttggtggttcnaatgggcattttgagctcaatgttttcannccaatgatgccagcactcttttacattcataaggcttctgctgatgcatctgcttcatttgaaaagaactgtgtaagaggtattcaagccaacagggacagaatctcaaagctcttgcatgagtcacttatgcttgtgacatctctgaatccaaaaattgggtatgacaatgctgcagcagttgccaagactgcccacaaggaaggaagtacactgaaggaagctgctttgaaattgggagtgttgacaagtgaagagtttgatcaacttgtagtgccagaaaagatgattggtccatccgattgaaccaattatagacaataaaagatgaacaacatttcagaggttcctttgaggaaactatttttgaaaactaattttgttatacctaataatctctanttattccacagtttccacaacggaaaatttgagatttgattttacatgtaatataaaatgtatcttctttggg

SEQ ID NO: 1831 - DNA, 1614 bp, Prunus persica
  misc_feature (178)..(178): n is a, c, g, or t
gaggaaagaacacctttggacccattctcgttccctcagacaagttgtggggggcgcaaactcaaagatcgttgcagaatttcgatatcggtggcgagcgtgaacgaatgcccgaacctattgttcgcgcctttggcgtactcaaaaatgtgctgccaaggtgaacatggagtatggncttgatccaactataggcaaagcaataatgcaagctgcccaagaagtcgccgagggaaagctaaaccagcactttccacttgttgtatggcaaactggcagtggaacccaaagtaacatgaatgccaatgaggtcattgcgaacagagcagctgagatacttggccataagcgtggtgaaaagattgtccacccaaatgaccatgttaatagatcacagtcttctaatgacacttttccaactgtcatgcacattgcgtctgcagtggaaattaattcaagactaataccaaatttgagaacattgcatacttctctacattcaaagtcagatgaattcaaagatattgttaaaattggacgcactcacacgcaagatgcaacacctttgactcttgggcaagaattcagtggctattcaacacaagtgaagtatggaattgaccgagtcttgtgcactctaccccgcatgtatcagcttgcacagggtggtactgctgttgggactggattgaacacaaagaagggatttgatgtaaagatagctgcggcagtagctgaggaaacaaacttaccatttgtcaccgccgaaaacaagtttgaagctttggctgcacatgatgcttttgttgaaactagcggagccctaaatacagttgctacttctctgatgaaaattgcaaatgacatacgtttattaggaagtggtccacgttgcggccttggtgaactcattctccctgaaaacgagcctggcagcagcattatgcctggcaaggttaaccctactcagtgtgaggctctcacaatggtctgtgctcaggtttttggtaaccatgtggccattacagtaggtggatcaaatggtcactttgaacttaatgtattcaagccaatgattgctagtggtctcctacattctgtgagattgcttggggatgcatcagcttcctttgaaaagaactgtgtaagaggaatcaaagctaatagggaaagaatttcaaaattacttcatgagtcactaatgttggtcacatcgttgaatcctaaaattggttatgacaatgctgcttcagttgcaaagaaagcccacaaggagggatccactttgaaggaagctgcattgaaacttggagtgctaaccagtgaagaatttgatacacttgtggtgcctgagaagatgattggcccatctgactgactgaccgacaggtttagaagctgttgaaaattgatttcccggcatgaattgccttgatgattcgtctttgcattgtctcgccgggtgaaataaggattaaagtgatgtatgtaattctaacgtttacgaagatattgttgaggcttttgtaattgggttaattttgtttacaaaaacagccgccaactgggtcacagaggaagagaatgccctcacaaatttttgtaaacatgtca

SEQ ID NO: 1832 - DNA, 1726 bp, Manihot esculenta
attatggtttcaatggccttcagggaagaaaaagacacttttggacccattcaagttcccgctgataagttatggggcgcgcaaactcaaagatcactgcaaaatttcgaaatagggggagagcgtgagcagatgccggaaccgatcgttcgtgcttttggcattcttaagaagtgcgctgccaaggtgaacatggagtatggtctggatccatccatagggaaggctataatgcaggctgcccaagaggtagctgaaggcaagttaaatgatcattttccgcttgttatatggcagactggtagtggcactcagagtaacatgaatgccaatgaggttattgccaacagagcagctgagattcttggacataagcgaggtgaaaagtttgtacacccaaacgatcatgtcaacaaatcgcagtcttctaatgataccttcccaacagtgatgcacattgcagctgccacagaaataaattcaagattaataccaaatctgaaaaatttgcacagcacactgcattcaaagtctattgaattcaaagatattgtcaaaattgggcgcactcacactcaagatgcaacaccactgactctcggacaagagtttagtggctacgccttgcaagtgaagtatggacttgatcggatcacatgcactctaccgcgcatgtatcagcttgctcaaggtggaactgctgttggaactggattgaacacaaagaagggatttgatgccaaaatagctgctgcagtggctgaggaaacaaaactaccatttgtaacagcagaaaacaagtttgaagctttggctgcacatgatgcttttgttgaaagtagcggagcccttaacacgattgctacttctctaatgaagattgcaaatgacatgcgcttcttgggaagcggcccacgatgcggccttggtgaacttgtacttcctgaaaatgaaccaggcagcagtattatgcctggaaaggttaatcctacccagtgtgaggcactcactatggcctgtgctcaggtcatgggaaatcatgtggctattacagtgggtggatcaaatggccattttgagcttaatgtgtttaagcctatgattgctagcaatctcctacattcaacgagattgctcggagatgcatctgcttcctttgaaaagaactgcgtgaaaggcattcaagccaacaaggaaaggatttcaaaattacttcatgagtcgcttatgcttgtgactgccttgaatcctaaaattggctatgacaatgctgcagcagttgctaagctagctcacaaggaaggaactactctaaaggaagctgcattgaaacttggagtgctcaccagtgaagaatttgatgcccttgtggtgcctgaaaaaatgattggcccatctgactgataaacatacaaggagttcagttccatgcttctaagggattgttttcctgagtcttgagcttcacattttccaggttgttgcatttgtgggctttgcaactgttaaataacttgacagggaataatgataagcaggtgattgtatttgctacaatttaaaacatattcttagaggtttttctcctccaggtagcctagcttgtcagattagtaacagcagcttttgatgggttcaataatggaaagcctttctcgttttgtaagaaatgctcactttgagaaaataacattggcaatgaaaaagcgttaaattttttcatcaa

SEQ ID NO: 1833 - DNA, 1793 bp, Medicago truncatula
ggcgtcgcgtaccctgattggtgatttacccatcattttcactgttgcactaatcagactattccatttctctccatcaccaccatccaaactctttcaatggcgctctacgttctatcacgccgtttatcaaccaaatcaacctcaccaacactcttcacctttcgttacttctcatcaaccactaccttcagagaagaacgcgacacattcggacccattcaagttccctccgataaactatggggagcacagactcaacgatctttgcagaatttcgatatcggtggtccccgtgaacgtatgcctgaacctatcattcgctctttcggcatcttgaaaaaatgcgctgctaaggttaatatggagtatggtcttgatcctactattggaaaagcgattatgaaggccgcgcaagaagttgctgatggaaagcataatgatcattttcctcttgttgtttggcaaactggaagtggtactcaaagtaacatgaatgctaacgaggttattgcaaacagagcctcagagattcttggccataagcgcggtgagaagtttgtgcacccaaatgaccatgtcaatatgtcacaatcttctaatgatacatttccaactgtgatgcacattgccgctggaactgaaataaactcaagactaatccccagcttgaagacattacatgctacacttgacgcaaagtcgattgaatttaaagatatagtcaagattgggcgcactcatactcaagatgctacacctttgactctcggacaggagtttagtgggtatactacacaactgaagtatagtcttgatcgtgtgattaccattttgccgcgtatgtatcagcttgcccagggtggtaccgctgtagggactggattgaatacaaagaaggggtttgatgttaaggtgtcactagcagtagctacggaaacaaatctgccctttgtaacagcagaaaataagtttgaggctttggctgcccacgattcttttgttgaaactagtggagccctcaacacaatttcggcttctttaatgaagatagctaatgatatacggttattaggaagtggtccccgttgcggtcttggtgaactcattcttcctgaaaacgaaccgggaagcagtattatgcctgggaaggttaaccctacccagtgtgaggctttgactatggtctgtgcacaggtcatgggaaaccatgttgcaatcactgtgggaggatcaaatggtcattttgagctcaatgtattcaagccagtgattgccagtaatctcctgcaatcggtgagactgcttggagattcatgtgcttcctttgaaaagaattgtgtaagaggtattcaagctaatagagaaagaatttcaaagctattgcatgagtcactcatgctggtcacatccttgaacccgaaaattggttatgacaaggcagctgcagttgccaagaaagcccacaaagaggggtctacacttaaggaagctgcattaaagcttggagtgctgacttctgaagagtttgacagtcttgtggttcccgagaaaatgcttggcccaagtgattgattagcatatgatgatgtattgttttaataattattggctcctcatcagctacgttggattaatatttttgaagcgtacccattgaatgaattgggaaatagaaatccaaataaccaatgattttgactttcttagcagacattcttgaggaaaaagattctccaaatttgtaacgaggcaacaaataaaggaaaagttttgctcactgtctttgattt

SEQ ID NO: 1834 - DNA, 2124 bp, Picea glauca
ggaagaggttcgatgagattcaattgactattggcccagtggcgaaagaagattgggggcttgggcacagtagcagagagccccggaacatcgcttgggacacgaggtggtgtgatataatggcaatcatttcagcataccgacgccatctatctatatctactgcatcttcgttgatgcataacatatcatttacatacagcagatcactttcgaccgcttttagagaggagagggacacatttggtcccatcaatgtaccggcagacaaattatggggtgcgcagactcaacggtcactgcagaactttgaaattggtggagagcgtgagcagatgcctgaacaaattatacaatcatttggtgttctaaaaaaatgcgctgctaaggttaatatggattatggtctcgacccaaccattgggaaagcaataatgcaagctgctcaagaagttgctgaaggaaagctgaacagtcatttccctttggtcatttggcaaactggtagcgggactcaaagtaacatgaatgctaatgaggtgattgcaaatcgtgctgctgagattcttggaaggaaacgtggtgaaaaatgtgtacatccaaatgatcatgtcaatatgtctcaatcttctaatgatacatttcccactgttatgcacattgcggcagcagtggaaatgaactcaaaattcataccaagcttgcggcaacttcattctacattggaagctaagagcaatgaattcaaggatattgtgaaaattgggcgtactcatacccaagatgcaacaccgctaactcttggtcaagagtttagtggttatgctacccaggtgaaatatggcatagaacgtgttacaaacacattacctcatatataccagcttgcacaaggagggactgctgttggaactggtctcaatacaaaaaaagggtttgacattaaaattgctgcagctgttgctgaagaaacacagctaccatttcttacagctgagaacaagtttgaagctttggcagcacatgatgcttatgttgaaaccagtggagctgtgaacactgtttcagtttctctaatgaagatagcaaatgatatacgtttcctaggaagtgggcctcgctgtggactaggtgaattgctattacctgaaaatgaacctggcagcagcatcatgcctggaaaggtgaaccctactcaatgtgaggctttgacaatggtttgtgctcaggttatgggaaaccatgttgcaattacagtagggggctcgaatggtcattttgagcttaatgtttttaagccattgatcgcaagtgctctacttcggtctttgacattgctaggggatgctgcagcttcatttgaaaagaattgtgtaaggggaattcaggccaaccatcgcaggataggacaacttgtgcgagagtcactgatgcttgttacagctctgaaccctaaaattgggtatgacaaagcagccgcaactgcgaaaaaagcccataaagagggatcaaccctgaaggaagctgcactgcagcttggagttcttacgtctgaagagtttgatgaattggtcgtgccagagaagatgattggtccatcagattaagttttatatcttttatctgttttggcatttactgcgataaaatttgcttgtcaatgatgggaacatcataaataagaggcgtcagctatcaattttgatctgtcctgacagttttcctccattttcatgaaagctgttcaatcaagtttatgagggcaagtgtttatctttcgtttaatcaataaaaattactctttccatctttgagttcatttaatctacttgcagtctggagcatgtttcctttgtagtttatatatgtttttaaaaatattatatactccagataattatttaaaaatgccaacatgccaactgtaattgcgcgcgttcctaattcaaggagtttttggacctctaattacagatgcagttttgtaattataaaagcacgatagtcaatcgattttgacatctatgtttgggaagtttttgatagatacttgttctgggagaagcatttcttgtgatattcaaggtattccttatgtgatttgtggaaaccatatatttctca

SEQ ID NO: 1835 - DNA, 1518 bp, Antirrhinum majus
  misc_feature (860)..(860): n is a, c, g, or t
tgccatttttgtcgacataaaaaaggtttgttcaaagcttaaaggctgcgcactaatacatacaggtcaagctcggatcgatctttgattttttccggtaatggcgatagtcgcagctagccgtcgattgcgtgtatccaacagcacgacgtcgtatctgtcatcaagtttcaggtggtattccacttcctttagagaagaaagagatacttttggccccattcaagttccaaacgacaagttatggggtgctcaaactcaaagatcattgcagaactttgaaattgggggcgagcgtgaaagatgcccgagcctattgtacgggcatttggtgttcttaagaaatgtgctgcaaaggtaaacatggagtatggccttgatccatccattggtaaagcaattatgcaagcagcccaagaagtcgctgagggaaaattgaacgatcatttccctctcgtagtttggcaaacaggcagtggtactcaaagtaacatgaatgccaatgaggttattgcaaatagagctgccgaaattcttggccataaacgcggtggaaagttcgtgcatccaaatgaccatgtgaacagatcacaatcttctaatgacacatttccaactgtaatgcacattgcagctgccatggagataaattcaggattaataccaaaactgaagcagttacactatacactacactcaaagactgttgagttcaatgatattgtcaaaatcggtcgcactcacacacaagatgctactcctttaacacttggacaagaatttagcggctataccacccaagtgaaatacggaattgatcgagtctcgcgcactcttcctcaaatttatcagcttgcacnggggggcactgctgtaggaaccggtttgaacacgaagaaagggtttgatgtaaagattgctgcagctgtagctgaggaaactaaattgccatttgtgactgctgaaaacaaatttgaagcactggctgcacatgatgcatttgttgaaacaagtggtgccttgaacacaattgctgtttcactgatgaagatagcaaatgacatacggttcttgggaagtggtccacgttgtggtttaggtgaactcatacttcctgaaaatgaacctggcagcagtataatgccggggaaagtgaaccctacacagtgcgaggctctcacaatggtttgcgctcaggttatgggcaatcatgttgctgtttcagtgggtggttccaatggccattttgaactgaatgttttcaagccagtcattgccagtaatctactacattcattgagattgctcggggatgcgtctgcttcctttgaaaagaactgtgttagaggaatccaagccaacagagagagaatctctaaattattacatgagtccctcatgcttgtcacttctttaaatcccaaaattggatatgataatgcagccgccgttgcaaagacagctcacaaggagggatccaccttgaaggaagctgcgttgaaacttggcgtgctcagt

SEQ ID NO: 1836 - DNA, 1795 bp, Artemisia annua
aggaagaagaatggcgatggttggagtatatcgtcgtggatcgggcgtttcgttacgctttacgatgagatattgttctactacgggagggtttagagaagaacgtgatacttttggacctattcaagtccctaatgacaagttatggggagctcaaactcaaagatctttacagaatttcgaaattggaggtgaccgtgaaagaatgccagaaccaatcattcggtcttttggaatcctcaagaagtgtgctgctaaggtgaacatagaatatggtcttgatccatccatagggaaagcaataatggaagctgcacaagaagtggctgacgggaagttaaatgatcactttccattggttatatggcagactggcagtggcactcaaagcaacatgaatgccaacgaggtcattgcaaatagagcagctgaaattcttggccataagcgtggtggtaagttggtgcatccaaatgaccatgtcaacagatcacagtcttcaaatgatacgttcccaactgtaatgcatattgcagctgcaacagaaatcaactcaagacttatcccaaagcttaagcagttacacactaccctacaagcaaagacatctgagttctctgatattgttaaaatcgggcgtactcacactcaagatgcaacaccccttactcttggtcaagagttcagtggctataccacacaagtgaaatatggaattgatcgggtcttatgcactctccctcgcatgtatcagcttgcgcaaggtggcactgctgtagggacaggattgaacacaaagaaagggtttgatgcaaagattgctgcagcagtagctgatgaaacaaggttaccatttgtaacagctgaaaacaagtttgaggcgctggctgcacatgatgcctttgttgaaactagtggagctttgaacacaattgctgtttctcttatgaaaatcgctaatgacattcgcttcctaggaagtggtccacgttgcggttttggagaacttatccttcctgagaatgaacctggtagcagcattatgcctgggaaagtgaatccaacacagtgtgaggctctgaccatggtctgtgctcagacaattggaaaccatgtgggcctcacagtgggtggttcaaatggtcattttgagctcaacgttttcaagccaatgattgctagctcccttttacattcaataagactaattgccgacgcgtcagcttcttttgaaaagaactgtgtgagaggcattcaagctaatagagacaggattaataagttactatacgagtcacttatgcttgtgacatctttaaatcctaaaatcggatatgacaatgctgcagcggttgccaagactgctcataagcagggatgtactctcaaggaagctgctctacaattgggagtgctgactagtgaagaatttgatcaacttgtagtaccagaaaagatgattggtccctctgactaaagcaactggttaaggatatggttgcatgttttatgaagctgaaagccattttactgtaagttgagataggaaataaaacatcagtgcgctgtcatatttcagaggttcattgaagtactctattcttcagagtgaaacactctttcgtcgaatttgtaagaaaacgtgttgagggaactagattttaccaacaaattttttgccagaggacaatttctttgctttgttgcataattcaaatgagctacaaattacatgaatggtgtgtaattgttcaaacagttctcccagtatttaagcaagtgaaatcttgaagcc

SEQ ID NO: 1837 - DNA, 1587 bp, Brassica rapa
  misc_feature (289)..(289): n is a, c, g, or t
  misc_feature (364)..(364): n is a, c, g, or t
  misc_feature (370)..(370): n is a, c, g, or t
  misc_feature (439)..(439): n is a, c, g, or t
  misc_feature (442)..(442): n is a, c, g, or t
  misc_feature (463)..(463): n is a, c, g, or t
  misc_feature (487)..(487): n is a, c, g, or t
  misc_feature (499)..(499): n is a, c, g, or t
  misc_feature (515)..(515): n is a, c, g, or t
  misc_feature (530)..(530): n is a, c, g, or t
  misc_feature (539)..(539): n is a, c, g, or t
  misc_feature (554)..(554): n is a, c, g, or t
  misc_feature (559)..(559): n is a, c, g, or t
  misc_feature (637)..(637): n is a, c, g, or t
  misc_feature (646)..(646): n is a, c, g, or t
  misc_feature (658)..(658): n is a, c, g, or t
  misc_feature (665)..(665): n is a, c, g, or t
  misc_feature (667)..(667): n is a, c, g, or t
cagcggaacagcgctgcggcgtgctatgagatcttattcaacgtttagggaggagagagacaccttcggcccgatccaagttccttccgataagttgtggggagcccagacgcagagatcgctgcagaacttcgagatcggcggcgagcgcgagcgaatgcccgagccaatcgtccgcgcttttggcgtcttgaagaagtgcgctgccaaggttaacatggagtatggacttgatccaacgattgggaaagcgattatgcaagctgctcaggaagttgctgagggcaanctcaatgatcatttcccccttgttgtttggcaaactggtagtggcactcagagtaacatgaatgctaatgaggtnattgcnaacagagcagctgagattcttggtggtgataaatgtgtccaccctaatgaccatgtcaaccgatctcantcntctaacgacactttccctacngtcatgcacattgcagctgcaacngagattaattcnaggctcatccctagtntgaaaactttgcatnccactctcnactctaagtccttcnagttnaaagatattgtgaaaattggaagaactcacactcaagatgctactcctttgacgctaggacaagaatttggtggctangctactcangttaagtatggncttaatngngtcacatgcactctaccccgcctctatcagcttgcacaaggtggaactgcggtcgggacaggattaaacaccaagaaagggtttgatgtaaagatagctgctgcagtagccgaagaaacaaacctgccgtttgtcactgcagaaaacaagtttgaagctctggctgcacatgatgcttgtgttgaaaccagtgggtcactcaacacaatcgccacatcgttgatgaagattgccaatgatatacgttttcttggaagtggtccaagatgtggtcttggtgaacttgttctgcctgaaaatgagccaggaagcagcatcatgcctgggaaggtaaatcctacacagtgtgaggccttgactatggtttgtgctcaggtaatgggcaaccatgtagctgtgacagttggtgggtcaaatggtcatttcgaactgaatgtatttaagccggtgattgcaagcgctctcttgcattccgtgaggttaatagcagatgcttcagcttcgtttgagaaaaactgtgtaaggggtattgaggccaacagagaaaggatctcaaagctattgcacgagtctcttatgcttgtgacatcattgaatccgaaaatcggatatgacaatgctgcagcagttgccaagaaagctcacaaagaaggatcgacactgaaggaagcggctctgaagttaggtgttcttacttctgaagagtttgatacccttgttgttcccgagaagatgatcggtccctccgattgatgttgagccaaaagcttcattttgccatgttttattcttgataaagaggttgtaatgacaaataagcaaatccccagactcaaattttgcatttggaaggattcaattctttatgtatcacacagttacttttatgttgaataaaagagcaactattcatgtttaga

SEQ ID NO: 1838 - DNA, 1913 bp, Pinus taeda
ggcccagtggcgaaagaagattaggcacctgggcacaatcgaagggagctccggaacattgtttgggacactaggtggtgtgatataatggcattcatttcagcatatcgacgccatctatctatatctactgcatcttccttgatgcatggcatatcatttacatacagcagatcactttggacagcttttagagaggagagggacacatttggtcccatcaatgtaccggcagacaaattatggggtgcacagactcaacggtcactgcaaaactttgaaattggtggagagcgtgagcagatgcctgaacaaattatacaatcatttggtgttctaaaaaaatgcgccgctaaggttaatatggagtatggtcttgacccaaccattgggaaagcgataatgcaagctgctcaagaagttgctgaaggaaagctgaacagtcatttcccattggtcatttggcaaactggtagtgggactcaaagtaacatgaacgctaacgaggtgattgcaaatcgtgctgctgaaattcttggaaagaaacgtggtgaaaaatgtgtacatccaaatgaccatgtcaatatgtctcaatcttctaatgatacatttcctactgttatgcacattgctgcagcagtggaaatgaactcaaaattcataccaagcttgcggcagcttctttctacattggaagctaagagcaatgaatttaaggatatagtgaaaattggacgtacacatacccaagatgcaacaccgctaactcttggtcaagagtttagtggttatgctacccaggtgaaatacggcatagaacgtgttacaaattcattacctcgtatataccagcttgcacaaggagggactgcagttggaactggtctcaatactaaaaaagggtttgacattaaaattgctgcagctgttgctgaagaaacacagctaccatttattacagctgagaacaagtttgaagctttggcagcacatgatgcttttgttgaaaccagtggagctgcgaacactgtttcagtttctctaatgaagatagcaaatgatatacgtttcctaggaagtgggcctcgctgtggactaggtgaactgctattacctgaaaatgaacctggcagcagcatcatgcctggaaaggtgaaccctactcaatgtgaggctttgacaatggtttgtgctcaggttatgggaaaccatgttgcaattacagtagggggatcaaatggtcattttgagcttaatgtttttaagccattgatcgcaagtgctctacttcggtctttgacattgctaggagatgctgcagcttcatttgaaaagaattgtgtaaggggaattcaggccaaccatcgaagaataggacagcttgtccgagagtcactgatgcttgttacagctctgaatcctaaaattgggtatgacaaagcagcagcaactgcaaaaaaagcccataaagagggatcaaccctaaaggaagctgcactgcagcttggagttcttacgtctgaagagtttgatgaattggtcgtgccggagaagatgattggaccatcagattaagttttatatattttatttcttttggcatttactgccataaaatttgattgtcaatgatgtgaacatcataaataaataagaggcatcaactgtcaattttgatctgtcccgacagtgttcctccattttcatgaaagctgttcgatcaagtttacgagtgtaagtgttcagctttcagttattcaataaaacttgctctttccatccgttgagttcatttaatttgcttgtagtgtggagcatgtttcctatgtagcttatatgcgttttttaaatattatacttcagataattatttaataatgtcaacacgccaactataattgcgcattactaat

SEQ ID NO: 1839 - DNA, 1900 bp, Arabidopsis thaliana
attagacaaagacattttagaactccgaaaatgtcaataaaatggatgatgattatgagaaaaacttacacgtttaataggcccgaagttgctatctagcagttgtagccatggccgctttgacaatgcagtttgaaggagagaagaaaaacgtatccgaagttgcagacgtaaccctcaagcaagaagatgaacaacaagaacgtagatcttattcgacgccgtttagggaagagagagacacctttggcccgatccaagttccttccgataaattatggggagcacagacgcagagatcgcttcagaacttcgagattggtggtgaccgcgagcgaatgcccgaaccaatcgtccgagcttttggtgtcttgaagaaatgtgctgccaaggttaacatggagtatggtcttgatccaatgattggggaagccataatggaagctgcacaagaagtagcagaaggaaagctcaatgatcatttccctcttgttgtatggcaaactggtagtgggacgcagagtaatatgaatgctaatgaggtcattgccaatagagcagctgagattcttggtcacaaacgtggtgaaaaaattgtgcacccaaatgaccatgtgaacagatcacaatcttctaatgacacttttccaactgtcatgcacattgcagctgcaaccgagattacttcgaggctaatccctagtttgaaaaatttgcatagctctttggaatctaagtccttcgagtttaaagatatagtgaaaatcggaagaactcatactcaagatgctacacctttgacattaggacaagaatttggtggctatgctactcaagttgagtatggacttaatagagtcgcatgtactctaccccgcatctatcagcttgcacaaggtggaactgctgttgggaccggattaaacactaagaaagggtttgatgtaaagatcgctgctgcagtagctgaagaaacaaacttgccattcgtcaccgcagaaaacaagtttgaagctctggctgcacacgatgcttgtgttgaaacaagtggatctcttaacacaatcgccacatcattgatgaagattgccaatgatatacgttttcttggaagtggtccaagatgtggtcttggtgaactttctctgcctgagaatgaaccaggaagcagtattatgcctggaaaggtaaatcctacacagtgtgaggccttgactatggtttgtgctcaagttatgggaaaccatgtagccgtgacaattggtgggtcgaatggtcattttgaattgaatgtattcaagccggttatcgcaagcgctctcttacattccattagactaatagcagatgcttcagcttcatttgagaaaaactgtgttagaggcattgaggccaacagagaaaggatctcaaagctattgcacgagtctcttatgcttgtgacatcattgaatcctaaaattggctatgacaatgctgcagcagtagccaaaagagctcacaaagaaggatgcacattaaagcacgcagctatgaagttaggtgttcttacttcggaagagtttgatactcttgttgttcccgagaagatgattggtccatctgattaagtactttataatggagccaaaagcttcaaatacaaagtggatgtttgggggcttttgcatcaagttgtgtttattcttttgtaataaattgctgcatgcatgtatgcttgtgttcaaaattttggatttgttttagagtcatgtgattatagtattctaagtaatttatcataaagtttgtcatatatacttaagtttaataaaaaataaatgtgtgtgaaaatgtcacatattggtgtttttgttataaaatgtcaaatattctaagtacatgtcaaatacttaagtca

SEQ ID NO: 1840 - DNA, 1887 bp, Arabidopsis thaliana
attttagaactccgaaaatgtcaataaaatggatgatgattatgagaaaaacttacacgtttaataggcccgaagttgctatctagcagttgtagccatggccgctttgacaatgcagtttgaaggagagaagaaaaacgtatccgaagttgcagacgtaaccctcaagcaagaagatgaacaacaagaacgtagatcttattcgacgccgtttagggaagagagagacacctttggcccgatccaagttccttccgataaattatggggagcacagacgcagagatcgcttcagaacttcgagattggtggtgaccgcgagcgaatgcccgaaccaatcgtccgagcttttggtgtcttgaagaaatgtgctgccaaggttaacatggagtatggtcttgatccaatgattggggaagccataatggaagctgcacaagaagtagcagaaggaaagctcaatgatcatttccctcttgttgtatggcaaactggtagtgggacgcagagtaatatgaatgctaatgaggtcattgccaatagagcagctgagattcttggtcacaaacgtggtgaaaaaattgtgcacccaaatgaccatgtgaacagatcacaatcttctaatgacacttttccaactgtcatgcacattgcagctgcaaccgagattacttcgaggctaatccctagtttgaaaaatttgcatagctctttggaatctaagtccttcgagtttaaagatatagtgaaaatcggaagaactcatactcaagatgctacacctttgacattaggacaagaatttggtggctatgctactcaagttgagtatggacttaatagagtcgcatgtactctaccccgcatctatcagcttgcacaaggtggaactgctgttgggaccggattaaacactaagaaagggtttgatgtaaagatcgctgctgcagtagctgaagaaacaaacttgccattcgtcaccgcagaaaacaagtttgaagctctggctgcacacgatgcttgtgttgaaacaagtggatctcttaacacaatcgccacatcattgatgaagattgccaatgatatacgttttcttggaagtggtccaagatgtggtcttggtgaactttctctgcctgagaatgaaccaggaagcagtattatgcctggaaaggtaaatcctacacagtgtgaggccttgactatggtttgtgctcaagttatgggaaaccatgtagccgtgacaattggtgggtcgaatggtcattttgaattgaatgtattcaagccggttatcgcaagcgctctcttacattccattagactaatagcagatgcttcagcttcatttgagaaaaactgtgttagaggcattgaggccaacagagaaaggatctcaaagctattgcacgagtctcttatgcttgtgacatcattgaatcctaaaattggctatgacaatgctgcagcagtagccaaaagagctcacaaagaaggatgcacattaaagcacgcagctatgaagttaggtgttcttacttcggaagagtttgatactcttgttgttcccgagaagatgattggtccatctgattaagtactttataatggagccaaaagcttcaaatacaaagtggatgtttgggggcttttgcatcaagttgtgtttattcttttgtaataaattgctgcatgcatgtatgcttgtgttcaaaattttggatttgttttagagtcatgtgattatagtattctaagtaatttatcataaagtttgtcatatatacttaagtttaataaaaaataaatgtgtgtgaaaatgtcacatattggtgtttttgttataaaatgtcaaatattctaagtacatgtcaaatacttaagtca

SEQ ID NO: 1841 - DNA, 1810 bp, Pinus taeda
aattcggcacgagggattcaacaaactcttgttggcctagtggcgaaagaagattaggcacctgggcacaatcgaagggagctccggaacattgtttgggacactaggtggtgtgatataatggcattcatttcagcatatcgacgccatctatctatatctactgcatcttccttgatgcatggcatatcatttacatacagcagatcactttggacagcttttagagaggagagggacacatttggtcccatcaatgtaccggcagacaaattatggggtgcacagactcaacggtcactgcaaaactttgaaattggtggagagcgtgagcagatgcctgaacaaattatacaatcatttggtgttctaaaaaaatgcgccgctaaggttaatatggagtatggtcttgacccaaccattgggaaagcgataatgcaagctgctcaagaagttgctgaaggaaagctgaacagtcatttcccattggtcatttggcaaactggtagtgggactcaaagtaacatgaacgctaacgaggtgattgcaaatcgtgctgctgaaattcttggaaagaaacgtggtgaaaaatgtgtacatccaaatgaccatgtcaatatgtctcaatcttctaatgatacatttcctactgttatgcacattgctgcagcagtggaaatgaactcaaaattcataccaagcttgcggcagcttctttctacattggaagctaagagcaatgaatttaaggatatagtgaaaattggacgtacacatacccaagatgcaacaccgctaactcttggtcaagagtttagtggttatgctacccaggtgaaatacggcatagaacgtgttacaaattcattacctcgtatataccagcttgcacaaggagggactgcagttggaactggtctcaatactaaaaaagggtttgacattaaaattgctgcagctgttgctgaagaaacacagctaccatttattacagctgagaacaagtttgaagctttggcagcacatgatgcttttgttgaaaccagtggagctgcgaacactgtttcagtttctctaatgaagatagcaaatgatatacgtttcctaggaagtgggcctcgctgtggactaggtgaactgctattacctgaaaatgaacctggcagcagcatcatgcctggaaaggtgaaccctactcaatgtgaggctttgacaatggtttgtgctcaggttatgggaaaccatgttgcaattacagtagggggatcaaatggtcattttgagcttaatgtttttaagccattgatcgcaagtgctctacttcggtctttgacattgctaggagatgctgcagcttcatttgaaaagaattgtgtaaggggaattcaggccaaccatcgaagaataggacagcttgtccgagagtcactgatgcttgttacagctctgaatcctaaaattgggtatgacaaagcagcagcaactgcaaaaaaagcccataaagagggatcaaccctaaaggaagctgcactgcagcttggagttcttacgtctgaagagtttgatgaattggtcgtgccggagaagatgattggaccatcagattaagttttatatattttatttcttttggcatttactgccataaaatttgattgtcaatgatgtgaacatcataaataaataagaggcatcaactgtcaattttgatctgtcccgacagtgttcctccattttcatgaaagctgttcgatcaagtttacgagtgtaagtgttcagctttcagttattcaataaaacttgctctttc

SEQ ID NO: 1842 - DNA, 1712 bp, Pseudotsuga menziesii
gggaactcaggcacaacagcagagagatccccggaacatttgcttggacacaagttagtgtgatataatggcaatcatttcagcatatcgacgccatctatctatatctactgcatcttcattgatgcaccgcatatcatttacatacagcagatcactttggacagcttttagggaggagagggacacatttggtcccatcaatgtaccggcagacaagttatggggtgcacagactcaacggtcactgcagaactttgaaattggtggagagcgtgagcagatgcctgaacagattatacaatcatttggtgttctaaaaaaatgtgctgccaaggttaatatggattatggtcttgacccaaccattgggaaagcaataatgcaagctgctcaagaagttgctgaaggaaagctgaacagtcatttccctttggtcatttggcaaactggtagcgggactcaaagtaacatgaatgctaatgaggtgattgcaaatcgtgctgccgagattcttggaaggaaacgtggtgaaaaatgtgtacatccaaatgaccatgtcaatatgtctcaatcttctaatgatacatttcccactgttatgcacattgccgcagcagtggaaatgaactcaaaattcataccaagcttgcggcaacttcattctgcattggaagctaagagcaatgaattcaaggatattgtgaaaattgggcgtacacatacccaagatgcaacaccactaactcttggtcaagagtttagtggttatgctacccaggtgaaatatggaatagaacgtgttacaaacacattacctcatatataccagcttgcacaaggagggactgcagttggaactggtctcaatacaaaaagagggtttgacattaaaattgcagcagctgttgctgaagaaacacagctaccatttcttacagctgagaacaagtttgaagctttggcagcacatgatgcttttgttgaaaccagtggagctgtgaacaccgtttcagtttctctaatgaagatagcaaatgatatacgctttctaggaagcgggcctcgctgtggactgggtgaactgctattacctgaaaacgaacctggcagcagcatcatgcctggaaaggtgaaccctactcaatgtgaggctttgacaatggtttgtgctcaggttatgggaaaccatgttgcaattacaatagggggctcgaatggtcattttgagcttaacgtttttaaaccattgatcgcaagtgctctacttcggtctttgacattgctaggggatgctgcagcttcatttgaaaagaattgtgtcaggggaattcaggccaaccatcgcagaataggacaacttgtgcaagagtcattgatgcttgttacagctctgaaccctaaaattgggtatgacaaagcagcagcaactgcaaaaaaagcccataaagagggaacaaccctaaaggaagctgcactacagcttggagttcttacgtctgaagagtttgatgaattggttgtgccagggaagatgattggaccatcagattgagttttatatcttctatctgtttagcatttattgccataaagtttaaatatcagtgatgagaacattattattaaaaagaggcgtcagctgtcaattttgatctgtcctgacagtcttcctccattgtcacgaaagttgttcaattaagtttatgagg

SEQ ID NO: 1843 - DNA, 1542 bp, Ricinus communis
ggaaatagcgctgctctacttagtcccagctagttttacttctctctctgtagcaacctcgactcgcgcgatcctccaaatcttcatcgtttcggctcaagttcgatatcgattagttgaattcaagtaaagaaaatggcgatggggactatagctcggcgaatctctcgtgaatcgacgacaacgcgtgcggtaggatcattgcgttatgctagctggagattgtattctactgccttcagagaagaaagggatacttttgggcctattcaagtacctaatgacaagttatggggtgcacaaacgcagagatcacttcaaaactttgaaattggcggtgagcgtgagcggatgccggagccgattattcgtgcttttggcattcttaagaaatgcgctgctaaggtgaatatggagtatggccttgatccatctatagggaaggctataatgcaagctgctcaagaggtagctgaagggaaactaaatgatcattttcctcttgtcgtttggcagactggcagtggcactcagagtaacatgaacgccaatgaggtcattgccaatagagcagctgagattcttggccataagcgtggtgaaaagtatgtacacccaaatgatcatgtgaacagatcacagtcttctaatgataccttcccaactgtaatgcacattgcggctgcaacagaaataaataaaagattgattcccaacttaagaaacttgcagacaacattacatgctaagtctgtagaattcaaagatattgtcaaaattggacgtacacatactcaggacgcaacacctttgaccctcgggcaagagtttagtggctacactacacaagtgaagtatggaattgataggatcatggttactctaccccgcatgtatcagcttgcacaaggtggaactgctgttggaactggattgaacacaaagaaggggtttgatgtcaaaatagctgcagcagtggctgaggaaacaaatttaccatttgtcacagcagaaaacaagtttgaagccttggctgcgcatgatgcttttgttgaaagtagtggagcccttaacacaattgctacctctctgatgaagattgcaaatgatgtacggttattaggaagtggtccacgatgcggtcttggtgaactcatacttcctgaaaatgagccaggcagcagtattatgccaggaaaggttaatcctacccagtgtgaggcacttaccatggtgtgtgctcaggttatgggaaatcatgttgctgttacagtgggtggatcaaatggccattttgaactaaatgtattcaagcctatgattgctagcaatctcctacattcagtaagattgcttggagatgcatctgcttcctttgagaagaactgcgtgaggggaattcaagctaatagggaaagaatttccaaattacttcatgagtcgctaatgcttgtcacatccttaaatcctaaaattggttatgacaatgctgcagcagttgccaagcttgctcacaaggaaggaagtactctaaaggtcata

SEQ ID NO: 1844 - DNA, 1849 bp, Arabidopsis lyrata
attatagatctaagaaaatgtcaatataatggatgatgattatgagaaaaacttacacgtttaagaggcccgaagttgctatctaacagttgtagccatggccgctttgataatgcagtttgaaggagagaagaaaaacttatccgaagttgcagacgtaaccctcaagcaagatcaagatgaacaacaacgtcgatcttattcgacgtcgtttagggaagagagggacactttcgggccgattcaagttccttccgataaattatggggagcacagacgcagagatcgcttcagaacttcaagattggtggtgaccgcgagcgaatgcccgaaccaatcgtccgagcttttggtgtcttgaagaaatgtgctgccaaggttaacatggagtatggtcttgatccaatgattggggaagctataatggaagctgcacaagaagtagcagaaggaaagctcaatgatcattttcctcttgttgtatggcaaactggtagtggcactcagagtaatatgaatgctaatgaggttattgctaatagagcagctgagattcttggtcacaaacgtggggaaaaaattgtgcacccaaatgaccatgtgaatagatcacaatcttctaatgacacttttccgactgtcatgcacattgcagttgcaaccgagattacttcaaggctgatccctagtttgaaaaatttgcatagctctttggagtctaagtccttcgagttcaaagacattgtgaaaattggaagaactcacactcaagatgctacacctttgacgctaggacaagaatttggcggctatgctactcaagttaagtatggacttagtagagtcgcatgtactctacctcgcatctatcagcttgcacaaggtggaaccgctgttgggaccggattaaacactaagaaagggtttgatgtaaagatagctgctgcagtagccgaagaaacaaacttgccattcgtcactgcagaaaacaagtttgaagctttggctgcacacgatgcttgtgttgaaacaagtggatctcttaatacaatcgccacatcgttgatgaaaatcgctaatgatatacgttttcttggaagtggtccaagatgcggtcttggtgaactttctctgcctgaaaatgaaccaggaagcagtatcatgcctggaaaggtaaatcctacacagtgtgaggcattgactatggtttgtgctcaagctatgggaaaccatgtagctgtgacaattggtgggtcaaatggtcattttgaattgaatgtattcaaaccggttatcgcaagcgctctgttacattccattagattaatagcagatgcttcagcttcatttgacaaaaactgtgtgagaggcagtgaggctaacagagagaggatctcaaagctattgcatgagtctcttatgcttgtgacatcattgaatcctaaaatcggctatgacaatgctgcagcagttgccaagaaagctcacaaagaaggatgcacattaaagcacgcagctatgaagttaggtgttcttacttcggaagagtttgatactcttgttgttcctgagaagatgattggtccctctgattaaattataatggagccaaaagcttcaaatacaaagtggatgtgtggtttttttttttggatcaagttgtgtttactcttttgtaataaaatgctgcatatgtatgcttgtgttcaaatttttggatatgttttagagtcatgtggttatagtattctaagtaatttatcaaaaagtttgtaatatatacttaagttcaatgaaataaatttgtatgtgaaaatgtttaatattgttgttgtgttacaaaagtca

SEQ ID NO: 1845 - DNA, 1456 bp, Brassica napus
ctccaccatctcgtctcccaaggcagaagaagaaccccatggcgatttacgtcgcatcacggcggctttccgccagaacaaccgcggcggcgctgcgttacgccactgctctgagatcttattcgacctcgttcagggaggagagggacaccttcggcccgatccaagttccttccgataagttgtggggagcccagacgcagagatcgctgcagaacttcgagatcggcggcgagcgcgagcgaatgcccgagccaatcgtccgcgcttttggcgtcttgaagaagtgcgctgccaaggttaacatggagtatggacttgatccaactattgggaaagcgattatggaagctgctcaggaagttgctgagggcaaactcaatgatcatttcccccttgttgtttggcaaactggtagtggcactcagagtaacatgaatgctaatgaggtcattgctaacagagcagctgagattcttggtcgcaaacgtggtgaaaaatgtgtccaccctaatgaccatgtcaacagatctcagtcttctaacgacactttccctaccgtcatgcacattgcagctgcaaccgagattaattcaaggctcatccctagtctgaaaactttgcataccactctcgactctaagtccttcgagtttaaagatattgtgaaaattggaagaactcacactcaagatgctactcctttgactctaggacaagaatttggtggctatgctactcaggttaagtatggacttaatcgagtcacatgcactctaccccgcctctatcagcttgcacaaggtggaactgcggttgggacaggattaaacaccaagaaagggtttgatgtaaagatagctgctgcagtagccgaagaaacaaacctgccgtttgtcactgcagaaaacaagtttgaagctctggctgcacatgatgcttgtgttgaaaccagtgggtcacttaacacaatcgccacatcgttgatgaagattgccaatgatatacgttttcttggaagtggtccaagatgtggtcttggtgaacttgttctgcctgaaaatgagccaggaagcagcatcatgcctgggaaggtaaatcctacacagtgtgaggccttgactatggtttgtgctcaggtaatgggcaaccatgtagctgtgacagttggtgggtcaaatggtcatttcgaactgaatgtatttaagccggtgattgcaagcgctctcttgcattccgtgaggttaatagcagatgcttcagcttcgtttgagaaaaactgtgtaaggggtattgaggccaacagagaaaggatctcaaagcttttgcacgagtctcttatgcttgtgacatcattgaatccgaaaatcggatatgacaatgctgcagcagttgccaagaaagctcacaaagaaggatcgacactgaaggaagcggctctgaagttaggtgttct

SEQ ID NO: 1846 - DNA, 1617 bp, Cucumis sativus
tattttgttcgtccaaataaatcgccgtattctttcacgacacctaccaccgtctgacgtcacctgccatttctccggcgtcttatctccgtccattcctccgttcgaggattccactttccccaatctccattcttatttgttactcttctctcctcctctttccggatcactctctcattcttccccaaactcatattagcttttacctctaaaaaatggcggccgtctatgttttgtcccggcgatcttccgcttcacacctctttgggatggctcgttatgctactacgtcactgagatcttactccacgtcttttcgcgaggaaagggatacttttggacctatcaacgttccctccgatagattatggggagctcaaacgcagagatcgttgcagaattttgagatcggaggcgaccgggagcgaatgccagaacctataattcgtgcctttggcgttcttaaaaagtgtgctgccaaggtaaacatggactacggtcttgatccaacaattgggaaagccataatgcaagcagctcaagaagtagcggagggaaagttgaatgatcattttccacttgttgtatggcaaactggaagtggtactcagagtaacatgaatgcgaatgaggttattgctaacagagcatctgagattcttggccacaaacgtggtgataagtttgttcacccaaatgaccatgttaaccggtcccagtcttctaatgatacattcccaactgtaatgcacatagcagctgcaacagaaattaattccaaattcataccaaaattgaaaactttgcattcatcactatactcaaagtctatagaattcaaagatatcgtgaaaattggacgcactcatactcaagatgccacacctctaactcttggacaagagttcagtggctataccacacaagtgaagtatggtattgatagagtcttgtgtactctacctcgaatgtatcagcttgcccaaggtggaacggctgttggaactggattgaacacaaagaaaggatttgatgtgaaaatagcggcagcagtagctgaagaaacaaatttgccatttgtgacagcagaaaacaagttcgaagccttggctgcacatgatgccttcgttgaaactagtggatctcttaacacagttgctgcttctttgatgaagattgccaatgacatacgcctgttgggaagtggtccacgttgtggtcttggtgaacttattcttcccgaaaacgaaccaggcagtagtattatgccaggtaaggtgaaccctactcaatgtgaggctctcactatggtctgcgctcaggttatgggaaaccatgtggcaataactgttggtgggtcaaatggtcactttgaacttaatgtatataaaccaatgatagccaatgctcttttgcattcattgagattattaggggatgcttctgcttcatttgagaagaactgtgtgaggggaattcaagctaacagggaaagaatttcgaaattactccatgagtctctgatgctcgtcacagctttaaaccctaaaattggttacgacaacgctgctgcagttgcaaagaaagctcacaaggaagggagtactttgaagg

SEQ ID NO: 1847 - DNA, 1732 bp, Saccharum officinarum
gccgagcccccattcctgccacaaatcgccactaaaaccctagccttccgccatggccacctccccagccgcctcgtcctcctccgctccgaccgcctccgccgccgctgcggccacgatggctgccgaggccaccgacgggccggtgctcagcgtagtatcgaagcgtctccgcgcgctgcggaagaagtacaaccgcatcacgcagatggaggagtcgctcgccgccggcaagacgctcaaccgagagcaggaggaggttctccgctccaagcccgtcgtcgccgctctgatcgacgagctcgagcgcctccgccccccgctcgcatccgccatcgcggaggagttctcctcccgccccgcccccgcccctgcccccggcgccgcttcctcctccgactcagattcgtcagtccaggacctcctcgcgctcatctacttcggctccctcttcgacgtcaagcagcaaagcgacttcgtctctttagtttacgcgagcgagctcgagcggagcaactgcctcacttatgactacgtcggggatgatccggaggacagtctcgcggagaccgatctgaacgcggtttctgcccttgcctccctcgccgcgtcgcgccctccagctgcagccggagtctcgcaccgtgacgcccttcaggcttgtgcccatcacgcccgcctctggctccgccgtgcggatgaacccatccaccctgactccaccatcacatatgctggggtgagggcaaagctggataggatcatggcatcgggctactacacagctcagctagaaatgaggccaccattggatctggctgctgcagtggcaagctttggagctggaggtgtgcaggtgcaggagagtatggttgtgtcacctcaggcaccggaagcagttgaggagaacctggctgttgaagggcacaaggatgagaaggaagattctcaggcaactgaaatctacagtgatcatcaggctcctcctgttgttgacgctgaacacgtggaggatgaaggcctggtgaatccaactgatgaagttccttcagctgaggcagagcaggagacatttgatgctgatgtggaggatcaggaacaaaaagaccaacaattcacccagcggcggtcttaccagaaccagcgtggtggtggtggtggtcgtggtggcggcaggaggggctatcctaatggccgtggaggacgtggtggccgtggcggaggcggtgggtactactatgaatctggatactaccagccgaggaactacaacaacagaggccggggtggtcgctcgggcggtggcaactcttactacaacaaccatggtggaggtgcacacggaggcggccatggacattcttgggaggttgagctgggcgcaaacgcctagctcgctgactattttgttttgaggatgtggagcgagggaggggagccattttgttattatagaactaacttagcctgttattacgccaccgttggcccctctgtgagttctttttgctactcgagtgactgcacatggtcggtcggtaatgtggaaaaactctgcgaaagtagtttcaggtcaaacattgcatttctatactagcgacttggaggactggtcgatgctgtcgatgggagagacggacctgataaacattgctaatctgggcggccgttttataggatccaagtcttattaccgttgcttccgagataataagttttatttggggtgcct

SEQ ID NO: 1848 - DNA, 1829 bp, Zea mays
gttagggcctgtagatccctcaaatccctaaccgacccgcgaccccgacccgattgccgtacctccttccgtgtggcatataaatccgacgcgccgacgcctcgattcctcgcctccccgagagcccccgtttctgtcacaaatcgccactaaaaccctagccttccgccatggccacctcccctgccgcctcgtcctcctccgctccgaccgcctccgcggtggctgcggctacgatggctgttgaggccaccgacgggccggtgctcagcgtagtatcgaagcgtctccgcgcactgcggaagaagtacaaccgaatcacgcagatggaggagtcgctcgccgccggcaagacgctcaaccgagagcaggaggaggttctccgctccaagcccgtcgtcgccgctctgatcgacgagctcgagcgcctccgccctccgctcgcctccgccctcgcggaggagctctcctcccgccccgcccccgccccctccgccgcttcctcctccgactcagattcgtcagtccaggacttgcttgcgctcgtctacttcggctccctctttgacgtcaagcagcaaagcgacttcgtctctttggtttacacgcgcgaactcgagcggagcagctgcctcacttatgactacgtcggggatgatccggaggacagtctcgcggagaccgatctgaacgcggtttctgcccttgcctccctcgccgcgttgcgccctcctgctgcagccggagtctcgcaccgtgacgcccttcaggcttgtgctcatcacgcccgcctctggctctgccgtgcggatgaacccatccatcctgactccaccatcacatatgctggggtgagggcaaagctggataggatcatggcatcgggctacttcacagcgcagctagaaatgaggacaccattggatctggctgctgcagtggcaagttttggagctggaggtgtgcaggtgcaagagagcatggttgtgtcacctcaggcaccggaagcagtggaggagagccaggctgttgaaggacacaagaatgagaaggaagattctcaggctacagaaatctacaatgatcatcctgttgttgactctgaacatgtggaggatgaagtcctggtgcatccaactgatgaagttcctccagctgagacagagcaggagcaggagacatttgatgctgatgtgaaggatcaggagcaaaaggaccaacaattcatccagcggcggtcttaccagaaccagcgtggtggtggtcgtggtggcagcaggagaggctatcctaatggtcgtggaggacgtggtggccgaggtggcgggtaccagaatggccgtggtggataccagaatggtcgtggcggtgctggcgggtactactacgaatctggatactaccagccgaggaactacaacagaggccggggtggtcgctccggcggtggcaactcttactacaacagccatggtggaggtgcacaggggcatcatcctgggagtgttgagctgggcgcaaacgcctagcttcgctgactgttctgtttgataatgaggagcgagtgagtcgtgccattttgttattatagaactaacttagcctgttattacgtcaccgttggtcccatccgtgagtctttttgctgctcgagtgactgcatatggtcggtcggtattgaggaaatactctgggaaagtagtttcaggtcatattcgttttctaagttacgtttttttttgtgttaatatgcccttatttcttaattattatatactctgctagaggtgtcgatgccgccaccagattttgtcgtcgcatcaggctgc

SEQ ID NO: 1849 - DNA, 1715 bp, Zea mays
ctccccgagagcccccgtttctgtcacaaatcgccactaaaaccctagccttccgccatggccacctcccctgccgcctcgtcctcctccgctccgaccgcctccgcggtggctgcggctacgatggctgttgaggccaccgacgggccggtgctcagcgtagtatcgaagcgtctccgcgcactgcggaagaagtacaaccgaatcacgcagatggaggagtcgctcgccgccggcaagacgctcaaccgagagcaggaggaggttctccgctccaagcccgtcgtcgccgctctgatcgacgagctcgagcgcctccgccctccgctcgcctccgccctcgcggaggagctctcctcccgccccgcccccgccccctccgccgcttcctcctccgactcagattcgtcagtccaggacttgcttgcgctcgtctacttcggctccctctttgacgtcaagcagcaaagcgacttcgtctctttggtttacacgcgcgaactcgagcggagcagctgcctcacttatgactacgtcggggatgatccggaggacagtctcgcggagaccgatctgaacgcggtttctgcccttgcctccctcgccgcgttgcgccctcctgctgcagccggagtctcgcaccgtgacgcccttcaggcttgtgctcatcacgcccgcctctggctctgccgtgcggatgaacccatccatcctgactccaccatcacatatgctggggtgagggcaaagctggataggatcatggcatcgggctacttcacagcgcagctagaaatgaggacaccattggatctggctgctgcagtggcaagttttggagctggaggtgtgcaggtgcaagagagcatggttgtgtcacctcaggcaccggaagcagtggaggagagccaggctgttgaaggacacaagaatgagaaggaagattctcaggctacagaaatctacaatgatcatcctgttgttgactctgaacatgtggaggatgaagtcctggtgcatccaactgatgaagttcctccagctgagacagagcaggagcaggagacatttgatgctgatgtgaaggatcaggagcaaaaggaccaacaattcatccagcggcggtcttaccagaaccagcgtggtggtggtcgtggtggcagcaggagaggctatcctaatggtcgtggaggacgtggtggccgaggtggcgggtaccagaatggccgtggtggataccagaatggtcgtggcggtgctggcgggtactactacgaatctggatactaccagccgaggaactacaacagaggccggggtggtcgctccggcggtggcaactcttactacaacagccatggtggaggtgcacaggggcatcatcctgggagtgttgagctgggcgcaaacgcctagcttcgctgactgttctgtttgataatgaggagcgagtgagtcgtgccattttgttattatagaactaacttagcctgttattacgtcaccgttggtcccatccgtgagtctttttgctgctcgagtgactgcatatggtcggtcggtattgaggaaatactctgggaaagtagtttcaggtcatattcgttttctaagttacgtttttttttgtgttaatatgcccttatttcttaattattatatactctgctagaggtgtcgatgccgccaccagattttgcgtcgcatcaggctgc

SEQ ID NO: 1850 - DNA, 1613 bp, Zea mays
ccccaagccgagccccccacacctgacagaaaagcgccactaaaaccctagccatccgccatgtccacctccccagccgcctcatcctccgctccgaccgccttcgccgcctctgcggttacgatggctgccgaggccgccgacgggccggtgctcagcgtagtatcgaagcgtctccgcgcgctgcggaagaagtacaatcgcatcacgcagatggaggagtcgctcgccgccggcaagtcgctcaaccgagagcaggaggaggttctccgctccaagcccgtcgtcgctgctctgatcgacgagctcgagcgcctccgccccccgctcgcatcagctctcgcggaggagctctcctcccgctctgcccccgcccccgccgccaccgcttcctcctccgactcagattcgtcagtccaggacctcctcgcgctcgtctactttggctccctcttcgatgtcaagcaacaaagcgacttcgtctctttggtatacacgcgcgagctcgagcggagcagctgcctcacttatgactacgtcggggatgatccggaagacagtctcgtggagaccgatctgaacgccgtttctgcccttgccaccctcgcggcgtcgcgccctcctgctgcagctggagtctctcaccgtgatgccctccaggcttgtgcccatcacgcccgcctctggctcagccgtgcggatgaacccatccaccctgactccaccatcacatatgctggggtgagggcaaagctggatagaatcatggcatcgggctactacacagctcagctagaaatgaggacaccaatggatctggctgctgcagtggcaaactttggagccggaggtgtgcaggtgcaagagagcatggttgtgtcgcctcaggcactggaagcagtcgaggagagccaggatgttgaagaacacaaggacgagaaggaagattctgaggctacagaaatctacagtgagcatcaggctcctgttgttgacgctgaacatgtggatgatgaaggcctggtgaacccagctgatgaagttccttcagctgaggcagagcaggagacacttgacgattatgtggacgatcaggaacaaaaagaccaacaattcacccagcggcgctcttaccagaaccagcgtagtggcggtggtcgtggtggtggcaggaggggctatcctaatggtcgtggagtgcgtgggtaccagaatggccgaggtggcgggtaccagaatggccgaggtggcggtggataccagaatggccgtggcggaggcggtgggtactacgaatctggatactaccagccgaggaactacaacaacagaggccggggtggtcgcaactcttattacaacaaccatggtggaggtgcacaggcaggcggccatggccatcctgggagggttgagctgggtgcaaacgcctagctcgagctgactgttttgtttgaggagcagaggtcggggggagccattttgttattatagaactaactgagcctgttatttcttttttgctactcgcatatggaaatgctttggggaagtagtttcaggtcgactttgttcttctaagttacgtctattaatcgtgttaatatgccctt

SEQ ID NO: 1851 - DNA, 1610 bp, Zea mays
caagccgagccccccacacctgacagaaaagcgccactaaaaccctagccatccgccatgtccacctccccagccgcctcatcctccgctccgaccgccttcgccgcctctgcggttacgatggctgccgaggccgccgacgggccggtgctcagcgtagtatcgaagcgtctccgcgcgctgcggaagaagtacaatcgcatcacgcagatggaggagtcgctcgccgccggcaagtcgctcaaccgagagcaggaggaggttctccgctccaagcccgtcgtcgctgctctgatcgacgagctcgagcgcctccgccccccgctcgcatcagctctcgcggaggagctctcctcccgctctgcccccgcccccgccgccaccgcttcctcctccgactcagattcgtcagtccaggacctcctcgcgctcgtctactttggctccctcttcgatgtcaagcaacaaagcgacttcgtctctttggtatacacgcgcgagctcgagcggagcagctgcctcacttatgactacgtcggggatgatccggaagacagtctcgtggagaccgatctgaacgccgtttctgcccttgccaccctcgcggcgtcgcgccctcctgctgcagctggagtctctcaccgtgatgccctccaggcttgtgcccatcacgcccgcctctggctcagccgtgcggatgaacccatccaccctgactccaccatcacatatgctggggtgagggcaaagctggatagaatcatggcatcgggctactacacagctcagctagaaatgaggacaccaatggatctggctgctgcagtggcaaactttggagccggaggtgtgcaggtgcaagagagcatggttgtgtcgcctcaggcactggaagcagtcgaggagagccaggatgttgaagaacacaaggacgagaaggaagattctgaggctacagaaatctacagtgagcatcaggctcctgttgttgacgctgaacatgtggatgatgaaggcctggtgaacccagctgatgaagttccttcagctgaggcagagcaggagacacttgacgattatgtggacgatcaggaacaaaaagaccaacaattcacccagcggcgctcttaccagaaccagcgtagtggcggtggtcgtggtggtggcaggaggggctatcctaatggtcgtggagtgcgtgggtaccagaatggccgaggtggcgggtaccagaatggccgaggtggcggtggataccagaatggccgtggcggaggcggtgggtactacgaatctggatactaccagccgaggaactacaacaacagaggccggggtggtcgcaactcttattacaacaaccatggtggaggtgcacaggcaggcggccatggccatcctgggagggttgagctgggtgcaaacgcctagctcgagctgactgttttgtttgaggagcagaggtcggggggagccattttgttattatagaactaactgagcctgttatttcttttttgctactcgcatatggaaatgctttggggaagtagtttcaggtcgactttgttcttctaagttacgtctattaatcgtgttaatatgccctt

SEQ ID NO: 1852 - DNA, 1779 bp, Setaria italica
gccgctccgacccctgagccccccattccttcccccaaatcgccccctaaaaccctagcctttcgccatggccgcctcttcctcctccgctcccaccgccgcggcggcagcggccgcggccgaggccactgacgggccggtcctcagcgtggtctcgaagcgcctccgcgcgctgcggaagaagtacaaccgcatcacgcagatggaggagtctctcgccgccggcaagaagctcaaccccgagcaggaggaggtgctccgctccaagaccgtcgtcgtcgcccagatcgaagagctcgagcgcctccgcgccccgctcgcctccgccctcgccgaggagctctcctcccgccccgcccccgcccccgcccccgctcccgccgccgccgccgccgcttcctcctccgactcggattcgtccgtcctggacttcctcccgctcgtctacttcggctccctcttcgacgtcaagcagcagggtgacttcgtcgccacgatggtcgcgcgcacgcacgagcgcaactgctgcatcacctatgactacgtcacggatgatgcggcggacctgctcgcggagaccgatctggacgcggtttctgcccttgcatccctcgccgcgtcgcgcccagcttctgcggctggagtctcccaccgtgacgccctccaggcttgcgcccatcacgcccgcctctggctccgccgtgcggatgagcccatccaccctgactccaccgtcacatatgctggggtgagggaaaagctggagaagatcatgtcattggactactacacagcacagccagatataagggcggcagaggctgtggctgctgcagtggggaattatggagcaggaggcgttcaggcccaggagagcatggttgtgtcacctcaggcttcagaagaagcagaggagagcctggctgttgaaggacataagggtgagaaggaagaacctcaggctacagaaatctacattgaccatcaggctcctgcagttgatgctcaacatgtggatgatgatgcgctggtgaacccaactgatgaagccccttcagctgaggcagagcaggaaaggtttgatgctgatgtggaggatcaggaacaaaaagaccaacagttcatccagcggcggtcttaccagaaccagcgtggtggtggtcgtggtggcaggaggggctaccctaatggtcgtggaggacgtggaggccgaggtggtgggtaccagaatggccgtggtggaggtggtgggtaccagaatggccggggtgggggcggcggcggcggcgggtactactacgaacaaggatactacccgccaaggaactacagcaacaacaacagaggccgtggtggtcgctctgggggtggcaactcttactacaacaaccacggtggaagcgggcagggaggtggccatgggagggttgagctgggtgctaacgcctagctcgctgactgttttgcttgagtgagggagggggagccattttgttattatagaactaacttagcctggtattacgagtcaccgttgggccccatctgtgagttattttgctacaccaatgactgcatatggttggtaggtaatcgttcttggtgggtcggtaatgcggaagtactctgggaaagtagtttgaggtcatattcttaagttacctcttcatgtgttcatatgcccttatttcgtttcgttctgttactccaatggctgcaggaggtaatgtcgatgccatctctagtttttgtcgttacatcaggttgaggagatgctcc

SEQ ID NO: 1853 - DNA, 2190 bp, Zea mays
agttccttccaagaagagctcaaaaagctttgtctgctcaacctggacgcctcggcctcggcgatccaccggcacggcaccgaaacacctcgtctcgatttcgaaccaaaccctccagtgtccagccccgtctcgttcgccgcggcaggagcgagcgagcgaccgagcgagcagccatggcgccggtcgatccccactcctacaccgacggcgcgcacccggtggtctcgcgcgcggcgctcgccttctacctcgacttcgccgcctccaccatacacgcctccgcggtgctcaccctctccgcgccgcactccggcgacctcctcctcgacacccgcgctctcgccgtccactccgcctccaccgacgccgacccgccggagcccatccccttctccctcgccgcggcgcccgacccggtcctcggcacggcgctgaccctcgccctgccccgcgacaccgcctccttccggctcaccttctcaacctcccccgccgcctccgcgctgcagtggctggccccgccgcagaccgcctccgcgcagcccttcgtcttctcgcagtgccagtccatccacgcccgctccgtcttcccctgccacgacacccccgccgcgcgcatcaccttctcgctcctcctcaacgtccccgagcagctctccgccgtcgccgccgcgcgccacgtcgcgcgccgggacccgctgccctccgaccaccgcggggcgtgcgacgacgggctctggtgcgcgcccggccgcatcgtcgaggagttccagatggaccagtccgtgccgccctacctcttcgcgttcgccgccggcagcatcgggttcagggacctcggcccgaggacgcgggtgtacgcggagggaggggacacggtgttggacgaggcggccagggagttcgcgggggtggaggagatggtcaaggttggggaggggctctttgggccgtatgaatgggagaggttcgatctgctcgtgctgccaccgagcttcccctatggaggtatggagaaccccaggatggtgttcctcactcccacggtcatcaaaggggatgctgcaggggctcaggttgtggcccatgagctcgcacatagctggactggcaatctgattactaacaaaaccaatgaagatttctggctaaacgagggattcacaacatatgctgagaggaggattgttgaggttgtgcaaggggaggagcgggcagccttaaacatggggattggatggaggggattgaacaggatgatggagaggtttaaggataacatggagttcaccaagttgaagccgaagatggcagggattgaccctgatgatgtttactctgaagtgccctatgagaaaggtttccagttcctttggagaattgagcgtgagattggcaggcctgctttcgacgagtttttaaagaagtacattgcaaccttcaagttccaatcgatagatacagagacatttcttgaattcctcaaaaccaatgtacctgggatagaaaacaaaattgaccttcacctgtgggttgaggggactggtatccctcctgatgccatggaaccagattcagctacttacaaaaagatctgctccttagctgcagaattcaaatctggaaaacttccaagtgaagatgaggtagcaaagtggagtgggcaagaatgggaactttacttagaaaatctaccagcagatgttgaagcctcacaggtcactgctctcgacgagcggtacaagctatctgaaagccgtgactacgaggtcaaagtggcgttcctccagctggcgatccccaccgggtgcaagtgctacttcaacgaggttgagaaatgcttgaagcaggtgggaaggatgaagtacctccgcccgctctacagctcgctggccaagtgctccagcgaggagaagatgctggcccagaggatattctcggaggctcaagagttctaccacccaatagctcgaagtgttgcggaggccattttgtcgaagcatagctaagcaagccaagactcttgcttggcgattcacgcttgatctggtgactgctgctcagtttgcttctttcgcataaaattatcgtctgctctggaaaagaaacttaggaaaaacttgaggcttgtattgcatctttgataacataatattatattatatgtagagactcagaaaccgtagt

SEQ ID NO: 1854 - DNA, 2178 bp, Zea mays
agttccttccaagaagagctcaaaaagctttgtctgctcaacctggacgcctcggcctcggcgatccaccggcacggcaccgaaacacctcgtctcgatttcgaaccaaaccctccagtgtccagccccgtctcgttcgccgcggcaggagcgagcgagcgaccgagcgagcagccatggcgccggtcgatccccactcctacaccgacggcgcgcacccggtggtctcgcgcgcggcgctcgccttctacctcgacttcgccgcctccaccatacacgcctccgcggtgctcaccctctccgcgccgcactccggcgacctcctcctcgacacccgcgctctcgccgtccactccgcctccaccgacgccgacccgccggagcccatccccttctccctcgccgcggcgcccgacccggtcctcggcacggcgctgaccctcgccctgccccgcgacaccgcctccttccggctcaccttctcaacctcccccgccgcctccgcgctgcagtggctggccccgccgcagaccgcctccgcgcagcccttcgtcttctcgcagtgccagtccatccacgcccgctccgtcttcccctgccacgacacccccgccgcgcgcatcaccttctcgctcctcctcaacgtccccgagcagctctccgccgtcgccgccgcgcgccacgtcgcgcgccgggacccgctgccctccgaccaccgcggggcgtgcgacgacgggctctggtgcgcgcccggccgcatcgtcgaggagttccagatggaccagtccgtgccgccctacctcttcgcgttcgccgccggcagcatcgggttcagggacctcggcccgaggacgcgggtgtacgcggagggaggggacacggtgttggacgaggcggccagggagttcgcgggggtggaggagatggtcaaggttggggaggggctctttgggccgtatgaatgggagaggttcgatctgctcgtgctgccaccgagcttcccctatggaggtatggagaaccccaggatggtgttcctcactcccacggtcatcaaaggggatgctgcaggggctcaggttgtggcccatgagctcgcacatagctggactggcaatctgattactaacaaaaccaatgaagatttctggctaaacgagggattcacaacatatgctgagaggaggattgttgaggttgtgcaaggggaggagcgggcagccttaaacatggggattggatggaggggattgaacaggatgatggagaggtttaaggataacatggagttcaccaagttgaagccgaagatggcagggattgaccctgatgatgtttactctgaagtgccctatgagaaaggtttccagttcctttggagaattgagcgtgagattggcaggcctgctttcgacgagtttttaaagaagtacattgcaaccttcaagttccaatcgatagatacagagacatttcttgaattcctcaaaaccaatgtacctgggatagaaaacaaaattgaccttcacctgtgggttgaggggactggtatccctcctgatgccatggaaccagattcagctacttacaaaaagatctgctccttagctgcagaattcaaatctggaaaacttccaagtgaagatgaggtagcaaagtggagtgggcaagaatgggaactttacttagaaaatctaccagcagatgttgaagcctcacaggtcactgctctcgacgagcggtacaagctatctgaaagccgtgactacgaggtcaaagtggcgttcctccagctggcgatccccaccgggtgcaagtgctacttcaacgaggttgagaaatgcttgaagcaggtgggaaggatgaagtacctccgcccgctctacagctcgctggccaagtgctccagcgaggagaagatgctggcccagaggatattctcggaggctcaagagttctaccacccaatagctcgaagtgttgcggaggccattttgtcgaagcatagctaagcaagccaagactcttgcttggcgattcacgcttgatctggtgactgctgctcagtttgcttctttcgcataaaattatcgtctgctctggaaaagaaacttaggaaaaacttgaggcttgtattgcatctttgataacataatattatattatatgtagagactc

SEQ ID NO: 1855 - DNA, 2197 bp, Oryza sativa
gttgcattgcttctttcaatcctgtctcgattcgagttcgaccaaatccacacaggccaaagccaaaccctgtccctccctccctaccctccactccgatctcctcctcctccgccgctgcagctcagccatgccgccggtggatccccactcgtacaccgacggcgaccacccggtcaccgccaaggccgccctcgccttctacctcgacttcgccgcctccaccatccacgcctccgcgctgctcaccctctccgccccgcactccggcgacctcctcctcgacacccgcgccctcgccgtccactccgcctccaccgcctccggcccgccctcccccatccccttctccctcgccgacgccgccgaccccgtcctcggctccgccctcacgctcaccctgccccccgacaccacctccttcctcctcaccttctccacctccccctccgcctccgcgctgcagtggctctcgccgccgcagaccgcctcctcgctccccttcgtcttctcccagtgccagtccatccacgcccgctccgtcttcccctgccacgacacccccgccgcgcgcatcaccttcgacctcctcctcaacgtccccacccagctctccgcggtcgccgccgcgcgccacgtctcccgccgcgaccccctgccctccgaccaccggggcgcctgcgacgacgcgctgtggtgcgcgccgggccgcatcgtggaggagttccagatggagcagtccgtgccgccctacctcttcgcgttcgccgcaggcgggatcgggttcagggacctcggcccgaggacgcgggtgtatgccgagggaggggacaaggttctcgacgaggcggcgagggagttcgccggcgtcgaggagatggtcaaggttggggagtcgctgtttgggccgtatgagtgggagaggtttgatctgctggtgttgccgcccagtttcccctacggtggcatggagaaccctagaatggtgttcctcacgcccacggtgatcaagggggacgctgctggggcgcaagtggtggcgcatgagctcgcgcacagctggactggcaacctgatcactaacaagaccaatgaagatttctggctaaatgagggtttcacaacatatgcggagcggaggattgttgaggtggtgcaaggggaggagcgggcagccttaaacatgggaattggatggcggggtttgaacagaatgatggagaggtttaaagataacatggagtatactaagctgaagccaaagatggcagggattgaccctgatgatgtgtactcagaagttccctatgagaaaggcttccaattcctttggcgcattgagcgtcagattggtcgacctgcatttgatgaattcctgaagaattacatatccacatttaagttcaagtcgatagacacagagacattccttgaattcctgaaaaccaatgtacctggaatagaaaaccaaattgaccttcaactgtggatcgaggggactggtatccctccggatgccatggaaccagagtcagctatttataaaaagatttgctccctagctgcagagtttaagtctggaaaacttccaagtgaagatgaggtagcagactggagtggacaggaatgggaactttacttggaaaacttacccacagatgttgaagcttcacaggtcactgctctcgatgagcggtacaagctatcagaaagctgtgactacgaggtcaaagtcgcgtttctccagcttgcaattcccaccggctgcagatgctacttcaacgaggttgagaaatgcttgaagcaagtggggaggatgaagtaccttcgcccgctctacagctcgctggctcgatgctccggggaggagaagatgcttgcccataggatcttctcagaggcgcatgaattctatcatcccatcgctcgtagcgtcgcagagagcatcctctcgaagcatggctaagccgaaacctatccttttatatatcctatatattgctgaacctaaagtaggaagaacatttgatgtttatcgacttgttgctcactagtagtttcataaattatcgctctctggagtaaccctgggaaaaactgggagctcaaaactgtgtcctgacggtatacaattgtgaattgtgactgcgcatcaaaatttcctggtcctatgagttgttgtgccttcccaatgcaa

SEQ ID NO: 1856 - DNA, 2098 bp, Brachypodium distachyon
aagactgaaaagtcgaaaccccacctcccgtccccatccccgtctcctctcctcctccttcgctcctccgccgcggccaccagaccagccatggcgcccgtggatccccactcctacaccgacggcgcgcacccggtgacctcccacctcgcgctcgccttctacctcgacttctccgcctccgccatccacgcctcggccctcgtcacgctctccgcgccgcactccggcgacatcctcctcgacacccgcgccctcgccgtccactccgccaccacgaccaccgacgcgccctcccccatccccttctccctcgccgccgacgcggacccggtcctgggcaccgcgctcaccctcaccctgcccccaaacacctcctccttcctcctcaccttctccacctcccccgccgcctccgcgctccagtggctctccccgccgcagaccgccagcgccctccccttcgtcttctcccagtgccagtccatccacgcccgctccgtcttcccctgccacgacacccccgccgcgcgcatcacctactcgctcctcctcaacgtgcccgcccagctctccgccgtcgccgccgcgcgccacgtgtcgcgccgcgacccggcctccgccgaccaccgtggcgcatgcgacgacgcgctctggtgcgcgcccgaccgcgtcgtcgaggagttcgagatggcgcagtgcgtgccgccctacctcttcgccttcgccgccggcgggatccggtgcagggacctcggcccgaggacaagggtttacgccgagggaggggacacgctcctcgacgaggcggccagggagttcgccggggtcgaggacatggtcaaggtcggggaggcgctgtttgggccctatgagtgggagaggttcgatctactcgtgcttccgcccagcttcccctatggaggtatggagaaccccaggatggttttcctcacgccaaccgtgatcaaaggggactctgcaggagcgcaggtggtggcccatgagctcgcacatagctggacgggaaatctcatcaccaacaaaaccaatgaggacttctggctaaatgagggtttcacaacatatgctgagaggaggatcgttgaggtggtgcaaggtgaggagcgggcagccttgaacatgggaattggatggaggggattgaacagaatgatggagaggtttaaggataacatggagtttaccaagctgaagccgaagatggcagggattgatcctgatgatgtgtactcagaagtgccttatgagaaaggcttccagttcctttggcgcattgagcggcagattggacgacctgcatttgatgaattcctgaagaagtatattgctaccttcaagttccagtcgatagatactgagacatttcttgaattcctgaaagccaatgtacctggcatagaaaaccaaattgaccttcagctgtggattgagggtactggtatccctccggatgccatggagccagattcagctacgtataaaaagatttgcgccttagctgcagaatttaagtctgggaaatttccaagtgaagaggaggtggcagactggagtggacaagaatgggaactgtacttggaaaatttgcccacagatgttgaagcctcacaggttactgctcttgatgaacggtacaggctatcagaaagtcgtgactacgaggtcaaagtcgcatttctccagctagcaatccccacaggttgcaggtgctacttcaacgaggtcgagaaatgcttgaagcaagtgggaaggatgaagtacctgcgcccgctttacagctcgctagcccggtgttccggggaggagaagatactggcacagaggatcttctcggaggcccacgatttctatcacccaatagctcgcagcgttgcagagagcatccttttgaagcatgggtagctgaagccatagttcattcgctcatttcttttgcataaaattgtctcccctcctggagctaacctggggtaaactagaacactgagaactgtcttttggtaatgtatcatgtgagattgcatgtgcgcaagtcttctgaccctgtaagaaatttgaacagtttggattcacg

SEQ ID NO: 1857 - DNA, 1809 bp, Pennisetum glaucum
ctcgctcctcctccacctccccggacgcctccgcgctgcagtggctgggcccgccgcagaccgcctccgggcagcccttcgtcttctcgcagtgccagtccatccacgcccgctccatcttccccagccacgacacccccgccgcgcgcatcaccttctcgctcctcctcaacgtcccctcgcagctctccgccgtcgccgccgcgcgccacgtcggccgccgggacccgctgccctccgaccaccgcggcgcctgcgacgacgagctgtggtgcgcgtccggccgcatcgtcgaggagttccagatggagcagtccgtgccgccctacctcttcgcgttcgccgccggcgggatcggcttcagggacctcggcccgaggacgcgggtgtacgcggagggaggggacaaggtgctggacgaggcggcgagggagttcgccggggtggaggagatggtcaaggtcggggaatcgctgtttgggccgtatgagtgggagaggttcgatctgctcgtgctgcctccgagcttcccttacggaggcatggagaaccccaggatggtgttcctcactccgaccgtcatcaagggggatgctgcaggggctcaggttgtggcgcatgagctcgcgcatagctggactggcaatctgattactaacaagaccaatgaagatttctggctaaatgagggattcacaacatatgctgagaggaggattgttgaggtggtgcaaggggaggagcgggcagccttaaacatgggaattggatggagggggttgaatagaatgatggagaggtttaaggataacatggagttcaccaagttgaagccgaagatggcagggattgaccctgatgatgtgtactctgaagtgccctacgagaaaggcttccagtttctttggcgcattgagcgccagattggccgccctgcttttgacgagttcttaaagaagtacattgccacgttcaagttcaaatccatagacagtgagacatttcttgaattcctgaaaacaaatatacctgggatagaaaaccaaattgaccttcaactgtgggttgaggggactggtattcctcctgatgccatggaaccagattcagctacttacaagaagatctgcgacttagctgcagaattcaagtcaggtaagcttccaagtgaagatgaggtggcagactggagtgggcaagagtgggagctttacttggaaaatctacccacagatgttgaagcctcacaggttactgctcttgatgagcggtacaagctatctgaaagccgtgactatgaggtcaaggtcgcgttcctccagctggcgatccccaccgggtgcaagtgctacttcaacgaggttgagaaatgcttgaaacaggtgggaaggatgaagtaccttcgcccgctttacagctcactggccaagtgctctggtgaggagaagatgctggcccagaggatcttctcagaggctcaagaattttaccacccaatagctcgcagtgttgcagagtccattttgtcgaagcatagctaaaggctttggtgaatccatcatcccttggagcaaacggaacatccactgttggctcagtcgcttctttcgcataaaactatcacccttcctggagctaacttaggaaaactggaaacttggtactgtatctcgataatatgtggaaactaaagactgtgttattatccgagattattcttagtactgcatatcttttgggattgctcatgcctagttttctgatatttgcaaattatttaagtccatccattaaagttggagctgatag

SEQ ID NO: 1858 - DNA, 1778 bp, Zea mays
ccccactactggctcggtccacgccacgcgcacggcgcgcaccgcccacgcccagcaggccagcagtccgctccaccgctcccgatcgagacctagcaccgccgccagttcgccaaccaacgcccactcccacacgcgcctgcctgcctccatgcatgatcccagaaatgaagaggaagccagccccgcccagccaagaccaccgcgcgcgcccgggtgcagagcagagacgtgccggcatctctccgcgccccgtcgcgtcacccgctcgcctttcacgtgccgcaatgctttcccctcaccgcccggtgcccgcgcaagccacgaaattagcaagggctgccctatctatctatccggccatctaccttgtctctcgacgctcgagtgtcaatcaccaccgctccagctacgcacagctataaaaccaggggcagccaaacatggtactgctataccgcatgaccgcacctcgtatcgtcgtctagctccgtttcgtttccgggaagcaaccaaccttcgttcccgggcagccgacgacccttgcgccgtcttcgtctgtcaagagtacagtttgacgcgagcagctgccggttccttctctcgtgcgcctttgctagcttgggatcgatcaaagccggtgagcgaccgagcgagcgagtgaggatcggaacatctgccatcatggcctccgagcatgcgcagctgtctgccaaggccgccgccggcagcaggttcgcggtgacgtacggcctgctgaggcagtacatgaaggagcagggcggcagcggcgccaccaggagcctcgcgccggccgtgggcgtgggcctcatgccggaagccgacgctgctgcggcggcggaggcgaccgaggagaggaccaccgtgctggagctcttcccgcagcaggctggcacgctcaaagacgagcagcaaaggaagaggaaggagcgtgctgacgggagagcgccgctgaccatcttctacggcggcaagatggtggtcttcgacgacttccccgccgagaaggccgaggagctgatgcagctcgccggctccggcaacgccgcccaggacgcgctgggacagcccagcctcacagacatgcccctcgcgaggaaggtgtcgctaaagaggttcctggagaagaggaagaaccggctcaccgcggcagatccatacccagcagcggcggcgacggcggcggcaagcgagtcgtcgactaagcctccggcagtgaaagacgagggcgcgccgtgggtcggcgtgaactcggcgctcagcctcagctgaacaatctcatcgacggcagcctgcctacctatcgctatagggaaaaactagctatttcccggccgtaaaaatatgtacgtgtttggccccccttgacatttacaccagttaaatggctgcttcagttcaggggaattattagctgggtagctaattaccatggtcggtttaattagttgtctgtttgagaattctttggccagaacgaagaagaattctttttttcttccttgctggtattcatcatatctgcgaggatacgaactgattaattagatctagtcgaactcatatatatacatagtgtgtaaattcaaataagatgatggaacaggttatatgcaattctttcgcttcattgattcagtctcgtgtcagatgaattcatggattgtttatttccactctccttttttttctgtcaccgggcggtgaaactgaaatatatcgctagcactcctccgtgtatcatgtatgtccctgac

SEQ ID NO: 1859 - DNA, 1775 bp, Zea mays
ccccactactggctcggtccacgccacgcgcacggcgcgcaccgcccacgcccagcaggccagcagtccgctccaccgctcccgatcgagacctagcaccgccgccagttcgccaaccaacgcccactcccacacgcgcctgcctgcctccatgcatgatcccaaaaatgaagaggaagccagccccgcccagccaagaccaccgcgcgcgcccgggtgcagagcaaagacgtgccggtatctctccgcgccccgtcgcgtcacccgctcgcctttcacgtgccgcaatgttttcccctcaccgcccggtgcccgcgcaagccacgaaattagcaagggctgccctatctatctatccggccatctaccttgtctctcgacgctcgagtgtcaatcaccaccgctccagctacgcacagctataaaaccaggggcagccaaacatggtactgctataccgcatgaccgcacctcgtatcgtcgtctagctccgtttcgtttccgggaagcaaccaaccttcgttcccgggcagccgacgacccttgcgccgtcttcgtctgtcaagagtacagtttgacgcgagcagctgccggttccttctctcgtgcgcctttgctagcttgggatcgatcaaagccggtgagcgaccgagcgagcgagtgaggatcggaacatctgccatcatggcctccgagcatgcgcagctgtctgccaaggccgccgccggcagcaggttcgcggtgacgtacggcctgctgaggcagtacatgaaggagcagggcggcagcggcgccaccaggagcctcgcgccggccgtgggcgtgggcctcatgccggaagccgacgctgctgcggcggcggaggcgaccgaggagaggaccaccgtgctggagctcttcccgcagcaggctggcacgctcaaagacgagcagcaaaggaagaggaaggagcgtgctgacgggagagcgccgctgaccatcttctacggcggcaagatggtggtcttcgacgacttccccgccgagaaggccgaggagctgatgcagctcgccggctccggcaacgccgcccaggacgcgctgggacagcccagcctcacagacatgcccctcgcgaggaaggtgtcgctaaagaggttcctggagaagaggaagaaccggctcaccgcggcagatccatacccagcagcggcggcgacggcggcggcaagcgagtcgtcgactaagcctccggcagtgaaagacgagggcgcgccgtgggtcggcgtgaactcggcgctcagcctcagctgaacaatctcatcgacggcagcctgcctacctatcgctatagggaaaaactagctatttcccggccgtaaaaatatgtacgtgtttggccccccttgacatttacaccagttaaatggctgcttcagttcaggggaattattagctgggtagctaattaccatggtcggtttaattagttgtctgtttgagaattctttggccagaacgaagaagaattctttttttcttccttgctggtattcatcatatctgcgaggatacgaactgattaattagatctagtcgaactcatatatatatatagtgtgtaaattcaaataagatgatggaacaggttatatgcaattctttcgcttcattgattcagtctcgtgtcagatgaattcatggattgtttattttcacctttttttttctgtcaccgggcggtgaaactgaaatatatcgctagcactcctccgtgtatcatgtatgtccctgac

SEQ ID NO: 1860 - DNA, 1102 bp, Panicum virgatum
ggccgacgacgacctcgaggtcagctgtcagaggttgatgtgagctggttcgcttcgatcgtgcgccttcttcctcgatcatcatcatcaagccggtgagggacatggccgccgccgagcagcagcagcagcccggcagcaaggccgccggcggcagcaggttcgcggtgacgtgcggcctgctgaggcagtacatgaaggagcagggcgggaacggcgccttgcgcctcgcgccggccgtggccatgggccttgcgccggtagccgacgccgcggcggcggcggcggaggaggggacggaggagaggaaggccgtgctggagctcttcccgcagcaggctggcacgctgaaagacgagcagcagaggaagaggaaggagcctgcggctgatgagagggcgccgctcaccatcttctacggcggcaagatggtggtgttcgacgacttccccgccgagaaggccgaggagctcatgcacctcgccggctccggcaacgcggcggcgcctgcaggccagaatgcgctgggacagcccagcctcacagacatgcccatcgccaggaaggcgtcgctcaagaggttcctggagaagaggaaggacaggctcaccgcgggagatccgtacccggcggcggcgagcgagtcgatcaagcctgcagcgaaagacgaagcaggagctccgtggctcagcagcgtcaactccgcgctcagcttgagctgagaagaacctgatggagagcacggacgcgcctagctagagaccacaagggaaactagtactactacagattactgcctactatttttccgtaaaaaaatatttggatcatgaaacgtgttttaccccgtgacatttacaccggttgctggttgcttcaggggaattagctagctagctaattgtgattggttaattagcttgccttttttaagcctgtttgagaattctttggagacaaaagaattcttttatttccatgctgatattcatctgcaatgatatgaactaaatctagttgattgatacgtatatagtttgtaaattcgaataacaggataattatactatatatttattgaattgtttcagttctcagtgcc

SEQ ID NO: 1861 - DNA, 1189 bp, Setaria italica
cctctactctctagcttccgtgaagtttccggaaagcaagtaagcaaccaacttccgtccgagggaggaagaggcggccggccgacgacctcgggtcacctgtcagagttccatgtgagctggttcgtctcgtgctgcacttcttcttcctcgatcaaagccggtggtgatttcagaggcatggccgccgagcatcagcagcagcccgtcgtggtcgccggcggtagcaggttcgcggtcacgtgcggcctgctgaggcagtacatgaaagagcaaggcgggaacggcgccaggcgcctcgcgccagccgtggccatgggcctcgtgccgggagccgacgcggcggcggcggtagcggaggagccggaggagaggaagcccgtgctggagctcttcccgcagcaggctggcacgctcaaagacgagcagcagaggaagatgaaggagcctgcggagagggcgcctctgaccatcttctacggcggcaagatggtggtgttcgacgacttccccgccgagaaggccgaggagctcatgcacctcgccggctccggcaacgcggcggccgctggccagaatgcgctgggacagcccagcctcacagacatgcccatcgccaggaaggcgtcgctcaagaggttcctcgagaagaggaagaacaggctcaccgccggagatccgtatccggtggcggcaactgagtcgatgtcgagcaaggctgcagtgaaagaagagggggcgccgtggctcggcgtgaactccgcgctcagcctgagctgaagaatctgatcgaggacgcatctagagagaccacacaagggaaactgttacgtattattactgcctactagtactactattttccctaaaaatatcttcaggattatgatacgtgttttcttcccccttgacatttacaccagttactggttgcttcaggggaattagctagctaattatgattggttaattagtctgtctgtctgtttgagaattctttggtgacaaaagaattctttttccatgctgatattcatctgcaaggatatgaactaaatctagtcgattgatacgtatatactttgtaaatttaaataacaggatgtgtgctatttattacatttttcagttcttgtgccatataatgtctgaggtagacagagtgttctatttgtggattggtttggtt

SEQ ID NO: 1862 - DNA, 1622 bp, Panicum virgatum
ccacgcgtccggcagggctcggtccacgccacgcgccaccgcccacgagccgaatttaacgcgccactcgcccactcccccgcgcgccctgctgataggctggataccgaaccggaaacgaagaggaggaagccaggcggcggtggccggcgggcagccagaaccaccaccgcggctatactgtaccctaaccccgcgtcgagtcgcgtcgcccgctcgcctttcacgtgctgccttttgatccccggccaaggcacgaaatctaggaggcccgtctacctgccccaagtcaagtgtcaaacccctctctccagcggccgtgcagctataaaacaccaggagcaggcaaacatcctccctagctcatgcctcctgcctgccaccgcatcccgtctagacgcagctcccgtctcgtttccgggaagcaaccaacttcctcgtccgagggaagaggcggccgacgacgacctcgatcggggtcagctgtcagaggttgatgtgagctggttcgcttcgtgcgccttctttcctcgatcatcatcaagccggtgaggtgaaggacatggccgccgccgagcagcagcagcccggcaccaaggctggcggcggcagcaggttcgcggtgacgtgcggcctgctgaggcagtacatgaaggagcagggcgggaacggcgccttgcgcctcgcgccggccgtggccatgggcctcgtgccgggagccgacgcggcggaggaggggacggaggagaggaaggccgtgctggagctcttcccgcagcaggctggcacgctgaaagacgagcggcagaggaagaggaaggagcctgctgatgagagggcgccgctcaccatcttctacggcggcaagatggtggtgttcgacgacttccccgccgagaaggccgaggagctcatgcagctcgccggctccggcaacgcggcggcggcggctctggcacagcccagcctcacagacatgcccatcgccaggaaggcgtcgctcaagaggttcctggagaagaggaagaacaggctcaccgcgggagatccgtacccggcagcggcaagcgagtccatcaagcctgcactgaaagacgaagcaggggctccgtggctcagcagcgtcaactccgcgctcagcttgagctgagaagaacctgatggagagcacgcacgcgcctagagaccacggggggaaactaccactactactactactacatattactgcctactatttttccgtaaaaacatctttggatcatgaaacttggtttacccaacttggtttaccccttgacttttacaccggttactgctggttgcttcaggggaattagctagctagctaattgtgattggttaattagcttgcctttttatgactgtttgagaattctttggagaaaaaagaattctttatttccatgctgatattcatctgcagggagtacgtatatagtttgtaaattcgaataacaggataattatgttgtatatttattgcattgtttcagttctcagtgccatatattttgcataaggtagacaaagtattcaatctgtggattggctgggttggccgtaaaattaacatatataccacaccatgcgcgttcctg

SEQ ID NO: 1863 - DNA, 1917 bp, Oryza sativa
accaaaccaacacaccaacctagctaactcactcactcactccttcttcttgcgacctagctatcgagctagagcttccaaaaccctagctagctagctgagacagttagtttcatctcgaactagttgttgatatgggcagcttggacaccaaccccacggccttctccgccttccccgccggcgagggtgaaaccttccagccgctcaacgccgatgatgtccggtcctacctccacaaggcggtggacttcatctcggactactacaagtccgtggagtccatgccggtgctgcccaatgtcaagccggggtacctgcaggacgagctcagggcctcgccgccgacgtactcggcgccgttcgacgtcaccatgaaggagctccggagctccgtcgtccccgggatgacgcactgggcgagccccaacttcttcgcgtttttcccctccacgaatagtgcggccgccattgccggcgacctcatcgcgtcggcgatgaacacggtcgggttcacgtggcaggcgtcgccggcggccaccgagatggaggtgctcgcgctggactggctcgcgcagatgctcaacctgccgacgagcttcatgaaccgcaccggcgaggggcgtggcaccggcggtggggttattctggggacgaccagcgaggcgatgctcgtcacgctcgttgccgcgcgcgacgccgcgctgcggcggagcggcagcgacggcgtggcgggactccaccggctcgccgtgtacgccgccgaccagacgcactccacgttcttcaaggcgtgccgcctcgccgggtttgatccggcgaacatccggtcgatccccaccggggccgagaccgactacggcctcgacccggcgaggctgctggaggcgatgcaggccgacgccgacgccgggctggtgcccacctacgtgtgcgccacggtgggcaccacgtcgtccaacgccgtcgacccggtgggcgccgtggccgacgtcgcggcgaggttcgccgcgtgggtgcacgtcgacgcggcgtacgccggcagcgcgtgcatctgcccggagttcaggcaccacctcgacggcgtggagcgcgtggactccatcagcatgagcccccacaaatggctgatgacctgcctcgactgcacctgcctctacgtgcgcgacacccaccgcctcaccggctccctcgagaccaacccggagtacctcaagaaccacgccagcgactccggcgaggtcaccgacctcaaggacatgcaggtcggcgtcggccgccgcttccgggggctcaagctctggatggtcatgcgcacctacggcgtcgccaagctgcaggagcacatccggagcgacgtcgccatggccaaggtgttcgaggacctcgtccgcggcgacgacaggttcgaggtcgtcgtgccgaggaacttcgctctcgtctgcttcaggatcagggccggcgccggcgccgccgccgcgacggaggaggacgccgacgaggcgaaccgcgagctgatggagcggctgaacaagaccggcaaggcgtacgtggcgcacacggtggtcggcggcaggttcgtgctgcgcttcgcggtgggctcgtcgctgcaggaagagcatcacgtgcggagcgcgtgggagctcatcaagaagacgaccaccgagatgatgaactaagtaaagagaagattacaaataaatacacatatttagaacacatatacgtttttgatttttttttttggggttttagatgcgaatctgttgattcattttgtgagctatttatacctatggatatatggatcaaaataaattattatttggttgtaatttttttaaaagatgaactgatactataccttacacaagaaatacaatatgataaaaatttatttattactttcccagaata

SEQ ID NO: 1864 - DNA, 1870 bp, Pennisetum glaucum
atgccgtagatttctactaggagttaggaccagcagcttcgagcttccgagtctcacgcatcacgatcgagcttgcaacgcaacagcttctctgttgcttgcacagctagctcgaacaagctggtcctaactcctagtagaaatctagggcattagctgcttcgttccacagcccagtagtacccagacatgggcagccttgacagcaaccctgccaccttcgacgcgttcgccgctgaggccgacggcttccagccgctcaacgccgaggatgtccgctcctacctccacaagtccgtcgacttcatctacgactactacaagtccgtcgagtccatgcccgtgctccccggcgtcgagccgggctacctcagccgcctgctccagtcagcaccacccagcgccgcagcgccgttcgacattgctatgaaagaggtacgggaggccgtggttcctgggatgacccactgggctagccccaacttcttcgccttcttccctgccaccaacagcgccgccgccatcgccggcgagctcatcgcctccgccatgaacaccgtcgggttcacgtggcaggccaacccggccgccaccgagatggaggtgctcgcgctcgactggctcgcccagctcctgcacctacccgagagcttcctcatgaaccgcaacggcggcggccgcggcaccggcggcggcgtcatcctcggcaccaccagcgaggcaatgctggtcacgctcgtcgcagctcgcgacgccgcgctgcgccgcatgggctccaacggcgtcgccgggatcactcggctggtcgtctacgccgccgaccagacccactccaccttcttcaaggcctgccgcctcgccggcttcgacccggccaacatcaggtccatccccaccggtgctgacacggactacggcctcgacccggcgaagctgctcgaggtcatgcaggctgacgtcgacgccggcctcgtgccaacctacatctgcgccacggtcggcacgacgtcgtccaacgccgtcgatccggtgggcgccgtcgccgacgtcgccgcccagttcaaggcgtgggtccacgtcgactctgcctacgccggatccgcctgcatctgcccggagttccggcaccacctcgacggcgtggagcgcgtggactccatcagcatgagcccgcataagtggctcatgacgtgcctcgactgcacctgcctgtgggtccgcgacgcgcaccgcctgaccgactccctcgagaccaacccggagtacctcaagaacgacgccagtgactccggcaccgtcaccgacctcaaggacatgcaggtcggcgtcggccgccgattccgtgggctcaagctctggatggtgatgcgcacctacggtgccaacaagctccaggagcacatccgcagcgacgtcgccatggccaagacgttcgaggaatgggtgcgtgccgacgaccggttcgaggtcgttgtgccgaggaacttcgcgctcgtgtgcttcagggtcaagccgcacgctggcatgacagaggaggccaccgaggcggccaaccgcgagctcatggagcgcctgaacaggaccgggaaggcgtacctggcgcacaccgtgatcggtggcaagttcgtgctgcggttcgccgtggggtcgtcgctgcaggaggaaaggcacgtgcgaagcgcgtgggagctcatcacgaagaagaccaccgagatcatgagcggagagatgtcggtgtagggatttttggcgatgtagttcttacatatttgtgtctgattgatttttgtttaatttccgttcggggaggtggtgtcaaataaaccttttggctgctggttcgtggttgcatgaataataatacaatctg

SEQ ID NO: 1865 - DNA, 2281 bp, Zea mays
ccgttaaacgcccatctcgccacgccgcttcccatgcccggtcgtccgtctcctctcgttcctcctccatccaaccctgctgcctatataaaccacacccaacccatgacaccacgccacacaacacacgttacacaccttccagagcttccgttccaagcgagctagtcctcctcgccatcattgcaactagctagctctgcttcttcgtccttagctctcgcacataatctttgaagaacgaacaccaacccaccaacgatcacacactactcaatccatcgactgacatgggcagcctcgacaccacccctaccgccgccttcgccgacgtcgccggcggtggcttcgagccgctcaacgccgacgacgtgcgctcctacctgcacaagtccgtcgacttcatctacgactactacaagtccgtggagtctctgcccgtgctgccgggcgtggagccgggctacctgcgccgcctgctgcagtccgtgccgcccacctcctccgcgcccttcgacattgccctaaaggaggtccgcgacgccgtcgtgcccgggatgacccactgggccagccccaacttcttcgccttcttcccgtccaccaacagcgccgccgccatcgcgggcgagctcatcgcctccgccatgaacaccgtcggcttcacctggcaggccagccccgcctccaccgagatggaggtgctcgcgctcgactggctcgcgcagctcctgcgcctgccgcccaccttcatgaaccgcaccgccgctgcagggcgcgggaccggcggtggcggcgtcatcctcggcaccaccagcgaggccatgctcgtcacgcttgtctccgcgcgcgacgccgccctgcggagggcaggctccgtcggggtcgctgggatcaccaggctcgccgtctacgccgccgaccagacgcactccaccttcttcaaggcgtgccgcctcgccggcttcgacccggccaacatccgctccatccccaccggcccggagacggactacgccctcgacccggcgaggctgctcgaggtcatgcaggccgacgtggacgccggcctcgtgcccacctacgtgtgcgccacggtcggcaccacgtcgtccaacgcggtcgacccggtcggagccattgccgatgtcgccgccgtgttcaacgcctgggtccacatcgacgccgcctacgccggcagcgcgtgcatctgcccggagttccggcaccacctggacggcgtggagcgcgtggactccatcagcatgagcccgcacaagtggctcatgacgtgcctggattgcacgtgcttgtgggtgcgggacacgcaccggctcaccgattctctcgaaaccaacccggagtacctcaagaacgacgccagcgagtccggcaccgtcaccgacctcaaggacatgcaggtcggcgtcggccgccgcttccgcgggctcaagctctggatggtcatgcgcacctacggctccgccaagctccaggagcacatccggagcgacgtcgccatggccaagatgttcgaggacgccgtgcgtgccgaccaccgcttcgaggtcgtggtgccgaggaacttcgcgctcgtgtgcttcaggatcaggccacagggcaccgacttgacggaggaggacgccgacgtggtcaaccgtgagctaatggagcgcctgaacaggacgggcaaggcgtacctggcgcacacggcgatcggcggcaagttcgtgctgcggttcgcggtggggtcgtcgctgcaggaagagaggcacgtgcgaagcgcgtgggagctcatcaagaagacgaccaccgagatcttcgaggaagagacgatgtagagagtattactatagattatcgtcattcttatttattgattgatgcagctggactaataaatatggttatgcatgccaatcgaaaggtgacgtccaataaagcctttcgtgatgcatatatattcatgcaagaaatttatgtacgttggacctggagtatataacaatgtattatttatgggctataatatatgaacttggctagcttctaatgtctttgtcctgcgtctatgatgaataccatgaactagtggccactatcttgaagaacgcagggtgagaacatgttcaattgttcattttattttgggagaaagagtgttcttgtttttttttccttcttggatgtgactatgacatgtgcgtaagagtaaagctaataaacttgactctagtggtttcaagtctttctctcactcgaacttctccgtgaaatataa

SEQ ID NO: 1866 - DNA, 2007 bp, Zea mays
tccgtctcctctcgttcctcctccatccaaccctgctgcctatataaaccacacccaacccatgacaccacgccacacaacacacgttacacaccttccagagcttccgttccaagcgagctagtcctcctcgccatcattgcaactagctagctctgcttcttcgtccttagctctcgcacataatctttgaagaacgaacaccaacccaccaacgatcacacactactcaatccatcgactgacatgggcagcctcgacaccacccctaccgccgccttcgccgacgtcgccggcggtggcttcgagccgctcaacgccgacgacgtgcgctcctacctgcacaagtccgtcgacttcatctacgactactacaagtccgtggagtctctgcccgtgctgccgggcgtggagccgggctacctgcgccgcctgctgcagtccgtgccgcccacctcctccgcgcccttcgacattgccctaaaggaggtccgcgacgccgtcgtgcccgggatgacccactgggccagccccaacttcttcgccttcttcccgtccaccaacagcgccgccgccatcgcgggcgagctcatcgcctccgccatgaacaccgtcggcttcacctggcaggccagccccgcctccaccgagatggaggtgctcgcgctcgactggctcgcgcagctcctgcgcctgccgcccaccttcatgaaccgcaccgccgctgcagggcgcgggaccggcggtggcggcgtcatcctcggcaccaccagcgaggccatgctcgtcacgcttgtctccgcgcgcgacgccgccctgcggagggcaggctccgtcggggtcgctgggatcaccaggctcgccgtctacgccgccgaccagacgcactccaccttcttcaaggcgtgccgcctcgccggcttcgacccggccaacatccgctccatccccaccggcccggagacggactacgccctcgacccggcgaggctgctcgaggtcatgcaggccgacgtggacgccggcctcgtgcccacctacgtgtgcgccacggtcggcaccacgtcgtccaacgcggtcgacccggtcggagccattgccgatgtcgccgccgtgttcaacgcctgggtccacatcgacgccgcctacgccggcagcgcgtgcatctgcccggagttccggcaccacctggacggcgtggagcgcgtggactccatcagcatgagcccgcacaagtggctcatgacgtgcctggattgcacgtgcttgtgggtgcgggacacgcaccggctcaccgattctctcgaaaccaacccggagtacctcaagaacgacgccagcgagtccggcaccgtcaccgacctcaaggacatgcaggtcggcgtcggccgccgcttccgcgggctcaagctctggatggtcatgcgcacctacggctccgccaagctccaggagcacatccggagcgacgtcgccatggccaagatgttcgaggacgccgtgcgtgccgaccaccgcttcgaggtcgtggtgccgaggaacttcgcgctcgtgtgcttcaggatcaggccacagggcaccgacttgacggaggaggacgccgacgtggtcaaccgtgagctaatggagcgcctgaacaggacgggcaaggcgtacctggcgcacacggcgatcggcggcaagttcgtgctgcggttcgcggtggggtcgtcgctgcaggaagagaggcacgtgcgaagcgcgtgggagctcatcaagaagacgaccaccgagatcttcgaggaagagacgatgtagagagtattactatagattatcgtcattcttatttattgattgatgcagctggactaataaatatggttatgcatgccaatcgaaaggtgacgtccaataaagcctttcgtgatgcatatatattcatgcaagaaatttatgtacgttggacctggagtatataacaatgtattatttatgggctataatatatgaacttggctagcttct

SEQ ID NO: 1867 - DNA, 2043 bp, Pennisetum glaucum
cggccggacgcgtcgtcgtcctccttcctcagaagcacgaatcagcgcagcagctcgatcagctagcttgcttactcgagcttgcgagtctcatatcgatcgtcctcgccggcagctccattaataaccatcaccatcaccaagcaaccaattaatcgatctcaagcaagaacatgggcagccttgacagcaaccccgtcaccttcgacgcgttcgccgccgagggcgccgacgggggcttccagccgctcgacgccgacgacgtccgctcctacctccacaagtcggtcgacttcatctacgactactacaagtccgtcgagtccctgcccgtgctcccgggcgtcgagccggggtacctccgccgcctgctgcagtccgcgccgcccagcgccgccgcgcccttcgacattgctatgcaggaggtccgggaggccgttgtccccgggatgacccactgggccagccccaacttcttcgccttcttccctgccaccaacagcgccgccgccatcgccggcgagctcatcgcctccgccatgaacaccgtcgggttcacgtggcaggccaacccggccgccaccgagatggaggtgctcgcgctcgactggctcgcgcagctcctccgcctcccgtcgagcttcctcatgcaccaccgcggcgccgacgacggcgaggagcgccgcggcaccggcggcggcgtcatcctcggcaccaccagcgaggcgatgctggtcacgctcgtcgccgcccgcgacgccgcgctgcgccgcatggggtccagcggcgtcgccgggatcacgcggctggtcgtctacgccgccgaccagacccactccaccttcttcaaggcgtgccgcctcacgggcttcgacccggccaacatccggtccatccccaccgccgccgacacggactacggcctcgacccggagaagctgctcgaggccatgcgcgccgacgccgacgccggcctcgtgccgacctacgtctgcgccaccgtcggcaccacgtcgacgaacgccgtcgacccggtgggcgccgtcgccgacgtcgcggccctcttcaacgcgtgggtccacgtcgacgccgcctacgccgggtccgcctgcatctgcccggagttccggcaccacctcgacggcgtggagcgcgtggactccatcagcatgagcccgcacaagtggctcatgacgtgcctcgactgcacctgcctgtgggtccgcgacgcgaaccgcctgaccgactccctggagaccaacccggagtacctcaagaatggcgccagcgactccggcaccgtcaccgacctcaaggacatgcaggtcggcgtcggccggcgcttccgcgggctcaagctctggatggtgatgcgcacctacggcgccgccaggctccaggagcacatccgcagcgacgtcgccatggccaagacgttcgaggaatgggtccgcgccgacgaccggttcgaggtcgtcgtgccgaggaacttcgcgctggtgtgcttcaggatgaagccgacgacggcggaggaggaggaggaggccgccgccgaggcggcgaaccgtgagctcatggagcggctgaacaggaccgggaaggcgtaccttgcgcacacggtggtcgggggcaggttcgtgctgcggttcgcggtggggtcgtcgatgcaggaggagaggcacgtgcgaagcgcgtgggagctcatcaggaagacggccgcggagatcgtggaggaggagggggagaagaagcgcgcgcgtggttgatcgtatttgttctgacattgttgatcctcttgcagatgatattattggagagtgtgtgtttgttgtttttgttgcaacttgcaagaggtagcagagtgcagagacgacgacgacggtggtcgtcgaataaaacccttcttcccgggggtgtgtttgaacgaaccaattaaacagctctggatttttgttcatgcatcgatccatgtagtactatctcgagattgtgtgtacgtagtacgtgtatgtattcaataaattattatttcgtttcccgtgg

SEQ ID NO: 1868 - DNA, 1723 bp, Sorghum bicolor
tcactactcaatccattgaccgatcgacatgggcagccttgacaccacccctaccgccaccgccaccttcgccgacatcaacggcagcggcggtttccagccactcaacgccgacgacgtgcgctcctacctccacaagtccgtcgacttcatctacgactactacaagtccgtcgagtcactccccgtgctcccaggcgtggagccaggctacctacggcgactgctgcagtcagtaccacccacctcctccgcgcccttcgacattgccctaaaagaggtccgcgacgccgtcgtcccggggatgacccactgggccagcccaaacttcttcgccttcttcccggccaccaacagcgccgccgcgatcgcgggcgagctcgtcgcctccgccatgaacaccgtcggcttcacctggcaggccaaccccgccgccaccgagatggaggtcctcgcgctcgactggctcgcccagctcctccgcctcccgtccaccttcatgaaccgcaccgctgccgcgggacgtgggtctggtggtggcgtcatcctcggcaccaccagcgaggccatgctcgtcacgctcgtcgccgcgcgtgacgccgccctgcgccggagtggatccgttggcgtcgctggcatcactagcctcgccgtctacgccgctgaccagacccactccaccttcttcaaggcgtgccgcctcgccggctttgatccggccaacatccgctccattgccaccggaccggagaccgactacgcccttgatccggcgaagctgctcgagatcatgctggccgacgtcgacgccgggctcgtgccgacatacatctgcgccacggtcggcaccacgtcgtcgaacgccgtggaccctgtcggagccatcgccgatgtcgccgccatgttcgacgcgtgggtgcacatcgacgcggcctacgccggcagcgcgtgcatctgcccggagttccggcaccacctcgccggcgtcgagcgggtggattccatcagcatgagcccgcacaagtggctcatgacatgcctggactgcacgtgcctgtgggtgcgcgacgcgcaccggctcaccgactcgctggagaccaacccggagtacctcaagaacgacgccagcgagtccggcaatgtcaccgacctcaaggacatgcaggtcggcgtcggccgccgcttccgggggctcaagctctggatggtcatgcgcacctatggcgccgccaagctccaggagcacatccggagcgacgtcgccatggccaagatgttcgaggaagccgtgcgcgccgacgaccggttcgaggtcgtggtgccgaggaacttcgcgctcgtgtgtttcaggatcaggccggaaggcgccatgacggaggaggacgccgaggaggtcaaccgtgagctcatggagcggctgaacaggaccgggaaggcgtacctggcgcacacggtggtcggcggcaagtttgtgctgaggttcgcggtggggtcgtcgctgcaggaggagaggcacgtgcgaagtgcgtgggagctcatcaagaagacgaccaccgagatcatggaggaagctagagatgtagtagagaattaatgttacaattgattattattcttatttatttttgttggattaataaatatttgtgatgccaatcgaaaggtggtggtgtcgaataaagcctttcgttatgcatgtatgtgcaagaaatatatgtatgtt

SEQ ID NO: 1869 - DNA, 1768 bp, Brachypodium distachyon
ctcactgacatgggcagcctcgactcgaccccggccaccgccttcgctgccatcgtcgacgataaggcggagccattccagccgctcaacaccgacgatgtcagggcctacctccacaaggccgtcgacttcatcaccgactactacaccaacgtcgagtccttccccgtgctccccaacgtcaagccggggtacctccaggacatgctcacgtcctccccgccgtcgcactcggctcccttcgacgtcgccatgaaggagctcaggacctccgtggtgcccggcatgacccactggcagagccccaacttcttcgccttcttcccttccaccaacagcgccgccgccatcgccggggagctcattgcttccgccatgaacactgttgggttcacgtggcaggcggccccggccgccacggagatggaggtgctcgcgcttgactggctcgcccagctcctccgcctgccgacgacgttcatgaaccggacgagctccggccgtggcaccggtggcggcgtcattcttggcaccacgagcgaggccatgctcgtcacgctcgtcgcagcccgtgacgccgcgctgaagaggatcggctctaatggagttgctgggatcacgaggctggctgtgtacgctgctgaccagacccactccacgttcttcaaggcgtgccgtctcgccggcttcgacccggccaatatccggtctatccccaccggggcggagacagattatgggctcgacccggcgaagcttctcgaggtcatgcaggctgatgtggacgccggcctcgtgccgacgtacgtctgcgccaccgtgggcaccacctcctccaacgcggttgacccggtcggcgctgtcgccgatgtcgccgccatgtttaatgcctgggtccacgtggatgccgcttatgctggcagcgcgtgcatctgcccggagttcaggcaccacattgacggtgtcgagcgtgtggactccatcagcatgagcccgcacaagtggctgatgacatgtctagactgcacgtgcctttatgtccgtgacgtgcaccgcctgagcgactcgttggagactaaccctgagtacctgaagaacgacgtcaccgactccggcgaggtcactgacctcaaggacatgcaggtcggcgtcgggcggcgcttccgtgggctcaagctctggatggtcatgcgcacctatggcaccgctaagctccaggagcacatacgcagcgacgttgccatggccaagatgttcgaggactttgtttgcgccgatgacaggttcgaggtggtcgtgccgaggaactttgctctggtgtgcttcaggatcaaggcgaatggtgccatgaccgaggaatacgccgacgagttgacccgcgagctcatggagaggctcaacaagaccggcaaggcgtatctcgcacacacagtggtgggtggcaggttcgtgctccggttcgctgtgggctcatcattgcaagaggagcgacacgtgcgaagcgcgtgggagctcatcaagaaaaccaccaccgagatcatagaggaagcggagcactagatgaccaatcgactgcaatatgcccgtttgattaattaattattgtttgtttggagtaataagtttggattgtctatagctcgttcgacttgaaaatagttatttctccatcgtcgttgatagccgtccaatcaaatcctctcatgacgatttttaacggtgacttaggaatagtcgttattttccagttgccgaagaaatagcaaag

SEQ ID NO: 1870 - DNA, 1560 bp, Sorghum bicolor
atgggcagcttggacaccaaccctaccgccttctctgccttcggtgacgacgtctcctccggcttccagccgctgaaccccgacgacgtccgctcctacctccacaaggccgtcgacttcatctccgactactacaagtccgtcgagtcactccccgtgctgcccgacgtcaagccggggtacctacgcgaccagctgcggtccgcgccgcccacgtcctccgccccgttcgacgtcaccatgaaggagctcaccgcctccgtcgtccccggcatgacccactgggccagccccaacttcttcgccttcttccccgccaccaacagcgctgcggccatcgccggcgacctcatcgcgtccgccatgaacaccgtggggttcacatggcaggccgcgccggcagccaccgagatggaggtcctcgcgctcgactggctcgcgcagctcctacgcctgccgtccagcttcatgaaccgcaccggcgctgcagggcgcggcaccggtggtggcgtcatcctcggcaccaccagcgaggccatgctcgtcacgctcgtcgccgcgcgtgatgccgcactgcgccggagtggctcccacggcgtgtccgggctgccgcgcttggccgtgtacgccgccgaccagacccactccaccttcttcaaggcctgccgcctcgccggcttcgaccctgccaacatccgctccatccccaccggcccggagacggactacgccctcgacccggcgaggctgctcgaggtcatgcgtgccgacgtcgaggctggcctcgtgccgacctacgtctgcgccaccgtcggcaccacgtcgtccaacgccgtcgactctgtcggagccattgccgatgtcgccgcggtgttcaaagcctgggtccacatcgacgcagcgtacgccggcagcgcgtgcatctgcccggagttccggcaccacctcgacggcgtggagcgcgtcgactccatcagcatgagcccacacaagtggctgctcacatgcctcgactgcacgtgcctgtgggtgcgcgacacgcaccggctcaccgactcgctggagacgaacccggagtacctcaagaacgacgccagcgagtccggcaacgtcaccgacctcaaggacatgcaggtcggcgtcggccgccggttccgggggctcaagctctggatggtcatgcgcacctatggcgccgccaagctccaggagcacatccggagcgacgtcgccatggccaagatgttcgaggacgccgtgcgcggtgacgaccggttcgaggtcgtcgtgccgaggaacttcgcgcttgtgtgcttcaggatcaagccccatggcggcggcatgacggaggaggacgccgacgaggccaaccatgagctcatggagcgcctcaacaggaccgggaaggcgtacctggcgcacacggtggttggcgacaggtttgtgctgcggttcgccgtgggttcgtcgctgcaggaggagaggcacgtccggagcgcgtgggagctcatcaacaagaccaccagtgagatcatgcaggaacacatcgctgtggagtag

SEQ ID NO: 1871 - DNA, 2162 bp, Zea mays
cgtcgccggagatcgcatgccagcgcgcgacacgacggcgcatggcaattgaccgcctgacttgactagctcgccgcgcccctttgccagattgccagttgccacagccaattctcttctcctaccaacgtcgtcttcgtcacccacgagcagcagcagtcgcacgtacgaccacgccgacgccctcgtccccacgccactcccttgctgccttgcctcctcctccacctgcatgcctatatatcccaaccctaacttctgccttcttccccaccaaaccccacggagctcgatctgcagccttcgatctgtcagtgtccactgaccagtcagctgcagctcgcaggctcgtagccgctagctcgacctctaggctctagctccaacttccccgctgtgttaatctagcgatcggcaagtcatgggcagcttggacaccaatcctaacgccttctccgccttcggcgtcgacgccaccaccggcttccagcccctccaccccgacgacgtccgcgcctacctccacaaggccgtcgacttcatctccgactactacaagtccgtcgagtcactgcccgtgctgccggacgtcaagccagggtacctgcggcagcagctaaggtccgcgccgcccacgtcctccgccccgttcgacgtcaccatgaaggagctgacggactccgtcgtccccggcatgacccactgggccagcccaaacttcttcgccttcttcccgtccaccaacagcgccgcggccatcgccggcgacctcatcgcgtccgccatgaacaccgtcggcttcacgtggcaggccgcgccagccgccacggagatggaggtcctcgcgctcgactggctcgcgcagctcctgcgcctgccgcccagcttcatgaaccgcaccggcgcagctgggcgcggcaccggcggcggcgtcatcctcggcaccactagcgaggccatgctcgtcacgctcgtcgccgcgcgtgacgccgccctccgccggactggctcccagggcgtgtccggccttccgcggctggctgtctacgccgccgaccagacgcactccaccttcttcaaggcgtgccgcctcgccggcttcgacccggccaacattcgctccatccccaccggccccgagacggactacgccctcgacccggccaggctcttcgaggtcatgcaggccgacgtcgacgccggcctcgtgccgacctacgtctgcgccacggtcggcaccacgtcgtccaacgccgtcgacccggtcggagccattgccgacgtcgccgccgtgttcaacgcctgggtccacatcgacgccgcctacgccggtagcgcgtgcatctgcccggagttccggcaccacctggacggcgtggaacgcgtcgattccatcagcatgagcccgcacaagtggctcttgacgtgcctggactgcacgtgcttgtgggtgcgcgacacgcaccggctcactgactctctcgagaccaatccggagtacctaaagaacgacgccagcgactccggcaacgttaccgacctcaaggacatgcaggttggcgtcggccgccggttccgggggctcaagctctggatggtcatgcgcacctacggcgcggccaagctccaggagcacatccggagcgacgtcgccatggccaagatgttcgaggacgccgtgcgctccgacaaccggttcgaggtcgtggttccgaggaactttgctctcgtgtgcttcaggatcaagccccatggtggcggtataatgacggaggaggacgcggacgaggccaaccgtgagctcatggagcgcctcaacaggaccgggaaggcttacctcgcgcacacggtggtcggcgacagatttgtgctccggttcgccgtcggttcgtcgctgcaggaggagaggcacgtccggagcgcgtgggagctcatcaacaagaccaccactgagatcatgcagaaataataaattaaattaaattaaatttattatatgcaagtatatacaaaaatagtagtatcataaatttaatacatgcaagtatatacgtatagtagtccatgagggaattttacttttattgatatgtttgattctttgttgtttgcccaaaggaggaataataaagccgatcaaagaaatattttgtccagagaag

SEQ ID NO: 1872 - DNA, 1536 bp, Zea mays
atgggcagcttggacaccaaccctgccgccatgtccgccttgggcgacaacgcctgctccggcttccagccgctgaacccggacgacgtccgctcctacctccacaaggccgtcgacttcatctccgactactacaagtccgtcgagtcactgcccgtgctgcccgacgtcaagccggggtacctacggaacgagctgcagtccgcgccacccacgtcctccgccccgttcgacgtcaccatgaaggagctcaccgcctccgtcgtccccggcatgacccactgggccagccccaacttcttcgccttcttcccgtccaccaacagcgctgcgaccatcgccggcgacctcatcgcctctgccatgaacaccgtcggcttcacgtggcaagccgcgcccgccgccaccgagatggaggtcctcgcgctcgactggctcgcgcagcttctgcgcctgccgcccagcttcatgaaccgcaccggcggggctgcgcgtggctccggcggcggcgtcatcctcgccaccaccagcgaagccatgctcgtcacgctcgtcgcggcgcgtgacgccgcgctgcgtcggagcggctcacacggcgtgtcccagctgccgcgcttggccgtgtacgccgcggaccagacgcactccaccttcttcaaggcgtgccgcctcgccggcttcgaccccgccaacatccgctgcatccccaccggcccggagacggactacggcctcgacccggcgaggctgctcgaggtcatgcaggccgacgtcgacgccggcctcgtgccgacctacgtctgcgccacggtcggcaccacgtcgtccaacgccgtcgaccctgtgcgagccattgccgatgccgccgccgtgttcaacgcgtgggtccacatcgacgccgcgtacgctggcagcgcgtgcatctgccctgagttccggcaccacctcgacggcgtggagcgcgtggactccattagcatgagcccgcacaagtggctcatgacgtgtctggactgcacgtgcctgtgggtgcgcgacacgcaccggctcaccggctcgctggagaccaacccggagtacctcaagaacgacgccagcgagtccggcaacgtcaccgacctcaaggacatgcaggtcggcgtcggccgccgcttccgggggctcaagctctggatggtcatgcgcacctacggcgcctccaagctgcaggagcacatccggagtgacgtcgccatggccaagatgttcgaggacgccgtacgcgctgacgaccggttcgaggtcgtggttccgaggaacttcgctctcgtgtgcttcaggatcaagccccgtggtggcatgacggaggaggacgccgacgaggtcaaccgtgagctcatggagcgcctcaacaggaccgggaaggcgtacctggcgcacacggtggtaggcggcaggttcgtgctgcggttcgccgtcggttcgtcgctgcaggaggagaggcacgtccggagcgcgtgggagctcatcaacaagacaaccaatgagatcatgctg

SEQ ID NO: 1873 - DNA, 1564 bp, Zea mays
aatgggcagcttggacaccaaccctgccgccatgtccgccttgggcgacaacgcctgctccggcttccagccgctgaacccggacgacgtccgctcctacctccacaaggccgtcgacttcatctccgactactacaagtccgtcgagtcactgcccgtgctgcccgacgtcaagccggggtacctacggaacgagctgcagtccgcgccacccacgtcctccgccccgttcgacgtcaccatgaaggagctcaccgcctccgtcgtccccggcatgacccactgggccagccccaacttcttcgccttcttcccgtccaccaacagcgctgcgaccatcgccggcgacctcatcgcctctgccatgaacaccgtcggcttcacgtggcaagccgcgcccgccgccaccgagatggaggtcctcgcgctcgactggctcgcgcagcttctgcgcctgccgcccagcttcatgaaccgcaccggcggggctgcgcgtggctccggcggcggcgtcatcctcgccaccaccagcgaagccatgctcgtcacgctcgtcgcggcgcgtgacgccgcgctgcgtcggagcggctcacacggcgtgtcccagctgccgcgcttggccgtgtacgccgcggaccagacgcactccaccttcttcaaggcgtgccgcctcgccggcttcgaccccgccaacatccgctgcatccccaccggcccggagacggactacggcctcgacccggcgaggctgctcgaggtcatgcaggccgacgtcgacgccggcctcgtgccgacctacgtctgcgccacggtcggcaccacgtcgtccaacgccgtcgaccctgtgcgagccattgccgatgccgccgccgtgttcaacgcgtgggtccacatcgacgccgcgtacgctggcagcgcgtgcatctgccctgagttccggcaccacctcgacggcgtggagcgcgtggactccatcagcatgagcccgcacaagtggctcatgacgtgcctggactgcacgtgcctgtgggtgcgcgacacgcaccggctcaccggctcgctggagaccaacccggagtacctcaagaacgacgccagcgagtccggcaacgtcaccgacctcaaggacatgcaggtcggcgtcggccgccgcttccgggggctcaagctctggatggtcatgcgcacctacggcgcctccaagctgcaggagcacatccggagtgacgtcgccatggccaagatgttcgaggacgccgtacgcgctgacgaccggttcgaggtcgtggttccgaggaacttcgctctcgtgtgcttcaggatcaagccccgtggtggcatgacggaggaggacgccgacgaggtcaaccgtgagctcatggagcgcctcaacaggaccgggaaggcgtacctggcgcacacggtggtaggcggcaggttcgtgctgcggttcgccgtcggttcgtcgctgcaggaggagaggcacgtccggagcgcgtgggagctcatcaacaagacaaccaatgagatcatgctggaaccggaacagatcgttgtggagtag

SEQ ID NO: 1874 - DNA, 1890 bp, Brachypodium distachyon
accaaaccaccaaagctagcaattgccaattcactagctccagctctctcctctgccttgccttagctagctagctcatcaactagcttcgtcttcctcatcctctccggccaacgctaagacaagcttcctgctagctcctacgtgctagctagctaaacctgcaaaggagacatgggcagcatcgacaccaaccccacggccttctccgccttccccgacgacgacaagccgttccagccgctcaacaccgacgatgtccgggcttatctccacaaggccgtggacttcatctctgattactacaccaacgtcgagtccatgcctgtcctccccaacgtcaagccggggtacctccaggaccagctcagcgcatctccgccgacatactcggctccctttgatgtcaccatgaaggagatccgcaactccgttgtccccggcatgacccactgggccagccccaacttcttcgccttctttccgtcgacgaacagcgccgccgccatcgccggtgacctcatcgcctctgcgatgaacactgtgggattcacgtggcaggccgcccctgccgctaccgagatggaggttctcgcgctcgactggctcgcgcagctcctccgcctgccgacgaccttcatgaaccgcacgagctccggtcgtggaaccggtggtggcgtcattcttggcaccaccagcgaggccatgctcgtcacgcttgtcgctgcccgtgatgccgctctacgccggagcggttcgattggtgtgtctggcctgcctaaattggcggtctacgccgccgaccagacccactccactttcttcaaggcgtgccgtctcgccggtttcgaccccgccaacatccgctccatccgcaccgggccagagaccgactatggcctcgacccggtgaggcttcttgaggtcatgcaggccgatgtcgatgctggtctcgtgccaacatatgtttgtgccaccgtcggcaccacctcctccaacgccgtcgaccccgtgggcgccgttgccgatgttgccgccatgttcaacgcgtgggtccatgttgatgctgcctacgctggcagcgcgtgcatctgcccggagttcaggcatcatctcgatggcgtggagcgtgtggactcgatcagcatgagcccacacaagtggctgatgacttgtctagactgcacatgcctctatgtccgtgatgctcaccgactgagtgacgcgctggagacgaaccccgagtacctcaagaatgatgtcacggactctggggaggtcacggacctcaaggacatgcaggtcggtgtgggacgacgcttccgtggtctcaagctctggatggtgatgcgcacctatggcaccgcgaagctccaggaacacatccgcagcgacgtcgccatggccaagatgttcgaggacctcgtccgtgatgacgaccggttcgagatcgtcgtgccgaggaactttgctctcgtgtgcttcaggatcaagacgaacggaagcatgacggaggaggaagctgacgaggccaaccgtgtgctcatggagaacctgaacaagaccggcaaggcataccttgcccacactgtggtcggcgacaggtttgtgctccggtttgcggtggggtcatcgctgcaggaggagaggcacgtgaggagtgcatgggagctcatcaagaagacaaccagcgagatgatggattaggtggatcgaggggtctatagagtatagaaacgatattccaaaaaaatcacacaaatacacaccctgcatttagggtacacaagttttttttttgggcgtgagcccatattcattttgtgagatatacagggctcgtttatgccagaaatattgatttgataataaaagaattctatttatatg

SEQ ID NO: 1875 - DNA, 1881 bp, Brachypodium distachyon
accaaattaaccaagcaaatctagctagagccagagcgaccaagctagctagagagccatcctccagctcattaagctagtagccaattaagctctctccgagcttctcttcttgctttcttgctcctaagtgcttaaaacctgcaaaagagatcgacatgggcagcatcgacaccaaccccaccgccttctccgccttccccgacgacgacaagtcgttccagccgctcaacaccgatgatgtccgggcctatctccacaaggccgtggacttcatctccgattactacaccaacgtcgagtccatgcctgtcctccccaacgtcaagccggggtacctccaggaccagctcagcgcctctccgccgacctactcggccccttttgatgtcaccatgaaggagatccgcaactccgttgtgcccggcatgacccactgggccagccccaatttcttcgccttctttccgtcgacaaacagcgccgccgccatcgccggtgacctcatcgcctctgccatgaacaccgttgggttcacgtggcaggcggctccggccgcgacggagatggaggtgctcgcgcttgactggctcgcgcagctcctccgcctgccgacgaccttcatgaaccgcacaagctccggccgtggcaccggtggtggtgttattcttgggacgaccagcgaggccatgctcgtcacgcttgtcgctgcccgagacgccgccctacgccggagtggctctgttggcgtgtccggcctgcctaaattggcggtctatgctgccgaccaaacccactccacgttcttcaaggcgtgccgtctcgccggcttcgaccctgccaacatccgctccatccccaccgggccggagaccgactacggccttgacccggtgaggcttcttgagatcatgcaggccgatgtcgatgctggtctcgtgccaacatatgtttgtgccaccgtcggcaccacctcctccaacgccgtcgaccccgtgggtgccgttgccgatgttgccgccatgttcaacgcatgggtccatgtcgatgctgcgtacgccggcagcgcatgcatctgcccggagttccgacaccatcttgatggtgtcgagcgtgtggactccatcagcatgagcccacacaagtggctgatgacgtgtctagactgcacatgcctctatgtccgtgatgctcaccgactgagtgacgcgctggagacgaaccccgagtacctcaagaatgatgtcacggactctggggaggtcactgacctcaaggacatgcaggtcggtgtgggacgacgtttccgtggtctcaagctctggatggtgatgcgcacctatggcactgccaagctccaggagcacatccgcagcgacgtcgccatggcaaagatgtttgaggacctcgtccgcgccgatgaccggttcgagatcgtcgtcccaaggaactttgctctggtgtgcttcaggatcaaggcaagtggagtcatgacagaggacgacgccgatgaggccaaccgcgttctcatggagaacctgaacaagaccggcaaggcttaccttgcgcacacggtggtcggcgacaggttcgtgctccggttcgccgtggggtcatcactgcaggaggagaggcacgtgaggagtgcatgggagctcatcaagaagacaaccagcgagatgatggattaagttgaggggtctttagaggatagaaacaaatattccaaaaagacacaaatatacaccctgcatttagggtacacattttcttaatttgattttttcagtttggcgcgtgagcccctatcattttgtgaccattacagagggcttgttatgcctgtgatatttatttgacaataaaaggactattctattt

SEQ ID NO: 1876 - DNA, 1793 bp, Brachypodium distachyon
ctagcttcttctagctttctcccacacaagtgctaagttgctaacaaattcaagttgctaagagcttctcttcttgctttcttgctcctaagtgcttaaaacctgcaaaagagatcgacatgggcagcattgacaccaaccccacggccttctccgccttccccgacgacgacaagtcgttccagccactcaacaccgatgatgtccgcgcctatctccacaaggccgtcgacttcatctctgattactacaccaacgtcgagtccatgcccgtgctccccaacgtcaagccggggtacctccaggaccagctcagcgcctctccgccgacttactcggctcccttcgacgtcaccatgaaggagatccgcaactccgttgtccccggcatgacccactggcagagcccaaacttcttcgccttcttcccttccaccaacagcgccgccgccatcgccggtgatctcatcgcctccgccatgaacaccgtcgggttcacgtggcaggccgcccctgctgccactgagatggaggtgctcgcgctcgactggcttgcccagctgctccgcctgccaaccaccttcatgaaccgtacgagctctggtcgtggaaccggcggtggcgtcatcctcggcactactagtgaggccatgcttgtcacgctcgtcgctgcccgtgacgccgctctacgccggagcggttctgtcggcgtctctggcctgcctaaattggcggtctacgccgccgatcagacccactccacgttcttcaaggcatgccgtctcgccggctttgaccccgcccacatccgctccatccctaccgggccggagaccgactacggccttgaccccgtgaagcttctcgagatcatgcaggccgatgtcgatgctggcctcgtgccgacatatgtctgtgccactgtcggcaccacctcctccaacgccgtcgatccggtgggcgccgtcgccgatgttgctgccatgttcaacgcgtgggtccacgtcgatgctgcctatgctggcagcgcgtgcatctgccccgagtttcggcaccatctcgatggtgtggaacgtgtggactccatcagcatgagcccacacaagtggctcctcacctgtctcgactgcacatgcctctatgtccgagatgctcaccgactgagcgacgcgctggagacgaaccccgagtacctcaagaatgatgtcacggactctggggaggtcactgacctcaaggacatgcaggtcggcgtgggccgccgcttccgtgggctcaagctatggatggtcatgcgcacctacggcaccgccaaactccaggagcacatccgcagcgacgtcgccatggccaagatgttcgaggacctcgtcggcgccgatgatcggttcgagatcgtcgtgccgaggaacttcgctctcgtgtgcttccgaatcaaggcaagtggtgccatgacggaggaagacgccgacgaggtgacccgtgagctcatggagcggctcaacaagaccggcaaggcttacctggcgcacacggtggtcggcggtaggttcgtgctccgcttcgcggtggggtcgtcactacaggaggagaggcacgtgaggggcgcgtgggagctcatcaagaagacaaccactgagatgatggattaacttagagctgagacttcaacgaactacgaggacacacagatccatacattttgggcaaaaccattcttttccattttcattttgtttcgattattgtttgtaattcaatccaaataattaactattttgattctacttgaa

SEQ ID NO: 1877 - DNA, 1649 bp, Zea mays
gtaggtcagataacgagcatcaggtcaaagaaacagacatgggcagcctttccggcacctcttcgtccttggccgctgcgttcgacgccgactccgagcgcttccagccgctgaacgccgacgacgtccgctcctacctccacaaagccgtggacttcatctacgactactacaagtccgtggagtccgtccccgtgctcccgagcgtcgagccgggttacctggcccgccagctcaagtccgcgccgccgaacgccgccgcgccgttcgacgtcgccatgcacgagctccgcgaggccgtggtgccggggacgacgcactgggccagccccaacttcttcgccttcttcccggcgaccaacagcgcggcggccatcgccggggagctcgttgcctccgcgatgaacaccgtcgggttcacctggcaggccaacccggcggccgcggagctggaggcgctcgcgctcgactggctcgcgcagctcctcctcctgccggacagcttcatgaaccgcccctgcagcgctgtcgtcgccggccgaggcgcaggcactagaggcggcggcgtcatcctcggcaccaccagcgaggcgatgctggtcacgctcgtggcggcccgcgacgccgccctgcgccggagcggctccgacggcgtggccgggatcacgcggctgaccgtgtacgcagccgaccagacgcactccaccttcttcaaggcctgccgcctcgccggcttcgacccggccaacgtcaggtcgatccccaccggcgccgacaccgactacgcgctcgatccggcaaggcttctcgaggcgatgcggcgcgacgccggcgccgggctcgttccgacgtacgtgtgcgtcacggtcggcacgacgtcgtcgaacgcggtcgacccggtgggcgccgcggccgacgccgccgccgagttcggcgcgtgggtgcacgtggacgccgcctacgccggcagcgcctgcatatgcccggagttccggcaccacctcgacggcgtggagcgcgtggactccctcagcctgagcccgcacaagtggctgctcacgtgcctggactgcacctgcctctgggtgcgcgacacgcgccgcctcaccgactccctagagacgcgcccggagtacctgcggaaccacgccaccgagtccggtgccgtcaccgacctcaaggacatgcaggttggcgtcggccgccgcttccgcggactcaagctctggatggtcatgcgcacgtacggcgccgccaagctccggcagcacatccgcagcgacgtggccatcgcaaaggtgttcgaggagtccgtgcgcgcggaccaccggttcgaggtggttgtcccgaggaacttcgcgcttgtctgcttcaggatcaggccgagcgccaccgccagcatgacggaggaggacgccgaggtggccaatcgggagctcatggagcggctgaacaaaagcgggagggcgttcctggccaacaccgtgatcggtggcaagttcgtgctgaggttcgcggtggggtccacgctacaggaggagaggcacgtgcggaacgcgtgggatctcattaagatgaccacaaccgagatcataaacggagaggtggattaagcctgtttgttaaccttggtcttgttttctaggatt

SEQ ID NO: 1878 - DNA, 1917 bp, Hordeum vulgare
aattaccaccacaaacctttccggccggcagcaaacctagctaccttccccttgtttaactaagccaagcttcgctgcttcccaccggcttgctcctaaaaaatgggcagcttggacgccaacccaatgacgaccttctccgccttccccgacgacaaggcggcgttcgagccgctcaaccccgaagatgtccgtgcataccttcacaaggccgttgatttcatctccgactactacaccaacgtcgagtccatgcccgttcttcctaacgtgaagccgggatacctgcaagatgagctcaccgcgtccccgccgacccactccgcgccgttcgacgtcaccatgaaggagctcaggacctccgtcgtccccggcatgacgcactgggctagccccaacttcttcgccttcttcccctccaccaacagcgccgcagccatcgccggcgacctcatcgcctcggccatgaacaccgtcggattcacgtggcaagcctcgcctgcagccaccgagatggaggtcctcgctctggactggcttgcgcagctcctgcgcctgcccaccaccttcatgaatcgcaccagcactggtcgtggcaccggcggtggtgtcatcctcggcacaacgagcgaggcaatgcttgtcacgctagttgccgcccgtgatgcagcactgcgtcgaagcggctctgtcggcgtgtctgacatcccacgcttggctgtgtatgctgccgaccagactcactccacgttcttcaaggcgtgtcgccttgcaggcttcgaccccgccaacattcgctccatctctactgggccggaaacaaactatgggctcgacccaaccaagcttctcgaggtcatgcaagctgatgccgacgccggtcttgtgccaacatatgtttgcgccaccgtgggcaccacgtcttccaatgccgtcgacccggtgggcgccgttgccgatgttgccgccatgttcaatgcgtgggtccatgtcgatgctgcttacgctggcagcgcgtgtatctgcccggagtttcgccaccatctcgacggtgtcgagcgcgtggactccattagcatgagcccacacaaatggcttctcacgtgcctcgactgtacatgtctctatgtccgtgacgctcaccgactgagcgactcattggagaccaacccggagtacctcaagaacgacgtcacggattccggtgaggtcaccgatcttaaggacatgcaggtcggtgtcggccgacgcttccgtggtcttaagctttggatggtcatgcgcacctacggtaccgcaaagctccaagagcacatccgtagtgacgtcgccatggccaagatgtttgaagattccgtccgtgccgacaacaggtttgaagtggtcgtgccgaggaactttgctcttgtgtgctttaggatcaaggcaaggggagacatgacggaggaggatgccgacgaggtcaaccgccttctaatggagaatctaaacaagactggcaaggcttatcttgcgcacaccgtggtcggtgacagatttgtgcttcgttttgctgttgggtcatcgctgcaggaggagaggcatgtgagaagtgcatgggacctcatcaagaagactaccagcagtatcatggattaagtgcactgaccaactgttcagggagctatacaaatccctatatttaggggacaactattattttatttttttcctttgattctgattattatttatttagacatgtggttcttattcctttttgtgatctataacgaccgagggtctatatatatatagcaggccggtaccaaagaagttgattatagactgtaaaaagactttgtattatagatcaagggtctatatatatagcaggccggcaccaaagaagttttttatattgaataaacatgagat

SEQ ID NO: 1879 - DNA, 1860 bp, Brachypodium distachyon
ctcaccaaaccaaagcaattgccaattaattcgatcactaatccatctcctctgccgaacaagctaattaacgagctctcttcgtcttcctcctctccggccgatctgccaattaagctagcttccagattgtcttctatctcgacatgggcagcatcgacactaaccccacggccttctccgcattccccgacgacgacaagtcgttccagccactcaacccggaagatgtccgtgcttatctccacaaggccgtggatttcgtctccgactactacaccaatgtcgagtccatgccggtgctccccaacgtcaagccggggtaccttcaggacgagctcagcgcctctccgccaacttactcggctcccttcgacgtcaccatgaaggagctccggacctctgttgtccccggaatgacgcattgggccagccccaacttctttgcgttttttccgtcgacaaacagcgccgccgccatcgccggtgacctcatcgcctccgccatgaacactgttgggttcacgtggcaggcggctccggccgccacggagatggaggtgctcgcgcttgactggctcgcacagctccttcacctgccgaccacgttcatgaaccgtacaagctcggggcgtggtaccggcggtggcgtcatcctcggcacgacgagtgaagccatgcttgtcacgctagtcgccgcccgtgatgccgctctacgccggagtggctccgtcggcgtctcgggcctgcctaaattggcggtctacgccgccgatcagacccactccacattcttcaaggcgtgccggctagccggctttgaccctgcccacatccgctccatccccactgggcctgagaccaactatggtctcgacccggcgaagcttctcgaggtcatgcaggccgatgtcgctgccggcctcgtgccaacatatgtttgtgcaaccgtcggcaccacctcctccaacgccgtcgaccccgtgggcgccgttgccgatgttgccgccatgttcaacgcatgggtacacgttgatgccgcctatgccggcagcgcttgcatctgcccagagttcaggcaccatcttgatggtgtggagcgtgtggactccatcagcatgagcccacacaagtggcttctcacctgcttggactgcacgtgcctctacgtgcgtgacgctcaccgcctgagcgactcactggagacgaaccccgagtacctcaagaatgatgtcactgactccggcgaggtcactgacctcaaggacatgcaggtcggtgtgggacggcgcttccgtgggctcaagctttggatggtcatgcgcacttacggcaccgccaagcttcaggagcacatccgcagcgatgttgccatggccaagattttcgaggacctcgtccgtgccgatgaccggttcgagatcgtggtgccgaggaactttgctctggtgtgctttaggataaaggcaagtggatccatgacagagaaggatgctgatgaggccaaccgcttgctcatggagagcctgaacaagaccggcaaggcgtaccttgcacatacggtgatcggcgagaggttcgtgcttcggttcgcagtggggtcatcgctccaggaagagaggcacgtaacaagcgcatgggaactcatcaagaagacaactagcgagatgctcgattaatcggaggggtcaatggagtagaaaccatattgcaaaacagacacagatatacaccctggatttagggtacacatgttcctaatttaatttttgattttttgtgcttgagcacctattcattttgtgagctatatatacagagggttttgtttatgcccacaatatttgtttgacaacaaaa

SEQ ID NO: 1880 - DNA, 1560 bp, Zea mays
atgggcagcctttccggcacctcttcgtccttggccgctgcgttcgacgccgactccgagcgcttccagccgctgaacgccgacgacgtccgctcctacctccacaaagccgtggacttcatctacgactactacaagtccgtggagtccgtccccgtgctcccgagcgtcgagccgggttacctggcccgccagctcaagtccgcgccgccgaacgccgccgcgccgttcgacgtcgccatgcacgagctccgcgaggccgtggtgccggggacgacgcactgggccagccccaacttcttcgccttcttcccggcgaccaacagcgcggcggccatcgccggggagctcgttgcctccgcgatgaacaccgtcgggttcacctggcaggccaacccggcggccgcggagctggaggcgctcgcgctcgactggctcgcgcagctcctcctcctgccggacagcttcatgaaccgcccctgcagcgctgtcgtcgccggccgaggcgcaggcactagaggcggcggcgtcatcctcggcaccaccagcgaggcgatgctggtcacgctcgtggcggcccgcgacgccgccctgcgccggagcggctccgacggcgtggccgggatcacgcggctgaccgtgtacgcagccgaccagacgcactccaccttcttcaaggcctgccgcctcgccggcttcgacccggccaacgtcaggtcgatccccaccggcgccgacaccgactacgcgctcgatccggcaaggcttctcgaggcgatgcggcgcgacgccggcgccgggctcgttccgacgtacgtgtgcgtcacggtcggcacgacgtcgtcgaacgcggtcgacccggtgggcgccgcggccgacgccgccgccgagttcggcgcgtgggtgcacgtggacgccgcctacgccggcagcgcctgcatatgcccggagttccggcaccacctcgacggcgtggagcgcgtggactccctcagcctgagcccgcacaagtggctgctcacgtgcctggactgcacctgcctctgggtgcgcgacacgcgccgcctcaccgactccctagagacgcgcccggagtacctgcggaaccacgccaccgagtccggtgccgtcaccgacctcaaggacatgcaggttggcgtcggccgccgcttccgcggactcaagctctggatggtcatgcgcacgtacggcgccgccaagctccggcagcacatccgcagcgacgtggccatcgcaaaggtgttcgaggagtccgtgcgcgcggaccaccggttcgaggtggttgtcccgaggaacttcgcgcttgtctgcttcaggatcaggccgagcgccaccgccagcatgacggaggaggacgccgaggtggccaatcgggagctcatggagcggctgaacaaaagcgggagggcgttcctggccaacaccgtgatcggtggcaagttcgtgctgaggttcgcggtggggtccacgctacaggaggagaggcacgtgcggaacgcgtgggatctcattaagatgaccacaaccgagatcataaac

SEQ ID NO: 1881 - DNA, 1876 bp, Triticum aestivum
actagctcctccgcctcttcttcttgctctccggcagcaaagctacctagctcaacttcattaagccaatccttctctccgcctcccaaccttctttgctcataatcaaggtttaaattacctacctaaaaggaatgggcagcttgggcaccaaccccatgtccttctccgccatccccgacgacaaggcggcgttcgagccgctcaaccccgaagatgtccgtgcatacctccacaaggccgtcgacttcatctccgactactacaccaacatcgagtccatgcccgtactccctaacgtgaagccggggtacctgcaagacgagctcagcgcatccccgccaacttactctgcgccattcgacgtcaccatgaaggagctcaggacctccgttgtccccggcatgacgcactgggctagccccaacttcttcgccttcttcccctccaccaacagcgcagctgcgatcgccggcgacctcattgcctcagccatgaacaccgtcggattcacgtggcaggcctcacctgccgccactgagatggaggttctcgctctcgactggcttgcgcagctcctgcgtctgcccacaaccttcatgaaccgcaccagcactggtcgtggcaccggtggtggggttatccttggcacaacaagcgaggccatgctcgtcacgctagtcgccgcccgtgatgcagcgctgcgtcgaagcggctctgtcggcgtgtctggcattccacgcttggctgtgtatgctgccgaccaaacccactccacgttcttcaaggcttgtcgcctcgcgggatttgaccccgccaacatccgctccatccctaccgggccagaaaccaattatgggctcgacccggcaaagcttctcgaggtcatgcaagctgatgccgacgctggtcttgtgccaacatatgtctgcgcaaccgtgggcaccacgtcttccaatgtcgttgacccggtgggcgacgtcgccgatgttgccgccatgttcagtgcatgggtccacgtcgatgctgcctacgctggcagtgcatgtatctgccctgagtttcgccaccatctcgacggcgtcgagcgcgtggactccattagcatgagcccacacaaatggcttctcacatgccttgattgcacatgtctctatgtccgtgatgctcaccgactgagtgactcattggagaccaacccggagtatctcaagaatgatgctaccgagtccggcgaggtcaccgatcttaaagacatgcaggtcggcgttggccggcgcttccgcgggctcaagctttggatggtcatgcgtacctatggtaccgcaaagctccaagagcacatccgtagtgatgttgccatggccaagatgtttgaagatttcgtccgtgccgatgacaggtttgaagtggtcgtaccgaggaactttgctcttgtttgctttcggatcaaggcaagtggagccatgacggagaaggatgctgacgagaccaaccgcgtgctaatggagaatctgaacaaaactggcaaggcttatcttgcacacacggtggtcggtgacaagttcgtgctgcggttcgccgttgggtcgtcgctgcaggaggagaggcatgtgagaagtgcttgggacctcatcaagaagactacgagcagtatcatggattaagtggacggacctatgggtgccaaaagttctaggagctacacaaagcccaatatttatgataatttttctttcttttctttttcttcgatagagattatttatttggacatgtggttcttattccgaccgagcgtatatatataataggccgatatcaaggctgtaaaaggtaaaatggcttatattaatgaacacaagatactttttta

SEQ ID NO: 1882 - DNA, 1784 bp, Hordeum vulgare
aatgggcagcttgggcaccaaccccacgtccttctccgccttccccgacgacaaggcggcgttcgagccgctcaaccccgaagatgtccgtgcataccttcacaaggccgttgatttcatctccgactactacaccaacgtcgagtccatgcccgttcttcctaacgtgaagccgggatacctgcaagatgagctcaccgcgtccccgccgacacactccgcgccgttcgacgtcaccatgaaggagctcaggacatccgtcgtccccggcatgacgcactgggctagccccaacttcttcgccttcttcccctccaccaacagcgccgcagccatcgccggcgacctcatcgcctcggccatgaacaccgtcggattcacgtggcaagcctcgcctgcagccaccgagatggaggtcctcgctctggactggcttgcgcagctcctgcgcctgcccaccaccttcatgaatcgcaccagcactggtcgtggcaccggcggtggtgtcatcctcggcacaacgagcgaggcaatgcttgtcacgctagttgccgcccgtgatgcagcactgcgtcgaagcggctctgtcggcgtgtctgacatcccacgcttggctgtgtatgctgccgaccagactcactccacgttcttcaaggcgtgtcgccttgcaggcttcgaccccgccaacattcgctccatctctactgggccggaaacaaactatgggctcgacccaaccaagcttctcgaggtcatgcaagctgatgccgacgccggtcttgtgccaacatatgtttgcgccaccgtgggcaccacgtcttccaatgccgtcgacccggtgggcgccgttgccgatgttgccgccatgttcaatgcgtgggtccatgtcgatgctgcttacgctggcagcgcgtgtatctgcccggagtttcgccaccatctcgacggtgtcgagcgcgtggactccattagcatgagcccacacaaatggcttctcacgtgcctcgactgtacatgtctctatgtccgtgacgctcaccgactgagcgactcattggagaccaacccggagtacctcaagaacgacgtcacggattccggtgaggtcaccgatcttaaggacatgcaggtcggtgtcggccgacgcttccgtggtcttaagctttggatggtcatgcgcacctacggtaccgcaaagctccaagagcacatccgtagtgacgtcgccatggccaagatgtttgaagattccgtccgtgccgacaacaggtttgaagtggtcgtgccgaggaactttgctcttgtgtgctttaggatcaaggcaaggggagacatgacggaggaggatgccgacgaggtcaaccgccttctaatggagaatctaaacaagactggcaaggcttatcttgcgcacaccgtggtcggtgacagatttgtgcttcgttttgctgttgggtcatcgctgcaggaggagaggcatgtgagaagtgcatgggacctcatcaagaagactaccagcagtatcatggattaagtgcactgaccaactgttcagggagctatacaaatccctatatttaggggacaactattattttatttttttcctttgattctgattattatttatttagacatgtggttcttattcctttttgtgatctataacgaccgagggtctatatatatatagcaggccggtaccaaagaagttgattatagactgtaaaaagactttgtattatagatcaagggtctatatatatagcaggccggcaccaaag

SEQ ID NO: 1883 - DNA, 1585 bp, Brachypodium distachyon
atatactatcatatactaacatgggcagcttggacgccaactccgccgctctagccgacgacagagctgcaccgggcagcagcttccagccgctgaacgccgacgacgtccgcgcctacctccacaaggccgtggacttcatctccgactactacgccaacgtcgagtccatggcagttctccccaacgtcaagccgggctacctccaggaggagctcaagctctcctccccgcccaactactccagccccttcgaggtcaccatgaaggagctcaggtccgccgtggtgcccggaatgacccactgggccagcccaaacttcttcgccttcttcccttccaccaacagcgccgccgccattgccggcgacctcatcgcctccgccatgaacaccgtggggttcacctggaaggccgcccccgcggcgaccgagatggaggtgctcgcgctcgactggctcgcgcagctgatgcgcctgccggcgacattcatgacccgcagcaccggcagcgaaggagcacgcggcaccggcgggggagttatcttggggacgacgagcgaggccatgctcgtgacgctcgttgcggcgagagattcggcgctgagaagaagcggctctaatggcgtggccgggatcacgaggctcaccgtgtacgcctctgaccagacccattcgacattcttcaaggcctgccgcctcgcgggcttcgacccggccaatatacgctctatccctactgggccagaggcccactacagcgtcagcccagagaagctgctcgaggccatgcaggccgatgcggaggctgggctcgtgcccacgtatgtctgtgccaccgtcggcaccacctcgtccaatgctgtcgaccctgtgggtgccgtcgccgatgtcgccgcattgtttgacgcgtgggtccatgttgatgctgcctatgccggcagcgcttgcatctgtccggagttccggcactatcttgacggcgtcgagcgcgtggactccatcagcatgagcccgcacaagtggctgctcacgtgcttggattgcacatgcctctacgtccgtgatactcaacggctgagcgactcgttggagacaaatccggagtacctaaagaacgacgtcaccgactccggcgaggttaccgatctcaaggacatgcaggtcggcgtgggccggcgcttccgcgggctcaagctctggatggtcatgcgcacctacggcaccgccaagctccaggagcacatccgcagcgatgtcgccatggctaagatgttcgaagagttggttcgtgccgacgaccggtttgaggtcgttgtgccgaggaactttgctttggtgtgctttaggatcaaggcccgtggaaccatgacggaggatgatgctgatgaggccacccgtgtgctcatggagaacctgaacaagacaggcaagatgtaccttgcacacacggtggtcggaggcaggttcgtcctccgttttgcggtggggtcgtcgctgcaggaagagaggcatgtgagaagctcatgggagctcatcaaaaagacgacatcccagttgacggattaaaatggacggacaaagcc

SEQ ID NO: 1884 - DNA, 2870 bp, Solanum phureja
tttcattcaattttcgccgatctaattactcttctttgacaaagtttttgggcttatattttgggtggaattcaactcctttcatttggtttctccttttctggcttacatttttaatcttattcacacttccactagaatgttcctctgaacctctgttttgtaattttgccaagtttttattcttgtgtggaatgatgatggtggggatatgggtatctttcgtgtcaactccagttcttggggcatgacctaccttcaaactgaaatttgatgctttgtactgattcatttggaagtgagactccaaacatataatcacttttttactgtttctttaacttggatcatagtaattcaaatgtttttctatggtctggtaattagaccccaaatcaatagtcggttgtctttgtgacggttggtgggtggtcattattttgtactgatgagtttccatggggcaacttgtttattacaattttcgagaagattgtcgttttcctcagctgattatctgttctgttagtagtcatgttgaattaactgtagtattcagatgctaccttatcttttttttgtgattttcttgatcattcattcggctaatttctagatgagcagtttcaactctgcctatagttcatgttagttttgttatttataggatcagtttgagtttgctagcagatacagatgatccagtccacaagcagtacctaataaatatccttatttggctttgcaggtgtttattgcctacacaccactgttggattcatatagccaactccaacttgtttgggattgaggcatagttgttgttgttgttgtacaccagggacaggcaattgtgtgttatgggttggttagaaaagatatttggaggttccacacacaggatctctggtggacaataccatgggggttatgagggtgggcaatatcatgggggatacgatggagggcaatatcattcggggcatgaaggaggacaaaatcatggagggtatgaggacagtactacttgggatggaccaactacatcagtggatgaattgtcagattttgataaagaagaaattgatcgtgccattgcactttctctagcagaagaggatcagaaagggaaaaaagtaattgagagtgaaccccatttggaggaagacgaggctctcgccaaggcccttcaggaaagtttgaatgtggagtcgtctccaccaccaccaccaccacctcgatatgattatggaagtccctttccaccagtatcatactcgtttccgtatgggtatagggtttgtgctggttgcaatgctgaaattggacagggaagatatttaagttgcatgggagctgtttggcatccagaatgtttccgttgccatggttgtaatcaaccaatttctgactatgagttttcaatgtcagataaccgtccataccataaatcatgctacaaggaacagcatcacccgaaatgtgatgtatgcaagaactttattccaacaaatccggctggtctaattgaatatagggctcatcctttctggcttcagaagtattgcccatcacatgaaactgatgggacgcctcgttgttgcagttgtgagagaatggagcccgtagatgccagatatctgatacttgaagatggtaggaagctgtgtctagagtgcttggactcttcaataatggacactcatgaatgtcaacctctttatcttgagatacaagaattttatgaaggcttaaatatgaaagtagagcagcaaattcctttgcttctagttgaaagacaagcattaaatgaagcgatggaaggagaaaagaatggtcatcatcacatgcctgagactcgaggactatgcctgtcggaagaacagaccattagcagtatttcaaggcgaccacggattggtggttatcggattttggatatgtttacggagcctcacaggttaattcgacaatgtgaagtgacagctattctaatcttgtatggtcttcctaggttattaactggttcaattctggctcatgaaatgatgcatgcatggctgcggcttaaaggttatccgagtttaagtccagaagtggaagaaggtatctgccaagttttagctcacatgtggttggactcagaaattatagctggttctggtagtacttcaacttctgcatctacatctgcatcctcatcgtcatcttcatcaccatctacttcatcaaagaaagggaaacgctccgactttgagaagaaactgggtgatttttttaagcaccagattgaatcagatacatcagcagcttatggggatggattcagagaaggtaataaggcagtgctcaagtatggcctcaagacgacacttgatcacatccggcttacaggaacctacccgtgttaaaatattcagtcattccgagtgtttccacttcaacgcggatgttctaaacaaaccttctatactagttttgttaggaccacatagcacatacaattataatcattacacaataatcaaaatataaagagtaaatgcagcaataagatgcagatacgtttaatacacttgtgtctgcttcaagttgtatacttattcatataaaggaaatccaaacatattgatgcacacgtatctacctttcttattgtccaccaaaaggtgcttcatttttgccgtggagaagaggaagattgatcatataggcctaattgactccatgtaatgtatgaagcagcaccaattatatcttatttgcatgctcctgcaattatatgaagttgtattgtgtttgcctgctcctgtaattatatggtggtaatatcttatttttcatcttattcagagaacatttttggttga

SEQ ID NO: 1885 - DNA, 4362 bp, Populus trichocarpa
attatttatttttttgcttcgatttcgattgggcgtcccagtgcggcatttcaatttttaatcactcagaccagtgaaaaaaatagggtttcagatttcgaaatcaaggtttttggtcatttatagggtttaacattgaattccaactttgtgtttgtagttagggttctctttgattatctgatttggagagagggagagataagttagggttttatgatggtagatagacaatggtgaggctattaggattaactcgtggagaatcagatgattctccacgagagattacctcgaggacgactcctttaactagtgagtcaggtgagagtggatggttaattagattttttgattcagctttcttttgtgagtggattgcagtaagttatctgtataagcatgatcatgctggggttcgggattatctgtgtaatagaatgtatacattgcccttatcgggtgtcgagagttatttgtttcaaatttgttatatgatgatacataagccgagtccgtcgcttgataagtttgttattgatatgtgttctaagtcattgttaatagctttgaaagtacattggtttttgttggcggagcttgaagattcggatgataatgatgggattagtaggattcaggagaagtgtcagattgctgctacgttgatgggagagtggccgccattgttgaggccacgaaatgaatcttcaagtcctgggagtaagaatcaggttctgagtagactcttgtcatcgaagcagaagttgctgtcattgacttcttctccacctccgcagaagtccatttcgttttcaccctcatcggggaacggtttgcaggaggatggaactggtagtcagctgtcaccggatgagaataagatttttaagaagtttattcctggttcgaaggttagagatgcattgttgtttaggaagtcatttgataaagatgatcagaaggctagagatgctttgttgtttaagaagtcagctgataaagatgcggaagagggtgaaaaggatggatttttcaagaggcttatgagggacagtggtaaacgtgaggatgaggagttgacacaaagttcagatgggtttttcaagaggcttagaggtagtattaaaagtgaggatgaggagatgacatccggctcagatggttttttcaagaggcttctcaaggatagtagtagaggtgaggatgaggaagtaacctcgagttccgatggctttttcaagaaactgtttcgtgatagtaagggcgacgctgatgacaagttggtttctaaatcttcagcggatgacgaaaaggaggggttcgttaagaagttttttaaggataagtttgaagacaagaaagatggaaatgatcagaatgaggatgaagagaggtcaaagcttgaagagaaaggttcaaaatctgcagaggatgatgaaaaagaagggttcttccggaagttgttcaaggataagtccgaggacaagaaagatgggaccgagaaatctgacgagggggctaccaattttgaggaagaagaaccttcagacttttccttgtttcgtagactgtttcgtgtgcatcctgaagaggtcaaaaatactggtgcaaatgaaaataacggtagtagcagcttgtttgaaagcagcccgggtactgagaatttttttcgcaaactgtttagagatcgtgagcgctcagttgaagactctgagttatttagtttcaagaagaacaaagagttgaatacaaagcctccgcttccaaataacactgcatcacagttccggaaaggggcttatcatgagtcattggactttgaaaggggcttatcatgagtcattggactttgtgatgtcgttatgtgagacttcatatggtttggttgattcacttgcagagattaatgtgcatttagctgaggctcgaaacagtggaggagtttgctttccaatgggaaaagggttgtatcgtgttgttcatatacctgaagatgaagctgttcttttgaattctagggaaaaggcaccttatctgatttgcgttgaagtattgaaaagtgaaatgccaagcaatagcaaggacacatctggcgctcaaaacctttccagaggaggaattcctcttgcaaatggagatgcattcctgccgaagccacctccttgggcttatcctttgtggactacccaggacatgtatcgaaatagtagtgataggatgtcccaatcaaccgctgaagcaattgaccaggcaatgtcccatgcatctgaaacaaaaatgaaatttgttaatgtgaatctttctgtggagaagaaattgcctagccagtcaactgtcattgaagcacctaaattaaattctggcatcaattttatgcatcaaaatgctgcacattgtagtgatttggaatgggtaagggtagtgctgacagcagatcctggagttagaatggaagatgtaggggatgaaggggcgccacgacgcaaggagcatcgtcgtgttcctagcacgattgcaatagaagaagtaaaggctgctgcagccaaaggggaagcacctcctggactacctctgaaaggggctggtcaagtttcatcagatgcacaaccaaatgttaatggtggcaatcccaaggccagtgatgccttatctggtgaactctgggaggtcaagaaagagagaatacgtaaagcttcagtatatgggaaattacctggctgggacttgcgctctgttattgtgaagagtggtgatgactgtaggcaggagcatcttgccgtgcaactcatttcacacttctatgatatatttcaagaagctggtgtccctctttggttgcgtccttatgaagttatttgtacttcatcatacacagctcttattgaaacaattccagatacggcttcaatccattctatcaagagtagatatccggacatcacaagtttgcgtgacttttttgttgccaaatatggagagaactccccaagttttaagcttgcacagaggaacttcgttgaaagtatggctggatattctttagtgtgctaccttttacaggtgaaggacaggcacaatgggaacttgttaatggatgaagatggccacattatacacattgattttggtttcatgctctctaattctcctggtggtgtaaattttgaaagtgcacccttcaaactaacccgagaacttcttgaggtcatggattctgatgctgagggaattccaagcgagttctttgactattttaaggttttatgcattcaaggcttcttgacatgtcgtaagcatgcagagcgtataattctccttgttgagatgttgcaggattctggtttcccttgctttaaaggtggtccccggacaatacagaacctaagaaagcgatgccatctaagtttgacagaagagcaatgcgtgtcattggtgctctctctgatcagcagcagcttagatgcatggcggacacggcagtatgattattatcaaagagttttaaatggaatattgtgaggttagatttgcttggtgattgctttcattgctccccctttgataaagccagtccagtgaagcacttttattggagctgtttgtaaattgatgtcgtatgagggaaattgactcactgcactgtggcattggcaattaagcagaatactgatgacagtttatggctgttttcgcttggtgtgaggaaattgtaaatgtatcggctgaaatactttttagaagtcttgcaggctgcatttacttcagcagggtcttcttcttttcactgtttccccttgtcatttgtcgtagagctctctgctggctggtggggggaatttagttactcaacaggagaacttccttttacccatcttcagacagcacatacttgtacattgattcctctggagacaacgttccagacatgaaatggtgtctgaggctgtaattgctggttggcgttgcagctgctctacattttacaccggtcagtgatcagaagcagccaaacattcccgatttttatctatccatatttgaaactcattatattcttctgattaaagttttgacgcactatatcggactggtagcctgttggttggtaactggtctcctccatttgatggctattcttcccagggtaagattcttccatgcttcctatcaaaggcttgttagcaacattcatgttagattagatcccatttgctgtttaacagtaaagaaaatttgtttatttgatattcctgttgtatatcagagttttggtggcatcgaattttgtttccaggttgtgtatttcttaatgaaaagtttgatgtttgtcagcttgcttgcacatgctaggtcttcttg

SEQ ID NO: 1886 - DNA, 3498 bp, Ricinus communis
gatattttttctaagaaacaaacagaaatcattttttgtcctacctgtacagggaattagggtttctggtcaatgaccggatttagcttacagaatttagattgaatcaactgagagctcttaaactaagactcgtctcataattggggttttgatcaaaggttttagggattcttagggtttaatatcgatctggtgtttggaaaatcgaagttaaggtttatgatgatagaatgacaatggtgcggcttctaggtctaagtcgtggagaatcagacgagctacctagagaaatcacctcgcgaagtaacctaattagtgagtctggtgagagtggatggttaatcaggttctttgactcgtctttcttctgcgagtggatcgcagtgagctacttatacaagcatgagcatgctggggtgcgtgattatctatgtaatagaatgtatacattgccgttatctggtattgagagttatttgtttcaaatttgttacatgttaatacataagccgagtccgtctttggataaatttgtaattgatatatgctctaagtctttactcatagctttaaaggtgcattggtttttgttggcggagattgaggattccgacgacaatgaaggaattagtaggattcaggaaaagtgtcaaatagcagcaactttgatgggagaatggcccccacttgttcgcccaccaaatgagtcttctactcctgggagtaagaaccaggttttgaataaaattctttcatcaaaacagaaattgttgtcgctgacatcttccccacctgtgaataagtctttgtcattttcaccgtcatcagggaataatctacaggaggatggaaaccctttatcaccagatgagaacaagatttttaagaagtttattccgggtccaaaagttagagatgcactgttgtttaggaaatcagtggagaaagatgacgatgagagtgagaagaatggatttttcaaaaggcttttgagggatagtagtaaaggtgatgatgaggagttgacatcaagctccgatggctttttcaagaaatttttgagagatagcagtattagaggagaggatgaggaattgacatcaacatcagatggctttttcaagaggcttttgagtagtaaaggtgaagatgaggaattgacgtcaagttcagaagggttttttaagaggttatttcgtgatagcaagagcgatggtgatgagaagccagttactaaatctatggaagatgatgataaggatggtttttttaggaaattttttaaggagaagtttgaggacaagaaggatggaaatgacaggaatgagcatgaaaaaagagttaactctgaagagaaatgttcaagatcttctgaggatgatgaaaaggaggggtttttccggaagctgttcaaggaaaagtttgaggatagaaaagatggaaatgataaaattgatgaggcaaatatcaatggtgaggaagaagaatattctgacttttcattgtttcgaagattgtttcgtgtgcatcctgaagatgtcaaaagtacttcagtaaatgagagtagcaatggtggtttatttgagggcagcccggggactgagaactttttccgcaaattgttcagagatcgtgatcgttcagttgaagactcagagttgtttggtttgaagaagaacaaagagaaacgtcctggttcaccaaagcaacagaatgaaaagtcgagcacaaagcccccacttcctaataatactgcatcacatttccgaaaaggggcttatcatgagtcactagactttgtgatgtcgttatgtgagacgtcttatggattagttgatgtatttcctgttgaagatcgcaaaagtgctctttgtgagtcacttgcagatatcaatttgcatatagctgaagctcaaaatagtggaggagtttgctttccaatgggaaaggggatgtatcgtgtagttcatatacctgaagatgaagctgctcttttgaattctagggaaaaggcaccatacctgatttgcgttgaagttttgaaatgtgatacgccaagcaataccaaggatgcatctgctgttcaaaagctttccaaaggaggaattcctctggcaaatggagatgcatttttgccaaagcctcctccatgggcctatcctttgtggactacccaagaagtgtatcggaatagtagtgacaggatgtcgagatctacagctcaagctattgaccaggctatgtcacatgccatggagtcaaaattgaaatttgtcagtgtgaccctctctttggagaagcaagtttctcgacagtcaatgaatattcgccatggtataaatcgtagcggagcacatcaaagagcagtggatggcggtgatttggaatgggtaagggtagtgctgacagcagattctggagttcggatggaagatattggggatcaaggaccaccacgtcgaagggagcatcgccgtgtccccagtacgattgctatagaagaagtgaaggctgctgcagccaaaggagaagcgcctcctggccttcctctgaaaggagctggtcaagattcatcagatgcacaacccagggttaatggtggcacctctgaagctagtgatgcactatctggtgagctttgggagataaagaaagagaggattcgtaaagcttcagtatatgggaagctacctggttgggacttgcgctctgttattgtaaaaagtggtgatgactgtaggcaggagcatcttgctgtgcagcttatttctcatttttatgatatattccaagaagctggtctccctctctggttacgtccttatgaagtcttagtcacttcttcttatacagctcttattgagacaattcctgatactgcctcacttcattctattaaaagtagatatcccagtatcacaagtttgcgtgacttctttgtcgctaagtatgaggagaactccccaagttttaagcttgcgcagaggaattttgtagaaagtatggctggatattctctagtgtgctaccttctgcaggtgaaggataggcacaatggaaacttattaatggatgaagaaggtcatattatacatattgatttcggatttatgctctctaattcacctggtggtgttaattttgaaagtgcgcctttcaaattaacccgagaactacttgaggtcatggattctgatgccgagggtattccaagcgagttctttgactatttcaaagttttatgcattcagggcttcttaacatgtagaaagcatgcagagcgtattattcttttggttgagatgttgcaggattccgggttcccatgttttaaaggtggtccacgaacaatacagaacctaagaaaaagatttcatctaaatttgacagaagagcaatgtgtctccttggtgctttctcttatcagcagcagcttagatgcatggcggacacggcagtatgactattatcagagagtgttgaatgggatattgt

SEQ ID NO: 1887 - DNA, 3232 bp, Manihot esculenta
tatgacaatggtgcggcttctgggactgagtcgtggagaatcagacgagtcacccagggagatcacctcccgaactagcctattaagtgagtcaggcgagagcgggtggctaatcaggttcttcgactcggcctttttctgtgagtggatcgcagtgagctacctatacaagcatgatcatgctggtgtacgtgactatctatgtaatagaatgtatacattgcctttatcaggtatcgaaagttacctgttccaaatttgttacatggtaatacacaagcccagcccatctttggataagttcgtcattgatatatgctcaaagtcactactgatagctctgaaggtgcattggtttttgttggcggagattgaggattctgatgataatgaagggattagtaggattcaggagaagtgtcagattgcagctactttgatgggagaatggcctccacttgtgcggccaccaagtgagtcttctagcgttggaggtaagaacccggttctgaataaaatcttgtcatcaaaacagaagtttttgtcactgacatcttcaccacctactaataagtctctgtctttttcaccctcatccgggagtagtttagttgaggatggaaatctattatctccagaccagaacagcatatttaagaagtttattcctggtccaaaagttagggatgcattgttgttcaggaagtcagtggagaaagatgaggaagagagtgagaaggatggattttttaagagacttttgcgagacagcagagatgatgaggaaattacgtcaacatcagatggcatttttaagaggcttttaagggatagtaaaggtgaagatgaggagttgacgtctagctcggaagggttttttaagaggttgtttcgggatagcaagagtgatgatgaggacaaatctgtttctaaatcagtggaagatgatgaaaaggaaggattctttaggaaattttttaaggagaagtttgaggacaagaaggatgagcatgaagaaagggtgagctctgaagagaaatgttctaaatctgcagaggatgaagaaaaggaggggttttttcgcaaattatttaaggataagtttgaggacaagaaagatggaaatggtaaaattgatgacagaaatgccaaagatggaaatggtaaaattgatgaccgaaatgccaatggcgaggaagaagaaacttccgaattttcattgtttcgaagattgtttcgggtgcatcctgaggatgccaagaatactgcattgaatgaaaatgggaatggtggaggtttgtttgagagcagccctggaactgaaagattttttcgcaaactatttagagatcgtgatcgttcagttgaagaatcagagttgtttgtttcaaagaagaacaaagagaagcggccaggttcaccaaagcagcagaatgacaagtcaaacacaaagcctccacttcataacaatactgcatcacatttcagaaaaggggcttatcatgaatcactggattttgtgatgtcactatgtgagacttcttatggcttagtagatgtatttcctcttgaagatcggaaaagtgctcttcgtgagtcacttgtggagatcaatttgcatttagctgaagctcaaaatagtggaggaatttgctttccgatgggaaagggaatgtatcgtgtagttcatatacctgaagatgaagccattcttttgaattctagggaaaaggcaccatatatgatttgtgttgaagttttgaaatgtgaaatgccaagcaataacaagggtacattcggtggtcaaaaactttccagaggaggtattcctctagctaatggagatgcatttttgccaaagccacctccgtgggcctatcctttgtggactacccaggaagtgtatcgcaatagcagtgataggatgtcaagatctacagctcaagccattgaccaggcaatgtcccatagtttggaggcaagacagaaatttgctaatgtaagcctctctgtggtgaagcaattgcctcgccatccaataaacaccaatgcacaggatatccaccatggcattaatcgcagtggactgcatcaaagagcaactaatgatggggaatttgaatgggtaagggtagtgctgacagcagaccctggtgtccggatggatgacattggggatcaagaaccacctcgtcgcagggagcatcgtcgtgttcccagtacgattgccatagaagaagtgaaggctgctgcagccaaaggtgaagcccctcctggacttcctctaaagggggctgggcaagattcgtcagatgcacgactgagggttaatggtggaacccctaaggccagtgatgctctatctggtgagctctgggaggcaaagaaagagaggattcgtaaagcttctgtatatggaaaattacctggttgggacttgcgctctgttattgtgaagagtggtgatgattgtaggcaggagcatctcgctgtgcaacttatttcgcatttttatgatatattccaagaagctggtctcccgctctggttgcgtccctttgaagttctggtcacttcatcttatacagctctcattgagacgattcctgatacagcctcacttcattctatcaagagtagatatcccaacatcacgagtttgcgcgacttctttgttgctaagtatgaggagaactccccaagttttaagcttgcgcagaggaactttgttgaaagtatggccggatattccctagtgtgctacctgctgcaggtgaaggataggcacaatggaaaccttttactggatgaagatggtcacattatacatattgattttggattcatgctctctaattcacctggtggtgtcaattttgagagtgctcccttcaaattaaccagagaactccttgaggttatggattctgatgctgagggagttccaagcgagttctttgactattttaaagttttgtgcattcaaggcttcttaacatgtcgtaagcatgcagagcggattattcttcttgttgagatgttgcaggactctggtttcccttgctttaaaggtggtccacggaccatacagaacctaagaaaacgattccaactaagtttgacagaagagcaatgtgtctccttggtgctttctcttatcagtagcagcctagatgcttggcggacacggcagtatgactattatcagagagttttgaatggaatattgtga

SEQ ID NO: 1888 - DNA, 3289 bp, Panicum virgatum
aagcccccatttttatgctctcactgcagttgcaggtgacgctttcccaggctcgccacgccctgcgctcccccgtcgcgtcgccttctatctttggggggagagcctttgccgctcctcactctctgtgtcacgtatctcctcggttgctgattccctgctcgtttgtcgccattgccgcacctcgtgccctgtgaaggcatggcgagctcggggccaacgtctgggaagaaatctctaaatacggtgactttgctgttcaaattaccatattacacacaatgggggcagagccttctgattgctggctcggaaccggcactgggttcgtggaatgtcaagcaaggactgtctctgagtccagttcatcaggataatgagctaatctggtgtggaagagtgtctgttgctgctggcttcacctgtgaatacaaatactatgtagtggatgacaacaagaacgttttgagatgggaggctggggagaacaggaaactagtcctgccagatggcgttcaagaaggagacataattgaaatccgtgactggtggcaggatgcttctgaagcccttttccttagaagcgcattcaagaatgttgttttcaatgctacagaaggtgttaaaaaggaaccccagtcggcatccctcaacaaaagtttggatcctgaagatatcgttgtccagttcgtaattagctgtcctcgactcgaatctggctctactgttgtcgtcactggaagtaatcctcagttaggaagatggcaagctcaagatggtctcaagctgagctatgttggagattccttgtggaaagcaatctgtgttttgcggaagtctgagttccctgtaaaatacaaatactgtcaaatcagtcaagcaggaaactcttcattggagctaggtccaaacagagaggtagatatcgatttatcatctcccaaagcaatccagatatgtcgtgttatctgatggtgccctcagggatgcaccatggaggggtgcaggtgttgctgtacccgtgttttcaatcagatcagacgaggaccttggtgttggagaatttctagatcttaaacttcttgttgactgggcagtcaattcaggtttccatcttgttcagctccttccgatcaatgatacttcagttaacgggatgtggtgggattcttatccatacagctcgctctctgtattcgcgttgcaccccttgtacctgagagtacaagcactttcagatgcgattccagcagatgttaaggaagagattttagcaggcaaagaagcaattggataaaaaggatgttgactatgaggcaacattgtccacaaaattatcgattgctaggaaaatattcaatttagaaaaggacaaagtgctaaactccagttctttcaagcagtttttatctgaaaatgaggaatggttgaaaccatatgcggcattttgctttttgcgggactttttcgagacatctgatcacagccaatggggtcggttttctcagttttccaaggaaaagcttgagaagcttatttctgaaggtactttgcaccatgacgttatccgttttcattactatgttcagtaccatctatatatgcaattatcagatgcagctgcatatgcaagaaagaaaaaggttatcctgaaaggtgatttacctattggcgttgacaggaatagtgtggatacttgggtatacccaactttatttcgcatgaatactgctaccggagcacctcctgattattttgacaagaatggtcaaaattggggttttccaacatataactgggaggagatgtcaaaggataattatgggtggtggcgagctcgtctgacacagatggcaaagtacttcacagcataccggatagaccacattttgggtttctttagaatatgggagcttccagatcatgctgcaacaggtttattagggaaatttagaccttcaattcctcttagtcaggaggagtttctaagtgaaggactatgggatttcaatagaatgagtcgaccatacattcgtcaagaaattctggaggagaagtttggatccttttggacagtcattgcagccaactttctaaatgagtatcagaaacagtgttatgagtttaaagaagattgcaacacagagaaaaagattatcgcaaagattaaaacaagtcctgaaaaatcactgtggctagagaaagaagacagtatccgccgtggtctttttgatttactacagaatattgttcttatcagggatccagaggactccacaaaattttatcctcgtttcaacctggaagatacttcaagttttagggaccttgatgaacacagcaaaaatgttctcagaagattgtattatgactattattttgctcgccaagaaaatctctggcgtcaaaatgcactgaagactctgcctgtcctgttgaactcgtcagatatgttggcatgtggagaagaccttggtcttatccctgcttgtgttcaccctgttatgcaagaacttgggttgattggactgcgtatccaaagaatgcctagtgaaccaaacacggaattcggtattccttctcaatacagctatatgacggtttgtgctccctcatgtcatgattgctctacattacgtgcttggtgggaagaagacgaaggaagaagaagtcgtttctacaagactgtagttggcagtgatgaagagcccccatctcgctgcaccccagaagtagttcacttcattgttcagcagcattttgatgctccatcaatgtgggcaatctttccacttcaggaccttctcgcactgaaagacaagtacacctcaagaccagcaccagaggaaacaatcaatgaccccactaacccaaggcactattggagattccgtgtccatgtgacattggagtccctgctggatgacaaggacatccaggcaaccatcaagggccttgtcacaagtagcgggagatccttccctggaaagaaggtggaaggtgccgacgaaagcggagagaagctatctaaggtgcagttgaatggtaaagcttaggaaaggatcgcaatagcagaatgcgaccacgattacaagtaaatagaataaggggacacattgcgttaccatgttggttggtttgtccgcttatgttgtttaagctagaaatgtcccgtgaaattctttcgacacatgaaataaggagtgtgacctgtcaagtcagaaagtgaaataattcattccattcataaaattgttcctctcatgatccaactatttcttattggtgc

SEQ ID NO: 1889 - DNA, 3145 bp, Pennisetum glaucum
tcgaggcgtcgccttctatctttaggagagaggcctcgccgctctctcactcgctctgtcctcggttgctgattccttgctcgtttctcgccattgccgccgctcgtgccctgtgaagatatggcgagcaagaaatctctaaatacggtgactttgctgttcaaattaccatattacacgcaatgggggcagagccttgtgattgccggctcggaacaagcactgggatcgtggaacgtcaagcaaggactgtctctgagtccagttcatcaggataaggagctattctggtgtggaagagtctctgttgctgctggtttcacctgtgaatacaaatactatgtagtggatgacaataagaatgttttgagatgggaatctggggagaaaaggaaactagtcctgcccgagggcgttcaagatggagacataattgaaatccgtgactggtggcaggatgcttctgaagctcttttccatagaagtgcattcaagaatgttattttcaatgataccgaaggtgttaaaaaggaattgcagtcattgtccctcaacaaaagtttggatcctgaagacattgttgtccagttcataattagttgtcctcgactcgtatccggctctactgttgttgtcactggaagtaatcctcagttaggaagatggcgagctcaagatggtctcaagatgagctatgttggagattccttgtggaaagccaactgtgttttgaggaagtctgagttccctgtgaaatacaaatactgtcaaatcagtcaagcaggaaaaccttcattggagctaggtccaaacagggaggttgatattgaactatcatcacccaagcaacccagatatgtcgtgttatctgatggtgcactcagggatgcaccatggaggggtgctggtgtcgctgtacctgtgttttcaatcagatcagatgaggacctaggtgttggagaatttctagatcttaaacttcttgttgactgggctgtcaattcaggcttccatcttgttcagctccttccaatcaacgatacttcagttcatgggatgtggtgggattcttatccatacagctcgctctctgtgtttgcgctgcatcccttgtacctgagagtacaagcactttcagatgcaattccagcagatgttaaggaagaaattcagcaggcaaagaagcatttggataagaaggacgttgactacgaggcatcattgtccacaaaactgtcgattgctagaaaaatattcaatttagaaaaggacaaagtgctaaactccagttccttcaagcagttcttatctgaaaatgaggaatggttgaaaccatatgcggcattttgctttttgcgggacttttttgagacatctgatcacagtcaatggggtcggttttctcagttttccaaggagaagcttgagaagcttatttccgaaggtactttgcaccacgatgttatccggtttcattactttgttcagtaccatctatatatgcaattatcagaggcagctgcatatgcaagaaagaaaaaagttatcctgaaaggtgatttacctatcggtgttgataggaatagtgtggatacttgggtatacccaactttgtttcgcatgaatactgctacgggagcaccacctgattattttgacaagaatggacaaaattggggttttcctacatataactgggaggaaatgtcaaaggataattatgggtggtggcgagctcgtctgacacagatggcaaagtacttcacagcatacaggatagaccacatcttgggattctttaggatatgggagcttccagatcatgctgcaacaggtttagttgggaaatttagaccttcaattcctcttagccaggaggagcttctaagtgaaggactatgggattttgatcgaatgagccgaccatacattcgccaagaaattctggaggagaagtttggatccttttggacggtcattgcagccaactttctaaatgagtatcagaagcagtgttacgagttcaaagaagattgcaacacagagaaaaagattattgcaaagattaaaacaagtcctgaaaagttactgtggctagagaaagaagacagtatccgccgtggtcttttcgatttacttcagaatattgtccttatcagagatccagaggaccctacaaaattttatccccgtttcaacctggaagatacttcaagttttagggatcttgatgaacacagcaaaaatgtgctcagaagattgtactatgactattattttgctcgccaagaaaatctctggcgtcaaaatgcactgaagactctgcctgtcctgttgaactcatcggatatgttggcgtgtggagaagaccttggtctcatccctgcttgtgttcaccctgttatgcaagaacttgggttgattggattgcgtatccaaagaatgcctagtgaaccaaacttggaatttggtattccttctcagtacagctatatgacggtttgtgctccatcatgtcatgattgctctacattacgtgcttggtgggaagaagatgaaggcataagaagtcgtttctacaaggatgtagttggcagcaatgaagaacccccatctcggtgcaccccagaagtagtgcatttcattgttaagcagcattttgatgctccatcaatgtgggcaatctttccacttcaggaccttctcgccctgaaagacaagtacaccacaagaccagcaccagaggaaacaatcaatgacccaactaatccaaagcactattggagattccgtgtccatgtgacgttggagtctctattggacgacaaggacatccaagcaaccatcaaggaccttgtcacaggtagcgggagatccttccctggaaataaggtggaaggtgccgacgaaggcggagagaagttatcaaaggtgcagttgaacggtaaagcttagaaatgatcgcagaacagctgagcgtgatcacgattgcaagtaaatagaataaggtgacacattgtattaacatgtccgttgggtctgttatttcagcaagaaatttctgactcccttgaagtttttttaacactggaaataagaagcgtcaccgtatcaaatcagcaaatgaaacaattcatctcatgca

SEQ ID NO: 1890 - DNA, 3644 bp, Sorghum bicolor
agaagggaaggagggggaggaaaaaaggctccttttttatgctgtcactgcggatgcaggtgacgctttcccaggctctcccccccgtcgtagacgtcgccttcgccctccacacgcacacccatcccatccatcccgctcccctcgcgtcgccttctatcttcgagggagaaccggagagcctttgccgctctctcactcgctctgttttgtatctaccccgtccgtcgctgattccctcctcgtttgtcgccattgccgccggtcgtgccgtgtcaaggacatggcgacctcgggaaagaaatctctgaattcggtgaccttgctgttcaaattgccatattacacacaatgggggcagagtcttctgattgccgggtcggaaccagcactcggctcgtggaatgtcaagcaaggagtgcctctgagtccagttcatcaggacagtgagctaatctggtgtgggagcgtgtctgttgttgctggcttcacctgcgagtacaaatactatgtggtggatgacaacaaaaatgttttgagatgggaggctggggagaaaaggaaactagtcctgccggagggcgttaaggaaggagatgtaattgaaatccgcgactggtggacggatgcttctgaagctctattctttagaagtgcattcaagaatgtcgtcttcaatgctactgaaggtgttaaaaaagaatcgcaatcggtgtccctcaacaaaagtttggatcctgaagatatcgttatccagttcgtaattagctgtcctcggctcgtatctggctctactgtcatcgtcactggaagtaaccctcaattaggaagatggcaaactcaagatggtctcaagctgagctatgttggagattccttgtggaaagcaagctgtgctttacggaagtctgagttccctgtaaaatatcaaatactgtcaaatcagtcaagcaggaaactcttcattggagcttggtccaaacagggaggttaatgttgatttatcgtcacccaagcaatccagatatattgtgttatctgatggtgctctcagggatgcaccatggaggggtgcaggtgttgctgtacccgtattttcaatcagatcagtcgaggaccttggcgttggagaattcctagatcttaagcttcttgttgactgggcagtcaattcaggcttccatcttgttcagctccttccaatcaacgatacttcagttcatgggatgtggtgggattcttatccatacagctctctctctgtgtttgcattgcaccccttgtacctgagagtacaagcactttcagatgcaattcctgcggatgttaaggaagaaattcagcaggcgaagaagcaattggataaaaaggacgttgactacgaggcagcattgtccacaaaattgtcgattgctagaaaaatattcaatttagaaaaggacaaagtgctaaactccagttctttcaagcagttcttatctgaaaacgaggaatggttgaaaccatatgcggcattttgctttttgcgggactttttcgagacatctgaccacagccaatgggggcggttttctcagttttccaaggagaagcttgacaaacttatttctgaaggtactttacaccatgacgttatacgttttcattactatgttcagtaccatctatatatacaattatcagaggcagcaacatatgcaagaaagaaaaaggttatcctgaaaggtgatttacctattggtgttgataggaatagtgtcgatacttgggtatacccgaccttgtttcgcatgaataccgctactggagcaccccctgattattttgacaagaatggacaaaattggggttttcctacatataactgggaggagatgtctaaggataattatgggtggtggcgaggtcgtctgacacagatggcaaagtacttcacagcatacaggatagaccacatcttgggtttctttaggatatgggagcttccagatcatgctgcaacaggtttagttgggaaatttagaccttccattcctcttagtcaggaggagcttttaagtgaaggtctatgggattttaatcgaatgagccaaccatacattcgtcaggaaattctagaggagaagtttggatccttttggacagtcattgcagccaattttctaaatgagtatcagaagcagtgttatgagtttaaagaagactgcaacacagagaaaaagattattgcaaagattaaaacaagtgctgaaaagtcactgtggctagagaaagaagacagtatccgcagtggcctttttgatttactacagaatattgtccttatcagagatccagaggactccacaaaattttatccccgtttcaacctggaagatacgtcaagttttagggacctagatgaacacagcaaaaatgtcctcagaagattgtactatgactattattttgctcgccaagaaaatctctggcgtcaaaatgccctgaagactttgcctgtcctgttgaactcgtcagatatgttggcatgtggagaggaccttggccttatccctgcttgcgttcaccctgttatgcaagaactggggttgattggattgcgtatccaaagaatgcctagtgaaccaaacacggaatttggtattccttctcagtatagctatatgacggtttgtgctccctcatgtcatgattgctctacattacgtgcttggtgggaagaagatgaaggaagaagaagtcgtttctacaagactgtagttggcagtgatgaagagcccccatctcgttgcaccccggaagtagtgcacttcattgttcagcagcattttgacgctccatcaatgtgggcaatctttccacttcaggaccttcttgcactgaaagacaagtacaccacaagaccagcaccagaggaaacaatcaatgaccccactaacccaaaacactattggagattccgtgtccatgtgacgttggagtctctgttggatgacaaggacatccaagcaaccatcaaggaccttgtcacaagtagcgggaggtccttccctggaaagaaggcggaaggtgccgacgaaagcggagagaaactatctaaggtgcagttgaatggtaaagcttaggaacggattgcaagaacagctgaaagcgaccacgattacaagtaaatagaataaggcaacagactgcattaccatgtcggttcgggtggtgatgtttctgctaggaaattcttacccctgtgaagttctttcaactctggaaataagaagtatcatcaatcaagtcagcaagtgaaataattcatccaattttggttttcattcataaattttctttgaggacccagttatttcttgttggcgtatttctgcatcagcaagccattgaaatggcatcttctgcagtttgtgttgtcctaatcaaccaaaatcggtgcgtctgtagtgcgtcgcatgtgaataaatgctactagttcttttagttgtctaattaatttatctgtctttgggaatagattctgttccagatttgtgttacactagaactcgtagtggggacagttccatttattttggtgctactactagcaaaagaaaaggtcatggctatggatggttctccagctgctttccctcgta

SEQ ID NO: 1891 - DNA, 3215 bp, Brachypodium distachyon
tcgcaggtgccgctttcccatgctcgccacccgctcctccgccctccgtcgttaacgtcgccttcacacccgggacgtcctcttcttcatccttggcgccttcctccctctcctctcctctacccagccgtcctctcctcctcttgttccgtcgctgattcggtgctcatttctggccgcgcccattggcgccgctcgtgctcggtgaagatatggtgaaatctctacatgtgactgtgatcttcaaattaccgtactacacgcaatggggacaaagccttgtcattgctggctctgaaccggcactgggatcttggaatgtcaagcaaggattggccttgagcccagttcaccaagggaatgctctaatttggtgtggccaactttcggttgctgctggcttcacctgtgagtacagttatcatgtagtggatgatcacaagaatgttttgagatgggagtctggggagaaaaagaaattagtgctgccagagggtgttcaggatggagacgtagtcgagatccgtgactggtggcaggatgcttctgaagctcttttccttcgaagtgcattcaagaatgtcattttcagcgaaaatgaaaatgctaaaagagaattgaagtctgcttccctcagcaaaagtttggaccctgaagatattgtcgtgcaatttattattagttgtcctcgactaggagctggctctactgttgtcgtcacaggaagtaacccttcaataggaaattggcgagctcaagatggcctcaagctgaactacgttggagattccatttggaaggcaaactgtgtgttgcggaaatctgagttcccagtcaaatataaatattgtcaaattagtgaagcaggagcatctacattggagttcggtccaaacagagaggtcgatgtggattcaccatccagatacatcctactatctgatggctccctacgggaatcaccatggaggggtgctggtgttgccgtgccaatgttttcaatcaggtcaaatgaggaccttggtgttggagagttcctagatcttaaacttcttgttgactgggcagtcaattcgggttttcatcttgttcagatccttcctatcaatgatacttcagttcaccagatgtggtgggattcatatccatacagctcactctctgtatttgcgttacaccccttgtacctgagagtacaagcactttcagatgcaattccaaaggatgttaaggaagagattttgcaagcaaagaaacaattggacaagaaggatgttgactatgaggcagcaatggccacaaaactgtcaattgccaaaaaaatattcaatttagaaaaagacaaagtattaagttccgcttcgttcaagaagttcctatctgaaaatgaggaatggttgaaaccatatgctgtattttgctttctgcgggatttctttgagacatcagatcacagccaatggggtcggttttctcagttctcgaaggaaaagcttgataagcttgttgcagaaggtactttgcaccatgatattattcgctttcattactatatccaataccatctatatacgcaattatcagaggcagctgcatatgcaaggaaaaacaaggttattctgaaaggagatttacctattggtgttgataggaatagtgtggatacttgggtataccctaccttatttcgcatgaatacagcaactggtgcacctccagattattttgacaaaaatggacaaaactggggtttccctacatataactgggaggagatgtcaaaggataattatgggtggtggcgagctcgtctgacgcagatggcaaaatacttcacagcttataggatagaccatattttgggtttctttaggatatgggagcttccagatcatgctgcgacaggtttgatcggaaaatttagaccttcgattcctcttagtcaggaggagcttctgggcgatggcatttgggattttgaccggatgagccgtccatatattcgtcaggatatgttggaggagaagtttggatctttttggacagttattgcagctaactttctgaatgaatatcagaagcaatgctacgagttcaaagaggaatgcaacactgagaaaaagattattgcaaagcttaaaaccagtcccgaaaaatcactctggctggagaaagaagacagtgttcggcgtggtctgtttgatctactacagaatatagtcctcattagagatccagaggaccccacgaagttttatccccgttttaacctggaagacacttcaaattttagggacttagatgaacatagcaaaaatgtccttagaagattatattatgactattatttcactcgccaagaaaatctttggcgtcaaaatgcgctgaagactctgcctgtcctgttggatgcatcagatatgctggcatgcggggaagatcttggtcttatccctgcttgtgttcatcctgttatgcaagaactagggttgattggattgcgtatccagagaatgcctagtgaaccaaactgtgaatttggtattccatctcagtatagctatatgacggtttgtgctccctcatgtcatgattgctccacactacgtgcttggtgggaagaagaagcagggagaagaagtcgcttttacaagggtgtaattggtagcgacaaggagcctccatctcgttgcaccccagaagtggttcacttcattgttcagcagcattttgatgccccatcaatgtgggcaatctttccgctacaggacctgctcgcactgaaagacaagtacaccacaagaccagcagtggaggaaactatcaacgaccccactaacccaaagcattactggagattccgcctacatgtgccactggagtctatgttggaggacaaagacatccaagcaaccatcaaggaccttgtcacaagtagtgggaggtcatttcctggcaagaaaacggaggcttccaaaggacagtcgagtggtaaaccataggaaaaaggaccaccgcaagaacggtcgtcgaacgggatcacgattacaagtaaatagaataaagtgatgcatttcatcaccacgtccgcgtagctgatcttgtttcagctggaaactgtttacgctaattccctttcgaactccgaaaaataataagtaccagtatcatctatcaagcctgctcgtggaataaattatccttggtctcgattt

SEQ ID NO: 1892 - DNA, 3002 bp, Zea mays
atggcgacctcgggaaagaaacacctgaattcagtgaccttgctgttcaaactaccgtattacacgcaatggggccagagcttgctgattgccgggtcggaaccagcactcgggtcgtggaatgtcaagcaaggagtatctctcagtccagtccatcaggacagtgagctaatctggtgtgggagcgtgtctgttgttgccggctttacctctgagtacaagtactatgtggtggatgacaagaagaatgtgttgagatgggaggctggggagaaaaggaaactagtcctgccggagggcgtgaaggaaggagacgtaattgaaatccgtgactggtggcaggatgcttctgaagctctattcttcagaagtgcattcaagaatgtcattttcaatgctactgaaggtgttaaaaaggaatcacagtcagtgtccctcaacaaaagtttggatcctgaagatatcgttgtccagttcgtgattagctgtcctcggctcgtatctggatctactgtcatcgtcactggaagtaaccctcaattaggaagatggcaaactcaagatggtctcaagctgagctatgttggagattccttatggaaagcaagctgtgctttacggaagtctgagttccctataaaataccttttgcaaatgattgttcccttaatcttttattggatgcgccacttttagctgatgcaccatggaggggtgcaggtgttgctgtacccatgttttcaatcagatcagatgaggaccttggcgttggagaatttctagatcttaaacttcttgttgactgggcagtcaattcgggcttccatcttgttcagctccttccaatcaacgatacttcagttcatgggatgtggtgggattcttatccgtacagctccctgtctgtgtttgctttgcatcccttgtacctgagggtacaagcactttcagatgcaattcctgtggatgttaaggaagaaattcagcaggcgaagaagcaattggataaaaaggatgtcgactacgaggcagcattgtccacaaaattgtcgattgctagaaaaatattcaatttagaaaaggaaaaagtgctaaactccagttctttcaagcagttcttatctgaaaacgaggaatggttgaaaccatatgcggcattttgctttttgcgggactttttcgagacatctgatcacagtcaatggggtcgtttttctcagttttccaaggataagcttgacaaacttatttgtgaaggtactttacaccatgacattatacgttttcattactatgttcagtaccatctatatatacaattatctgaggcagcaacatatgcaagaaagaaaaatgttatcctgaaaggtgatttacctattggtgttgataggaatagtgtcgatacatgggtatacccaaccttgtttcgcatgaataccgctactggagcgcctcctgattattttgacaagaatggacaaaattggggttttcctacatataactgggaggagatgtcaaaggataattatgggtggtggcgagctcgtctgacacagatggcaaagtacttcacagcatacaggatagaccacatcttgggtttctttaggatatgggagcttccagatcatgctgcaacaggtttagttgggaaatttagaccttccatccctcttagtcaggaggagcttctaagtgaaggtctatgggattttaatcggatgagccaaccatacattcgtcaggaaatactggaggagaagtttggatccttttggacagtcattgcagccaattttctaaatgagtaccagaagcagtgttatgagtttaaagaagattgcaacacagagaaaaagattattgtaaagattaaaacaagtgctgaaaagtcactgtgggtagagaaagaggacaatatccgccgtggccttttcgatttactacagaatattgtccttatcagagatccagaggactccacaaaattctatccccgtttcaacctggaagacacatcaagttttagggaccttgatgaacacagcaaaaatatcctcagaagattgtattatgactattattttgttcgccaagaaaatctctggcgccaaaatgccctgaagactttgcctgtcctgctgaactcgtcagatatgttagcatgtggagaggaccttggccttatccctgcttgtgttcaccctgttatgcaagaactggggttgattggattgcgtatccaaagaatgcctagtgaaccaaacttggaatttggtattccttctcagtatagctatatgacggtttgtgctccctcatgtcatgactgctctacattacgtgcttggtgggaagaagatgaaggaagaagaagtcgtttctacaagactgtagttggcagtgatgaggagcccccatctcgttgcaccccggaagtagtgcacttcattgttcagcagcattttgacgctccatcaatgtgggcaatctttccacttcaggacctccttgcactgaaagacaagtacaccacaagaccagcgccagaggaaacaatcaatgaccccactaacccaaagcactattggagattccgtgtccacgtgacattggagtccctgctgaacgacaaggacatccaggcaaccatcaaggacctggtcacaagcagtgggaggtccttccccggaaagaaggcggaaggtgccgacgagagcggggagaagctgtccaaggtgcagctgaatggtaaagcttaggaaaggattgcgagagctgctggaagtgaccacggttacaagtaaataaatagaataaggcgacagattgcatcaccgtgttgatccaggtgatgctgtttctggtaggaaattcttacccatgtgatgttctttcaactctggaaataagaagcaccctctaccaagtcagaaagtgaaataatccatccagtgtcggttttcattaatagaattttcgttgaccgcccagtt

SEQ ID NO: 1893 - DNA, 3419 bp, Hordeum vulgare
tccggtcaccgcggctcacaggtgccgctcccccatgctcgcccaccgtcgttaacgtcaccctcacacccgtcctcttcgccatctctttggcatcgtccctccctcccgtgcctccatccatgctctcgctctcctgagcctcctcctcctcctcctccttgctctgccgccgattccatccccgcccgtggccgccattggcgccgtccctgctcgctgaagagatggggaagaacacggtgaccgtgatcttcaagctgccgtactacacgcaatgggggcagagcctcgtcatcgccggctccgcgccggcgctcgggtcctggagcgtcaagcaggggctgtccctgagcccggttcaccaggggaacgcgctggtctggtgtggccaggtttcggtcgccgccggcttcacatgtgagtacagctaccatgtggtggacgaccacaagaacgttctcagatgggagtccggggagaagaagaagctcgtggtgcccgagggcgtgcaggacggcgaagtcgtcgaggtccgcgactggtggcaggataattctgaagctcttttccttcgaagtgcattcaagaatgttatcttcagcgcagctgacaacgctaaaagagaattgcagtcttcttccctcaccaaaagtttggatcctgaagatactgtcgtgcaatttattatcagttgtcctcggctagcatctggctctactgttgtcgtcacaggaagtaaccctgcggtaggaaattggaaagctcaagatggcctcaagctcaactatgttggagattccatttggaaagccaactgtgtgttgcggaagtctgagttcccagtaaaatataagtactgtcaagttagtgaagcaggagtcacttcattggagttcggcccaaacagagaggttgatgtggacttatcatcacccaagccatccagatacgtcttattatctgatggctccctccgggaagcaccatggaggggtgctggtgttgccgtaccaatgttctcaatcaggtcaaatgaggatcttggtgttggagaattcctagatcttaaacttcttgttgactgggcagtcaactcgggttttcatcttgttcagctccttcctatcaatgatacttctgttcataagatgtggtgggattcatatccatatagctcactctccgtatttgcattgcaccccttgtacctgagagtgcaggcactttccgatgctattccagcggatgttaaagaagagatttcgaaagcaaagaaggagttggacaaaaaggacgtcgactatgaggcagcgctggccacgaaactcacaattgccaaaaaaatatttaatttagaaaaggacaaagtgctaaattcagctccgttcaagcagttcttatctgaaaatgaggaatggttgaaaccatatgctgcattttgctttcttcgggatttcttcgagacatcagatcacagtcagtggggtcggttttctcagttttccaaggagaagcttgacaagctagtcgcgccagatgctttgcaccatgatattatacgctttcactactatgtccaatatcatctatttacacaattatcagaggcagctacatatgcaaggaagaacaaggttattctgaaaggagatttacctattggtgttgataggaacagtgtggatacttgggtataccctacactatttcgcatgaataccgctactggtgcacctccagattactttgacaagaatggacaaaattggggttttcctacgtataactgggaggagatgtcaaaggataattatgggtggtggcgagctcgtctgacacagctatcaaaattcttcacagcgtataggatagaccatattttgggtttctttaggatatgggagcttccagaccatgctgccacaggtttggtcggaaaatttagaccttcaatccctcttagtcaggaggagcttctaggtgatggtatctgggattttgatcggatgagccgcccatatattcgtcaggacatgctggaggagaagtttggatctctttggacagttgttgcagccaactttctgaacgagtatcagaaacactgctacgagttcaaagaggaatgcaacaccgagaaaaagattattacaaaggttaaaaccagtcctgaaaaatcactctggctggagaaagaagacagtattcggcgtggtctgttcgatcttctacagaatatagtcctcatcagagatcctgaggactccacaaagtactatccccgttttaacctggaggatacttcaagttttagggatttagatgaacatagcaaaaatgtccttagaagattataccatgactattatttcgttcgccaagaaaatctgtggagacaaaatgcgctgaagactctgcctgttctattgaattgttcggatatgttggcatgcggggaagatcttggtcttattcctgcttgtgttcaccctgttatgcaagaactcgggttgattggattgcgtatccagagaatgcctagtgaaccaggcttggaatttgatatcccgtccaactacagctatatgacggtttgtgctccctcatgtcatgattgctccacattacgtgcttggtgggaaggagatgaagggacaagaagtcgtttttacaagaccgtaattggcagcgacaaagaggccccatctcgttgcaccccagaagtagtgcacttcattgttcagcagcatttcgatgcaccatcaatgtgggcaatctttccgctacaggatctgctcgcgctgaaagacaaatacaccgcaagaccagcagcggaggaaacaatcaacgaccccactaacccgaagcattactggagattccgcctacatgtgccactggagtccatgctggaggacaaggacatccaagcgaccatcaaggagctcgtcacaagcagtgggaggtcgttccctggcaagacggtggacaaggcccagccgaacgccaaaaaatcgtaggaacaacaaaggaccacaaagaacggtcagtcatcgccgggcgggatcatgatcacgagaagaagagagggagatataggataaataaggcggtgtatttaccgccatgtccgatgagctgatgttgtttcagctagagaaaaaatctttacgcccgctcataattcctttttcgacgccctggagaataataactactggtatatgattctatatcaaagccggcttgtgaaataaatgatcccgcgccccagttttttgtcgacgaaatcttcctccacggctagctttcacttgttattttttctccttggctaagagaaaacctgttctcttttctgcatatttttctacttatgtgtgattcaaggccctgaaatggaggttcctgatgcc

SEQ ID NO: 1894 - DNA, 3419 bp, Hordeum vulgare
tccggtcaccgcggctcacaggtgccgctcccccatgctcgcccaccgtcgttaacgtcaccctcacacccgtcctcttcgccatctctttggcatcgtccctccctcccgtgcctccatccatgctctcgctctcctgagcctcctcctcctcctcctccttgctctgccgccgattccatccccgcccgtggccgccattggcgccgtccctgctcgctgaagagatggggaagaacacggtgaccgtgatcttcaagctgccgtactacacgcaatgggggcagagcctcgtcatcgccggctccgcgccggcgctcgggtcctggagcgtcaagcaggggctgtccctgagcccggttcaccaggggaacgcgctggtctggtgtggccaggtttcggtcgccgccggcttcacatgtgagtacagctaccatgtggtggacgaccacaagaacgttctcagatgggagtccggggagaagaagaagctcgtggtgcccgagggcgtgcaggacggcgaagtcgtcgaggtccgcgactggtggcaggataattctgaagctcttttccttcgaagtgcattcaagaatgttatcttcagcgcagctgacaacgctaaaagagaattgcagtcttcttccctcaccaaaagtttggatcctgaagatactgtcgtgcaatttattatcagttgtcctcggctagcatctggctctactgttgtcgtcacaggaagtaaccctgcggtaggaaattggaaagctcaagatggcctcaagctcaactatgttggagattccatttggaaagccaactgtgtgttgcggaagtctgagttcccagtaaaatataagtactgtcaagttagtgaagcaggagtcacttcattggagttcggcccaaacagagaggttgatgtggacttatcatcacccaagccatccagatacgtcttattatctgatggctccctccgggaagcaccatggaggggtgctggtgttgccgtaccaatgttctcaatcaggtcaaatgaggatcttggtgttggagaattcctagatcttaaacttcttgttgactgggcagtcaactcgggttttcatcttgttcagctccttcctatcaatgatacttctgttcataagatgtggtgggattcatatccatatagctcactctccgtatttgcattgcaccccttgtacctgagagtgcaggcactttccgatgctattccagcggatgttaaggaagagatttcgaaggcaaagaaggagttggacaaaaaggacgtcgactatgaggcagcgctggccacgaaactcacaattgccaaaaaaatatttaatttagaaaaggacaaagtgctaaattcagctccgttcaagcagttcttatctgaaaatgaggaatggttgaaaccatatgctgcattttgctttcttcgggatttcttcgagacatcagatcacagtcagtggggtcggttttctcagttttccaaggagaagcttgacaagctagtcgcgccagatgctttgcaccatgatattatacgctttcactactatgtccaatatcatctatttacacaattatcagaggcagctacatatgcaaggaagaacaaggttattctgaaaggagatttacctattggtgttgataggaacagtgtggatacttgggtataccctacactatttcgcatgaataccgctactggtgcacctccagattactttgacaagaatggacaaaattggggttttcctacgtataactgggaggagatgtcaaaggataattatgggtggtggcgagctcgtctgacacagctatcaaaattcttcacagcgtataggatagaccatattttgggtttctttaggatatgggagcttccagaccatgctgccacaggtttggtcggaaaatttagaccttcaatccctcttagtcaggaggagcttctaggtgatggtatctgggattttgatcggatgagccgcccatatattcgtcaggacatgctggaggagaagtttggatctctttggacagttgttgcagccaactttctgaacgagtatcagaaacactgctacgagttcaaagaggaatgcaacaccgagaaaaagattattacaaaggttaaaaccagtcctgaaaaatcactctggctggagaaagaagacagtattcggcgtggtctgttcgatcttctacagaatatagtcctcatcagagatcctgaggactccacaaagtactatccccgttttaacctggaggatacttcaagttttagggatttagatgaacatagcaaaaatgtccttagaagattataccatgactattatttcgttcgccaagaaaatctgtggagacaaaatgcgctgaagactctgcctgttctattgaattgttcggatatgttggcatgcggggaagatcttggtcttattcctgcttgtgttcaccctgttatgcaagaactcgggttgattggattgcgtatccagagaatgcctagtgaaccaggcttggaatttgatatcccgtccaactacagctatatgacggtttgtgctccctcatgtcatgattgctccacattacgtgcttggtgggaaggagatgaagggacaagaagtcgtttttacaagaccgtaattggcagcgacaaagaggccccatctcgttgcaccccagaagtagtgcacttcattgttcagcagcatttcgatgcaccatcaatgtgggcaatctttccgctacaggatctgctcgcgctgaaagacaaatacaccgcaagaccagcagcggaggaaacaatcaacgaccccactaacccgaagcattactggagattccgcctacatgtgccactggagtccatgctggaggacaaggacatccaagcgaccatcaaggagctcgtcacaagcagtgggaggtcgttccctggcaagacggtggacaaggcccagccgaacgccaaaaaatcgtaggaacaacaaaggaccacaaagaacggtcagtcatcgccgggcgggatcatgatcacgagaagaagagagggagatataggataaataaggcggtgtatttaccgccatgtccgatgagctgatgttgtttcagctagagaaaaaatctttacgcccgctcataattcctttttcgacgccctggagaataataactactggtatatgattctatatcaaagccggcttgtgaaataaatgatcccgcgccccagttttttgtcgacgaaatcttcctccacggctagctttcacttgttattttttctccttggctaagagaaaacctgttctcttttctgcatatttttctacttatgtgtgattcaaggccctgaaatggaggttcctgatgcc

SEQ ID NO: 1895 - DNA, 3199 bp, Zea mays
gacatggcgacctcgggaaagaaacacctgaattcagtgaccttgctgttcaaactaccgtattacacgcaatggggccagagcttgctgattgccgggtcggaaccagcactcgggtcgtggaatgtcaagcaaggagtatctctcagtccagtccatcaggacagtgagctaatctggtgtgggagcgtgtctgttgttgccggctttacctctgagtacaagtactatgtggtggatgacaagaagaatgtgttgagatgggaggctggggagaaaaggaaactagtcctgccggagggcgtgaaggaaggagacgtaattgaaatccgtgactggtggcaggatgcttctgaagctctattcttcagaagtgcattcaagaatgtcattttcaatgctactgaaggtgttaaaaaggaatcacagtcagtgtccctcaacaaaagtttggatcctgaagatatcgttgtccagttcgtgattagctgtcctcggctcgtatctggatctactgtcatcgtcactggaagtaaccctcaattaggaagatggcaaactcaagatggtctcaagctgagctatgttggagattccttgtggaaagcaagctgtgctttacggaagtctgagttccctataaaatatccttttgcaaatgattgttcccttaatcttttattggatgcgccacttttagctgttggccgatatcacgtccttaattttttttctgagaatgattgtccttaacatcttctccacatacaaatattgtcaaatcagtcaagcaggaaactctacattggagcttggcccaaacagggaggttaatgttgatttatcatcacccaagcaatccagatatattgtgttatctgatggtgctcttagggatgcaccatggaggggtgcaggtgttgctgtacccatgttttcaatcagatcagatgaggaccttggcgttggagaatttctagatcttaaacttcttgttgactgggcagtcaattcgggcttccatcttgttcagctccttccaatcaacgatacttcagttcatgggatgtggtgggattcttatccgtacagctccctgtctgtgtttgctttgcatcccttgtacctgagggtacaagcactttcagatgcaattcctgtggatgttaaggaagaaattcagcaggcgaagaagcaattggataaaaaggatgtcgactacgaggcagcattgtccacaaaattgtcgattgctagaaaaatattcaatttagaaaaggaaaaagtgctaaactccagttctttcaagcagttcttatctgaaaacgaggaatggttgaaaccatatgcggcattttgctttttgcgggactttttcgagacatctgatcacagtcaatggggtcgtttttctcagttttccaaggataagcttgacaaacttatttgtgaaggtactttacaccatgacattatacgttttcattactatgttcagtaccatctatatatacaattatctgaggcagcaacatatgcaagaaagaaaaatgttatcctgaaaggtgatttacctattggtgttgataggaatagtgtcgatacatgggtatacccaaccttgtttcgcatgaataccgctactggagcgcctcctgattattttgacaagaatggacaaaattggggttttcctacatataactgggaggagatgtcaaaggataattatgggtggtggcgagctcgtctgacacagatggcaaagtacttcacagcatacaggatagaccacatcttgggtttctttaggatatgggagcttccagatcatgctgcaacaggtttagttgggaaatttagaccttccatccctcttagtcaggaggagcttctaagtgaaggtctatgggattttaatcggatgagccaaccatacattcgtcaggaaatactggaggagaagtttggatccttttggacagtcattgcagccaattttctaaatgagtaccagaagcagtgttatgagtttaaagaagattgcaacacagagaaaaagattattgtaaagattaaaacaagtgctgaaaagtcactgtgggtagagaaagaggacaatatccgccgtggccttttcgatttactacagaatattgtccttatcagagatccagaggactccacaaaattctatccccgtttcaacctggaagacacatcaagttttagggaccttgatgaacacagcaaaaatatcctcagaagattgtattatgactattattttgttcgccaagaaaatctctggcgccaaaatgccctgaagactttgcctgtcctgctgaactcgtcagatatgttagcatgtggagaggaccttggccttatccctgcttgtgttcaccctgttatgcaagaactggggttgattggattgcgtatccaaagaatgcctagtgaaccaaacttggaatttggtattccttctcagtatagctatatgacggtttgtgctccctcatgtcatgactgctctacattacgtgcttggtgggaagaagatgaaggaagaagaagtcgtttctacaagactgtagttggcagtgatgaggagcccccatctcgttgcaccccggaagtagtgcacttcattgttcagcagcattttgacgctccatcaatgtgggcaatctttccacttcaggacctccttgcactgaaagacaagtacaccacaagaccagcgccagaggaaacaatcaatgaccccactaacccaaagcactattggagattccgtgtccacgtgacattggagtccctgctgaacgacaaggacatccaggcaaccatcaaggacctggtcacaagcagtgggaggtccttccccggaaagaaggcggaaggtgccgacgagagcggggagaagctgtccaaggtgcagctgaatggtaaagcttaggaaaggattgcgagagctgctggaagtgaccacggttacaagtaaataaatagaataaggcgacagattgcatcaccgtgttgatccaggtgatgctgtttctggtaggaaattcttacccatgtgatgttctttcaactctggaaataagaagcaccctctaccaagtcagaaagtgaaataatccatccagtgtcggttttcattaatagaattttcgttgaccgcccagtt

SEQ ID NO: 1896 - DNA, 1591 bp, Panicum virgatum
ggaatacgaagcaagcacggcaccgggaaggaaatggccacgcggccactcgccaccgcgctcaccctctccaaaaccccacgcgccccctcctcctcctcctcctccggctcccaccactccccacctgccctcgtccgccgcctccaaaccctagcccgcgcgctcgcgtcctcgtctccccaggccatggcgtcggccccggcccccaagaaggtgctggtccccatcgcgaacgggacggagccgatggaagcggtcatcaccatcgacgtgctccggcgcgcgggggccgacgtcgccgtcgcatccgtcgagccggcctccgcgaccgtcgcggcggcgtggggcgtcaagctcgccgcggacgcgctcctcgccgacatcgccgacgccgaattcgacctcatctctctccccggagggatgcctggggcttccaattttagagactgcaaacttttggagaatgtggttagaaaacatgtagagaagggcaagctttatgctgcgatatgtgctgcaccagctgtggctctaggaacttggggtttgctcaatggcttaaaggcaacatgtcatccttcgttcatggataaacttccttcagaggtgcatgctgtggaatcaagggtgcagattgatgggaagtgtgttaccagccgtgggccaggaacagccatggagtattctattgttttggttgagcaactatatgggaaggaaaaggctgaagaagttgctgggccgatggttatgcgccctcagcatggtgtggaattctctacgaaagagctgaattcaactagttggaatgttggtgaaacacctagtattcttgtaccaattgctaatgggacagaggagatggaggcaactatgatcattgacattctgcgcagggcgaaagcaaatgttgtggttgcctcgttggaagacaagttggaggttgttgcatcccggaaagtgaagatggttgctgatgtgatgttggacgatgctcttaagcagcaatatgatctcattctgctacctggtggtcttggtggtgctgaagcctatgcaaaatctgataaactgatgggtctgatcaagaagcaagctgaggcaaacaaattgtatggcgctatatgtgcctctcctgcaatcgctcttgaaccacatggcctcctaaagggaaagaaagctacatcatatcctgctatgtggaacaaacttgcggaccaaagtgagtgcaagaacagagttgtcgtcgacggcaacctgatcacaagccaaggtccaggcacttctatggaattctctcttgccatagtggagaaactctttggccgggagaaggcccgtgagcttgccaaaaccatggttttcgtttgagttcagcaacttcagttggtatgtattaggtccctggagtaccaactttttgtgaatgtgaggcatgctatgttttccccttgtgtggaatgtactttaaggccctttttagcaacaataacatgacaccttgtaatgagtttaatatgcaaataaagttgatgcgaacatgcatatagatgtttcctgatcataaaaatctcaccttgtaagg

SEQ ID NO: 1897 - DNA, 1662 bp, Avena sativa
gaaaaaaaacaacaacttgacacccaccccatccggtcgacgcacacggtgtccgcgcttctggaacagcccaccgaagctttgagaaagaagcaccgaaaaaaatggccacgcggccactcgtcttctccactctcagaaccccctcctccccctccccacctcctctcctccgccgcctccaaaccctaacccgcgcgctcgcttcgtcgtccccgcagaccatggcgtcttctcctgcccccaagaaggtgctggtgccgatcgcgaacgggacggagccgatggaggccgtcatcaccatcgacgtgctgcgccgcgcaggggccgaagtctccgtcgcctccgtcgagcctgcggctgcgcaggtcgccgccgcctggggcgtcaagctcgtcgccgacgccctcctcgacgacctcgccgaaaccgatttcgacctcatctcgctccccggagggatgcctggggcttccacattcagagacagcaaagttttggagaatatggttaaaatacatgtagagaagggtaagctttacgctgcagtatgtgctgcgccagctgtggcactaggatcttggggtttgctcaatggattaaaggcaacttgctatcctgcttttatggataaacttccttcagaggtgaacgctgtagaatcaagggtgcagatcgatgggaaatgtgtaactagccgcggcccaggaacaaccatggaatattctgttgttttggttgaacaactgtgtggcaaagaaaaggctgatgaagtagctggaccaatggttatgcgtcctcagcatggcgcggagttttcaatgaaggagctgaattcaattagttggaatgttggtgaaggtcctcagattcttgtgccaattgctaatggtacagaggagatggaggcaattatgattattgacattcttcgaagggcgaaagcaaatgttgttgtggcatctttggaaggcaccttggagattgttgcatccaggaacgtgaagatggttgctgatgtgctattgaatgatgcccttaagcagcagtatgatctcattttgttacctggtggtcttggcggtgcccaagcgtatgccaaatcagatgaattgatcggtctgatcaagaagcaagctgaggcaaataaactgtatggggccatatgcgcctcccctgcaattgcccttgagccacatggcctgctgaagggaaagaaggctacatcctatcctgctatgtggaacaaactcacggaccaaagtgaatgcaagaacagagtagttgtggatggaaacctgatcactagccaaggtccaggcacttccatggaattctcgcttgccattgtggagaagctctttggaagggaaagggcccttgagctggccaagaccatggttttcgtgtgagttatgttgctaccggaaagttccaggtgagacttgcctgaaccaatttcaaagttcagttccaggtcaggctagagtgacactttgtgaataggaggcatgctatgtagctggtgtggaatgtgtagtctttttctcttattacaataacacaacggcttgtaatggatgcaaatgctataaagagttatgaatatgatgcagtgggaatgcctcactttctgaataaaatgtttaatgcttctcaact

SEQ ID NO: 1898 - DNA, 1662 bp, Avena sativa
gaaaaaaaacaacaacttgacacccaccccatccggtcgacgcacacggtgtccgcgcttctggaacagcccaccgaagctttgagaaagaagcaccgaaaaaaatggccacgcggccactcgtcttctccactctcagaaccccctcctccccctccccacctcctctcctccgccgcctccaaaccctaacccgcgcgctcgcttcgtcgtccccgcagaccatggcgtcttctcctgcccccaagaaggtgctggtgccgatcgcgaacgggacggagccgatggaggccgtcatcaccatcgacgtgctgcgccgcgcaggggccgaagtctccgtcgcctccgtcgagcctgcggctgcgcaggtcgccgccgcctggggcgtcaagctcgtcgccgacgccctcctcgacgacctcgccgaaaccgatttcgacctcatctcgctccccggagggatgcctggggcttccacattcagagacagcaaagttttggagaatatggttaaaatacatgtagagaagggtaagctttacgctgcagtatgtgctgcgccagctgtggcactaggatcttggggtttgctcaatggattaaaggcaacttgctatcctgcttttatggataaacttccttcagaggtgaacgctgtagaatcaagggtgcagatcgatgggaaatgtgtaactagccgcggcccaggaacaaccatggaatattctgttgttttggttgaacaactgtgtggcaaagaaaaggctgatgaagtagctggaccaatggttatgcgtcctcagcatggcgcggagttttcaatgaaggagctgaattcaattagttggaatgttggtgaaggtcctcagattcttgtgccaattgctaatggtacagaggagatggaggcaattatgattattgacattcttcgaagggcgaaagcaaatgttgttgtggcatctttggaaggcaccttggagattgttgcatccaggaacgtgaagatggttgctgatgtgctattgaatgatgcccttaagcagcagtatgatctcattttgttacctggtggtcttggcggtgcccaagcgtatgccaaatcagatgaattgatcggtctgatcaagaagcaagctgaggcaaataaactgtatggggccatatgcgcctcccctgcaattgcccttgagccacatggcctgctgaagggaaagaaggctacatcctatcctgctatgtggaacaaactcacggaccaaagtgaatgcaagaacagagtagttgtggatggaaacctgatcactagccaaggtccaggcacttccatggaattctcgcttgccattgtggagaagctctttggaagggaaagggcccttgagctggccaagaccatggttttcgtgtgagttatgttgctaccggaaagttccaggtgagacttgcctgaaccaatttcaaagttcagttccaggtcaggctagagtgacactttgtgaataggaggcatgcgatgtagctggtgtggaatgtgtagtctttttctcttattacaataacacaacggcttgtaatggatgcaaatgctataaagagttatgaatatgatgcagtgggaatgcctcactttctgaataaaatgtttaatgcttctcaact

SEQ ID NO: 1899 - DNA, 1571 bp, Triticum aestivum
aggggttgttgcccctattgcacagtgcacacatgacatcaccatccccatccactcggcgcacacgctgtccgcccttctggaacagcccaccgaagctccgagaaaagagcaccgaaagaaatggccacgcggccacccgtcttctccactctcacagcgtccttctccccttccccacctcatctgctacgccgcctccaaaccctaacccgcgcgcttgcgtcctcctccccgcagcccatggcgtcgtctcctcccctgaagaaggtgctggtgcccatcgcgaacgggacggagccgatggaggccgtaatcaccatcgacgtgctgcgccgcgcgggggcggacgtcgccgtcgcctccgtcgagcctggggccgcgcaggtcgccgcatcctggggcgtcaagcttgccgccgacacgctcctcgccgacctagccgaagctgattttgaccttatctcgcttcctggagggatgcctggggcttccacctttagagactgcaaaattttggagaatatagttaaaaaacatgcagagaagggcaagctttatgctgcagtatgtgctgcaccagctgtggcgctgggagcttggggtttgctcaatggattaaaggcaacttgtcatccttcagtcatggacaaacttccttcagaggtgcaagccgtagaatcaagggtacagattgatgggaattgtgtgactagccgtggaccaggaacaaccatggagtattctgttgttttggttgaacaactgtatggcaaagaaaaggccgatgaagttgctgggccaatggttatgcgtccccagcatggcgcagagttttcaatgaaggagctgaattcgactagttggaatgttggtgaaaatcctcaaattctcgtaccaattgctaatggcacggaggagatggaggcagttatgatcattgacattcttcggagagcgaaagcaaatgttgtcgttgcatccttggaaggcactttggagattgttgcatccaggaatgtgaagatggttgctgatgtgcttttggatgatgcgcttaagcagcagtacgatctcattttgttacctggtggtcttggtggtgcccaagcatatgccaaatcagataaactgattggattgatcaagaagcaagccgaggcaagcaaactgtatggagccatatgtgcctccccagcaattgcccttgagccacatggcctgctgaagggaaagaaggctacatcctatcctgctatgtggagcaaactcgcggaccaaagcgaatgcgagaacagagtcgtcgtggatggcaacatgatcactagccaaggtccgggcacttccatggaattctcgcttgccatcgtggagaagctctttggaagggaaagggccttcgagctggccaaatcaatggttttcgtgtgagtgctgttgctactagagagtgacgctgtttgtgaatatgcgaggggatgctgtgttagctggtggtttttgttgcttagtactacaaataacgcaacagctcgtaatggatggaaatgcaataaagagttcagatgaat

SEQ ID NO: 1900 - DNA, 1538 bp, Triticum aestivum
cacgctgtccgcccttctggaacagcccaccgaagctccgagaaaagagcaccgaaagaaatggccacgcggccacccgtcttctccactctcacaacgtccttctccccttccccacctcctctgctacgccgcctccaaaccctaacccgcgcgcttgcgtcctcctccccgcagcccatggcgtcgtctcctcccctgaagaaggtgctggtgcccatcgcgaacgggacggagccgatggaagccgtaatgaccatcgacgtgctgcgccgcgcgggggcggacgtcgccgtcgcctccgtcgagcctggggccgcgcaggtcgccgcatcctggggcgtcaagcttgccgccgacgcgctcctcgccgacctagccgaagctgattttgaccttatctcgcttcctggagggatgcctggggcttccacctttggagactgcaaaattttggagaatatagttaaaaaacatgcagagaagggcaagctttatgctgcagtatgtgctgcaccagctgtggcgctgggagcttggggtttgctcaatggattaaaggcaacttgtcatcctttagtcatggacaaacttccttcagaggtgcaagccgtagaatcaagggtacagattgatgggaattgtgtgactagccgtggaccaggaacaaccatggagtattctgttgttttggttgaacaactgtatggcaaagaaaaggccgatgaagttgctgggccaatggttatgcgtccccagcatggcgcggagttttcaatgaaggagctgaattcgactagttggaatgctggtgaaaatcctcaaattctcgtaccaattgctaatggcacggaggagatggaggcagttatgatcattgacattcttcggagagcgaaagcaaatgttgtcgttgcatctttggaaggcactttggagattgttgcatccaggaatgtgaagatggttgctaatgtgctgttggatgatgcgcttaagcagcagtacgatctcattttgttacctggtggtcttggtggtgcccaagcatatgccaaatcagataaactgattggtttcataaagaagcaagcggaggcaaacaaactgtatggagccatatgtgcctccccagcaattgcccttgagccacatggcctgctgaagggaaagaaggctacatcctatcctgctatgtggagcaaactcacggaccaaagcgaatgcaagaacagagtcgttgtcgatggcaacctgatcactagccaaggtccaggcacttccatggaattctcgcttgccatcgtggagaagctctttggcagggaaagggccctcgagttggccaaatcaatggttttcgtgtgagttctgttgctactagagtcacactgcttgtgaatatacgaggggatgctgtgttagctggtggtttttatttcttatatactacaataacgcagcagctcgtaatggatggaaatgcaataaagagttaagatgaattcgatgcaaaacctgcccgggcggccgctcga

SEQ ID NO: 1901 - DNA, 1594 bp, Brachypodium distachyon
gcatacgttgtccgcggttctggaacagggacagacagccccaggaagaactagaagcaccaaaactccaaaagaaatggccacgctgtcgctggttttcacttccagaaccctcccaacctcctccccatctcatctcctccgccgcctccaaaccctaacccgcgctatcgcatcctcctcgccgcaggccatggcttcgtctcccacccccaagaaggtgctggtgcccatcgccaacgggacagagccgatggaggccgtcatcaccatcgacgttctccgccgcgcaggggtcgacgttgcagtcgcctccgtcgagcccggggccgcgcaggtcgctgcgtcctggggcgtcaagctcgctgcggacgccctccttgccgaccttgctgatgccgatttcgacctcatatcgctccccggagggatgcccggggcttccagctttagggactgcaaaattttggagaacatggttaaaaaacatgcagagaagggcaagctttatgctgcaatatgtgctgcaccagctgtggcactgggatcttggggtttgcttgatggattaaaggcaacttgttatccatcattcatggacaaacttccttcggaggtgaaagctgtagaatcaagggtgcagattgatgggaagtgtgtgaccagccgtgggccaggaacagctatggaatattctgttattttggttgaacaactatatggcaaagaaaaggctgatgaagttgctgggccaatggttatgcgtccccaacatggtgtggagttttcaatgaaggaactgaattcaactagttggaatgttggtgaatcacctcagattcttgttccaattgctaatggcacagaagagatggaagcaattatggttatcgacattcttcgaagggcgaaagcaaatgttgttgttgcatccttggaagacaatttggagattgttgcatccaggaacgtgaagatggttgctgatgtgctgttggatgaagccattaagcagcaatatgatcttattttgttacctggtggtcttggtggtgcccaagcatatgccaattcagataaactgattggtttaatcaagaagcaagccgagacaaacaaactgtacggagctatatgtgcctccccggcaattgcccttgaaccacatggcctgctgaagggaaagaaggctacgtcctatcctgctatgtggaacaaacttgcggaccaaagcgaatgcaaaaacagagttcttgttgatggcaacctgatcactagccaaggtccaggcacttccatggaattctcgcttgccatcgtggagaagctctttggaagggaaagggcccttgagctggccaaaacgatggtcttcgtatgagtcatgttgctacaagaaagttcccggtcagaccagagtatgctactgtctgtgaatatacgaggcatgctttgttagctgagggttcgtttttttacagcaagaacgcaacttgcaggatggaaatgcaataaaaagttctacagtacatgagtatgatgcagtccggtgaatttgaaaacgatcgtaatataatctgttatggttcctatc

SEQ ID NO: 1902 - DNA, 1577 bp, Triticum aestivum
  misc_feature (185)..(185): n is a, c, g, or t
aggggttgttgcccctattgcacagtgcacacatgacatcaccatccccatccactcggcgcacacgctgtccgcccttctggaacagcccaccgaagctccgagaaaagagcaccgaaagaaatggccacgcggccacccgtcttctccactctcacaacgtccttctccccttccccacctcntctgctacgccgcctccaaaccctaacccgcgcgcttgcgtcctcctccccgcagcccatggcgtcgtctcctcccctgaagaaggtgctggtgcccatcgcgaacgggacggagccgatggaggccgtaatcaccatcgacgtgctgcgccgcgcgggggcggacgtcgccgtcgcctccgtcgagcctggggccgcgcaggtcgccgcatcctggggcgtcaagcttgccgccgacacgctcctcgccgacctagccgaagctgattttgaccttatctcgcttcctggagggatgcctggggcttccacctttagagactgcaaaattttggagaatatagttaaaaaacatgcagagaagggcaagctttatgctgcagtatgtgctgcaccagctgtggcgctgggagcttggggtttgctcaatggattaaaggcaacttgtcatccttcagtcatggacaaacttccttcagaggtgcaagccgtagaatcaagggtacagattgatgggaattgtgtgactagccgtggaccaggaacaaccatggagtattctgttgttttggttgaacaactgtatggcaaagaaaaggccgatgaagttgctgggccaatggttatgcgtccccagcatggcgcagagttttcaatgaaggagctgaattcgactagttggaatgctggtgaaaatcctcaaattctcgtaccaattgctaatggcacggaggagatggaggcagttatgatcattgacattcttcggagagcgaaagcaaatgttgtcgttgcatctttggaaggcactttggagattgttgcatccaggaatgtgaagatggttgctaatgtgctgttggatgatgcgcttaagcagcagtacgatctcattttgttacctggtggtcttggtggtgcccaagcatatgccaaatcagataaactgattggtttcataaagaagcaagcggaggcaaacaaactgtatggagccatatgtgcctccccagcaactgcccttgagccacatggcctgctgaagggaaagaaggctacatcctatcctgctatgtggagcaaactcacggaccaaagcgaatgcaagaacagagtcgttgtcgatggcaacctgatcactagccaaggtccaggcacttccatggaattctcgcttgccatcgtggagaagctctttggcagggaaagggccctcgagttggccaaatcaatggttttcgtgtgagttctgttgctactagagtcacactgcttgtgaatatacgaggggatgctgtgttagctggtggtttttatttcttatatactacaataacgcagcagctcgtaatggatggaaatgcaataaagagttaagatgaattcgatgca

SEQ ID NO: 1903 - DNA, 1484 bp, Saccharum officinarum
cgcggccactcacctccgcgcttccgctctccaaaaccccgcgcgtcccctcctcacaccattcccctctcctccgccgcctccaaaccctaacccccgcgctcgcctcctcgtccccacaggccatggcgtcgtcccctgcccctaagaaggtgctggtcccgatcgcgaatgggacggagccgatggaggcggtcatcaccatcgacgtgctccgacgcgcgggggccgatgtcgccgtcgcctccgtcgagccgggggccgcgaccgtcgctgcctcatggggcgtcaagctcgccgccgacgcgctccttgccgacctggccgaggacgagttcgatctcatctctctccctggagggatgcctgggtcttccacttttagagactgcaaagttttggagaatatggtcaaaaaacatgtagagaagggcaagctttatgctgcaatttgtgctgcaccagccatggctttaggaacttggggtttgctcaatggcttaaaggcaacatgttatccttcgttcatggataaacttccttcagaggtgcatgctgtggaatcaagagtgcagattgatgggaagtgtgtgaccagtcgtggaccaggaacagccatggagtattctgttattttggttgagcaactatatggaaaggaaaaggctaaagaagttgctgggccaatggttatgcgtcctcagcatggtgtggaattctctataaaagagctgaatgcaactagttggaatgttggtgaaacgcctaatattcttgtaccaattgctagtgggacagaggagatggaagcaactatgataattgacattttgcgaagggcgaaagcaaatgttgtggttgcctccttggaagacaagctggagattgttgcatcccggaaggtgaagatgattgctgatgtgctgttggatgatgctcttaaggagcaatatgatctcattctgttacctggaggtctgggtggtgcggaagcatatgcaaaatctgataaactaatggatctgatcaagaagcaagctgaggcaaatagattgtacggagctatatgtgcctcccctgcgattgctctcgaaccacatggcctgctaaagggaaagaaaggtacatcctatcctgctatgtggaacaaacttgcagaccaaagcgaatgcaacaacagagttgttgttgatggtaacctaatcaccagccaaggccctgggacttctatggaattctcgcttgccatagtggagaaactctttggacgggagagagcccttcagcttgccaaaaccatggtttttgtatgagttcaaatggtacatgttaggttcctggagtatgtactttcttgtgaatatgaggcatgctatgttcattttcttgtggaatgtactctgaagccctttttaaatagaaataagaagaatacttgtaatgtgtttcatatgcaataaaaggtttgaggcgaacattaagcg

SEQ ID NO: 1904 - DNA, 1891 bp, Pennisetum glaucum
ggaaatggccacgcggcctctcgctcccgcccccgccctcccccgcctccccaaaacctcacgcggcctctccaccggctcccaccattccgcactccccctcgtccgccgcctccaaaccctaacccgctcgcttgcgtcctcgtcttcgtctcgccaagccatggcgtcggcccccacccccaagaaggtgctaatcccggtcgcgaatgggacggagcccatggaggcggtcatcaccatcgatgtgctccggcgcgcgggggccgacgtcgccgtcgcctccgtcgagccggggtcagcgaccgtcgcggcggcgtggggcgtcaagctcgctgccgacgtgcttctcaccgacatcgctgatgccgaattcgacctcatctccctgcctggaggaatgcctggatcatccacttttagagactgcaaacttttggagaatatggtcaaaaaacaagtagagaagggcaaactttatgctgcaatatgtgctgcaccagccatggctcttggaacttggggtttgctcaatggcttaaaggcaacatgctatccttcattcatggataagcttccttcagaagtgcatgctgtggaatcaagggtgcagattgataggaagtgtgtgaccagccgtgggccaggaacggccatggagtattctgttgttttggttgagcaactatatgggaaggaaaaggccgaagaagttactgggccgatggttatgcgccctcagcatggtgtggagttctctatgaaagagctgaattcaactagctggaatgttggtgaaacacctaatattcttgtaccaattgcgaatgggacagaggagatggaagcaactatgatcattgacattctgcggagggcgaaagcaaatgttgtggttgcctcgttggaagacaagttggaggttgttgcatctcggaaagtgaaaatggttggtgatgtgctattggatgatgctcttaagcagcaatatgatctcattcttctacctggtggtctgggtggtgctgaagcttatgcaaaatctgataaactgatggatctgatcaagaagcaagctgaggcaaacaaattttatggcgctatatgtgcctctcctgcaattgcacttgaaccacatggcctcctaaagggaaagaaggctacttcttatcctgctatgtggaacaaacttgcagaccaaagcgagtgcaagaacagagttgtagttgacggcaacttgatcacaagccaaggtccaggcacttcaatggaattctcacttgccatagtggataaactctttggccgggggagggctcttgagctcatgaacaccatggttttcatatgagtttagtaccttcagttggtgtgtttttggttcttggagtggacttttttgtcaatacgaggcatcctatgttctgtggaatctacttaaggccccttttagctgcaataacacgccaccttgtaatgataatatgcaataaaagttgggggcaagcatttgcatagacgattcctgatcataaatacgttcataaatatgtcacctactcacgttgtatagttgtatgacgatgtttttgctcttttggtctgttttatacttcctagtctccccacagtgaaattgggtgtatcagtgaagattgagcagccaatcattctgatatactatattcatttggcataggagctgggtgtccgttatgattaattaatattgtatacttaattagttttatgtggttgtaatcagctggtaacgggattggcatgctttttatgctaggctgcagtgatagcttaggaacctaaattgtgagtatcctgtgctgcctttcggctttctaggcctaaggctggctattttttatccccataa

SEQ ID NO: 1905 - DNA, 1598 bp, Sorghum bicolor
gaggcaccccaaggagaaaatggccacgcggccactcaccaccgcgcttccgctctccaaaaccccgcgcggcaccccctcctcgcaccattcccctccgcccctcctccgccgcctccaaaccctaacccgcgcgctcgcctcctcatcctcgcaggccatggcgtcgtcgtctcctgcccccaagaaggtgctggtcccgatcgcgaatgggacggagccgatggaggcggtcatcaccatcgacgtgctccggcgcgcgggggcccatgtcgccgtcgcctccgtcgagcccggggccgccaccgtcgccgcctcgtggggcgtcaagctcgccgccgacgcgctcctcgccgacctcgctgacgacgagttcgacctcatctctctcccgggagggatgcctgggtcttccacttttagagactgcaaagttttggagaatatggtaaaaaaacatgtagagaagggcaagctttatgctgcaatttgtgctgcaccagccatggctctaggaacttggggtttgctcaatggcttaaaggcaacatgttatccttcattcatggataaacttccttcagaggtacatgctgtggaatcaagagtgcaaattgatgggaagtgtgtgaccagtcgtggaccaggaacagccatggagtattctgttattttggttgagcaactatatggaaaggaaaaggctaatgaagttgctgggccaatggttatgcgtcctcagcatggtgtggaattctctatgaaagagctgaattcaactagttggaatgttggtgaaacgcctaatattcttgtaccaattgctaatgggacagaggagatggaagcaactatgataattgacattttgcgaagggcgaaagcgaatgttgtggttgcctccttggaagacaagctggagattgttgcatcccggaaagtgaagatgattgctgatgtgctgttggataatgttcttaaggagcaatatgatctcattctgttacctggaggtctgggtggtgcggaagcatatgcaaaatctgataaactaatggatctgatcaagaagcaagccgaggcaaatagattgtacggagctatatgtgcctcccctgcgattgcttttgaaccacatggcctgctaaagggaaagaaagctacatcctatcctgctatgtggaacaaacttgcagaccaaagcgaatgcgacaacagagttgttgttgatggtaacctaatcacgagccaaggtcctgggacttctatggaattctcgcttgccatagtggagaaactctttggacgggagagagcccttgagcttgccaaaaccatggtttttgtatgagttcaaatggtatgtgctaggttcctggagtttgtaccttttttgtgaatatgaggcatgctatgttctttccctgtgcaatgtactccgattcccttttcaaatagaaataagagtaatacttgtaatgtgtttcatatgcaataaaaagtttgaggcgaacattaagcgaggactgagtctgatttgaaaacacttaaatttctatgaaatctttctgctcttgggtatgcttgcttgtttgaag

SEQ ID NO: 1906 - DNA, 1550 bp, Triticum aestivum
  misc_feature (58)..(58): n is a, c, g, or t
  misc_feature (64)..(64): n is a, c, g, or t
  misc_feature (1084)..(1084): n is a, c, g, or t
  misc_feature (1354)..(1354): n is a, c, g, or t
aacagcccaccgaagctcagagaaaagagcaccgacagaaatggccatcgcggccacncgtccnccactctcacaacgtccttctccccctccccacctcctctcctacgccgcctccaaaccctaacccgcgcgcttgcgtcctccgccccgcagcccatggcgtcgtctcctcccctcaagaaggtgctggtgcccatcgcgaacgggacggagccgatggaggccgtaatcaccatcgacgttctgcgccgcgcgggggcggacgtcgccgtcgcctccgtcgagcctggggccgcgcaggtcgccgcatcctggggcgtcaagcttgccgccgacgcgctccttgccgacctggccgaagctgattttgaccttatctcgcttcccggagggatgcctggggcttccacctttagagactgcaaaattttggagaatatggttaaaaaacatgcagagaagggcaagctttatactgcaatatgtgctgcaccagctgtggcgttgggagcttggggtttgctcaatggattaaaggcaacttgtcatccttcagtcatggacaaacttccttcagagatgcaagctgtacaatcaagggtacagattgatgggaattgtgtgactagccgtgggccaggaacaaccatggagtattctgttgttttggttgaacaactgtatggcaaagaaaaggccgatgaagttgctgggccaatggtaatgcgtccccagcatggcgcagagttttcaatgaaggagctgaattcgaccagttggaatgttggtgaaaatcctcaaattctcgtaccaattgctaatggcacagaggagatggaggcaattatgataattgacattcttcgaagggcgaaagcaaatgttgtcgttgcatctttggaaagcactttggagattgttgcatccaggaacgtgaagatggttgctgatgtgcagttggatgatgcccttaagcagcagtacgatctcattttgttacctggtggtcttggtggtgcccaagcatatgccaaatcagataaactgatcggtttgatcaagaagcaagccgaggcaaacnaactgtatggagcaatatgtgcctccccagcaattgcccttgagccacatggcctgctgaaggggaagaaggctacatcctatcctgctatgtggagcaaactcgtggaccaaagcgaatgcaagaacagagtcgtcgtggacggcaacctgatcactagccaaggtccaggcacttccatggaattctcgcttgccatcgtggagaagctttttggtagggaaagggccttcgagctggccaaagcaatggtttttgtgtgagttctgntgctacgatgaagttcctggtcagactagagtggcgctgtgaatatacgaggggatgctgtgttagctggtggcctttgtttcttactagtacaataacgcaacagctcgtaatggatggaaatgcaataaaaagttaagatgaatacgatgcagttaagaatgtggaatgacactacttttttttgccgtggtac

SEQ ID NO: 1907 - DNA, 1553 bp, Triticum aestivum
ggaacagcccaccgaagctcagagaaaagagcaccgacagaaatggccatcgcggccacccgtcttctccactctcacaacgtccttctccccctccccacctcctctcctacgccgcctccaaaccctaacccgcgcgcttgcgtcctccgccccgcagcccatggcgtcgtctcctcccctcaagaaggtgctggtgcccatcgcgaacgggacggagccgatggaggccgtaatcaccatcgacgttctgcgccgcgcgggggcggacgtcgccgtcgcctccgtcgagcctggggccgcgcaggtcgccgcatcctggggcgtcaagcttgccgccgacgcgctccttgccgacctggccgaagctgattttgaccttatctcgcttcccggagggatgcctggggcttccacctttagagactgcaaaattttggagaatatggttaaaaaacatgcagagaagggcaagctttatactgcaatatgtgctgcaccagctgtggcgttgggagcttggggtttgctcaatggattaaaggcaacttgtcatccttcagtcatggacaaacttccttcagagatgcaagctgtacaatcaagggtacagattgatgggaattgtgtgactagccgtgggccaggaacaaccatggagtattctgttgttttggttgaacaactgtatggcaaagaaaaggccgatgaagttgctgggccaatggtaatgcgtccccagcatggcgcagagttttcaatgaaggagctgaattcgaccagttggaatgttggtgaaaatcctcaaattctcgtaccaattgctaatggcacagaggagatggaggcaattatgataatggacattcttcgaagggggaagcaaatgttgtcgttgcatctttggaaagcactttggagattgttgcatccaggaacgtgaagatggttgctgatgtgcagttggatgatgcccttaagcagcagtacgatctcattttgttacctggtggtcttggtggtgcccaagcatatgccaaatcagataaactgatcggtttgatcaagaagcaagccgaggcaaacaaactgtatggagcaatatgtgcctccccagcaattgcccttgagccacatggcctgctgaaggggaagaaggctacatcctatcctgctatgtggagcaaactcgtggaccaaagcgaatgcaagaacagagtcgtcgtggacggcaacctgatcactagccaaggtccaggcacttccatggaattctcgcttgccatcgtggagaagctttttggtagggaaagggccttcgagctggccaaagcaatggtttttgtgtgagttctgctgctacgatgaagttcctggtcagactagagtggcgctgtgaatatacgaggggatgctgtgttagctggtggcctttgtttcttactagtacaataacgcaacagctcgtaatggatggaaatgcaataaaaagttaagatgaatacgatgcagttaagaatgtggaatgacactacttttttttgccgtggtac

SEQ ID NO: 1908 - DNA, 1688 bp, Hordeum vulgare
gggcgcacaccgtgtccgcccttctggaacagaccgccgaagctccgagaaaagagcacggacagaaatggccacgcggccacccgtcttctccactctcacaacatccttctccccctccccaccccttctcctacgccgcctcaaaaccctaacccgcgcggttgcgtcctccgccccgcagcccatggcgtcgtctcctcccacgaagaaggtgctggtgccgatcgcgaacgggtcggagccgatggaggctgcaatcatcatcgacgtgctgcgccgcgcgggggcggacgtcgccgttgcctccgtcgagcccggggccacgcaggtcgccgcatcctggggcgtcaagcttgccgccgacgcactcctcgccgaccttgccgaagctgattttgaccttatctcgcttcccggagggatgcctggggcttccacctttagagactgcaaagttttggagaatatggttaaaaaacatgcagagaagggcaagctttatgctgcagtatgtgctgcaccagctgtggcactgggagcttggggtttgctcaatggattaaaggcaacttgtcatccgtcgtgcatgaacaaacttccttcagaggtgcaagctgtagaatcaagggtacagattgatgggaattgtgtgactagccgtgggccaggaacaaccatggagtattctgttgttttggttgaacaactgtatggcaaagaaaaggccgatgaagttgccaggccaatggttatgcgtccccagcatggtgcagagttttcagtgaaggagctgaactcaatcagttggaatgttggagaaaatcctcaaattctcgtaccaattgctaatggcacagaggagatggaggcaattatgataattgacattcttcgaagagcgaaagcaaatgttgtcgttgcatctttggaaggcactttggagattgttgcatcgaggaatgtgaagatggttgctgatgtgctgttggatgatgtccttaagcagcagtacgatctcattttattacctggcggtcttggtggtgcccaagcatacaccaaatcagataagctggttggtctgatcaagaagcaagccgaggcaaacaaactgtatggagcaatatgtgcctccccagcaattgcccttgagccacatggcctgctgaagggaaagaaggctacatcctatcctgctatgtggagcaaactcgcggaccaaagcgaatgcgagaacagagtcgtcgtcgatggcaacctgatcactagccaaggtccaggcacttccatggaattctcgcttgccatcgtggagaagctctttggaagggaaagggctctcgagctggccaaagcaatggttttcgtgtgagttgtgttgctactagagggtgacactgtttgtgaatatactaggggatgctgtgttagctggtggttttttgcttctcactacaataacgcaacagctcgtaatggatggaaatgcaataaagagttcagatgaatacgatgcagttacgaatgccacgccttctgagaaacatgtttagtcgctcgactttgtggagcttgtcgtggcttgtaatcgcagacgtatttatcagctactcaggataagcttgtgcaattttctacgacaacattaaccaattgaacctgaactctggaagcagagttttagt

SEQ ID NO: 1909 - DNA, 1688 bp, Hordeum vulgare
gggcgcacaccgtgtccgcccttctggaacagaccgccgaagctccgagaaaagagcacggacagaaatggccacgcggccacccgtcttctccactctcacaacatccttctccccctccccaccccttctcctacgccgcctcaaaaccctaacccgcgcggttgcgtcctccgccccgcagcccatggcgtcgtctcctcccacgaagaaggtgctggtgccgatcgcgaacgggtcggagccgatggaggctgcaatcatcatcgacgtgctgcgccgcgcgggggcggacgtcgccgttgcctccgtcgagcccggggccacgcaggtcgccgcatcctggggcgtcaagcttgccgccgacgcactcctcgccgaccttgccgaagctgattttgaccttatctcgcttcccggagggatgcctggggcttccacctttagagactgcaaagttttggagaatatggttaaaaaacatgcagagaagggcaagctttatgctgcagtatgtgctgcaccagctgtggcactgggagcttggggtttgctcaatggattaaaggcaacttgtcatccgtcgtgcatgaacaaacttccttcagaggtgcaagctgtagaatcaagggtacagattgatgggaattgtgtgactagccgtgggccaggaacaaccatggagtattctgttgttttggttgaacaactgtatggcaaagaaaaggccgatgaagttgccaggccaatggttatgcgtccccagcatggtgcagagttttcagtgaaggagctgaactcaatcagttggaatgttggagaaaatcctcaaattctcgtaccaattgctaatggcacagaggagatggaggcaattatgataattgacattcttcgaagagcgaaagcaaatgttgtcgttgcatctttggaaggcactttggagattgttgcatcgaggaatgtgaagatggttgctgatgtgctgttggatgatgtccttaagcagcagtacgatctcattttattacctggcggtcttggtggtgcccaagcatacaccaaatcagataagctggttggtctgatcaagaagcaagccgaggcaaacaaactgtatggagcaatatgtgcctccccagcaattgcccttgagccacatggcctgctgaagggaaagaaggctacatcctatcctgctatgtggagcaaactcgcggaccaaagcgaatgcgagaacagagtcgtcgtcgatggcaacctgatcactagccaaggtccaggcacttccatggaattctcgcttgccatcgtggagaagctctttggaagggaaagggctctcgagctggccaaagcaatggttttcgtgtgagttgtgttgctactagagggtgacactgtttgtgaatatactaggggatgctgtgttagctggtggttttttgcttctcactacaataacgcaacagctcgtaatggatggaaatgcaataaagagttcagatgaatacgatgcagttacgaatgccacgccttctgagaaacatgtttagtcgctcgactttgtggagcttgtcgtggcttgtaatcgcagacgtatttatcagctactcaggataagcttgtgcaattttctacgacaacattaacaaattgaacctgaactctggaagcagagttttagt

SEQ ID NO: 1910 - DNA, 1524 bp, Zea mays
cgcgaaagcaaaggaataacgagccgaggaaatggccacgcggtcactcacctccgcacttccgctctccagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgccgacgcgctcctcgccgacctcgcggacgatgagttcgatctcatctctctaccgggagggatgcctggttcttcgacttttggagagtgcaaagttttggagaaaatggtcaaaaaacatgtagagaagggcaagctttatgctgcaatttgcgctgcaccagcaatgactctaggaacttggggtttgctcaatggcttaaaggcaacatgttatccttcgttcattgataaacttccttcagaggtacatgctgtggaatcaagagtgcagattgatgggaagtgtatgaccagtcgtggaccgggaacagccatggagtattctgttattttggttgagcaactatatggaaaggaaaaagctaaagaagttgctgggccaatggttatgcgtcctcagcatggtgtggaattctctatgaaagaggtgaattcaactagttggaatgttggtgaaacaccaaatattctagtaccaatcgctaatgggacagaggagatggaagcaactatgataattgacattttgcgtagggcgaaagcaaatgttgtggttgcctccttggaagacaagctagagattgttgcatccaggaaggtgaagatgattgctgatgtgctgttggatgatgctcttaaggagcaatatgatctcattctgttacctggaggtctgggtggtgcagaagcatatgcaaaatctgataaactaatggatctgatcaagaagcaagctgaggcaaatagattgtatggagctatatgtgcctcccctgcgattgctcttgaaccacatggcctactaaagggaaagaaagttacatcctatcctgctatgtggaacaaacttgcagaccaaagcgaatgcaacaacagagttattgttgatggtaacctaatcaccagccaaggtcctgggacttctatggaattctcgcttgccatagtggagaaactctttggacgggagagagcccttgagctggccaaatccatggtttttatttgagttgaaatggtacgtgtacgtattaggtttctggagtatgtacttgtgtaaatcgaggcatgctatgttctttttcttgtggaatgtacttcaaatccccttttaaatagaaataagacgaacgcttgtaatgtgtttcatatgcagtaaaaggtttgaggcaaacattaagcgaagac

SEQ ID NO: 1911 - DNA, 1549 bp, Zea mays
aaaaccactcgttgcttctggaacaccaccgcgaaagcaaaggaataacgagccgaggaaatggccacgcggtcactcacctccgcacttccgctctccagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgccgacgcgctcctcgccgacctcgcggacgatgagttcgatctcatctctctaccgggagggatgcctggttcttcgacttttggagagtgcaaagttttggagaaaatggtcaaaaaacatgtagagaagggcaagctttatgctgcaatttgcgctgcaccagcaatgactctaggaacttggggtttgctcaatggcttaaaggcaacatgttatccttcgttcattgataaacttccttcagaggtacatgctgtggaatcaagagtgcagattgatgggaagtgtatgaccagtcgtggaccgggaacagccatggagtattctgttattttggttgagcaactatatggaaaggaaaaagctaaagaagttgctgggccaatggttatgcgtcctcagcatggtgtggaattctctatgaaagaggtgaattcaactagttggaatgttggtgaaacaccaaatattctagtaccaatcgctaatgggacagaggagatggaagcaactatgatacttgacattttgcgtagggcgaaagcaaatgttgtggttgcctccttggaagacaagctagagattgttgcatccaggaaggtgaagatgattgctgatgtgctgttggatgatgctcttaaggagcaatatgatctcattctgttacctggaggtctgggtggtgcagaagcatatgcaaaatctgataaactaatggatctgatcaagaagcaagctgaggcaaatagattgtatggagctatatgtgcctcccctgcgattgctcttgaaccacatggcctactaaagggaaagaaagttacatcctatcctgctatgtggaacaaacttgcagaccaaagcgaatgcaacaacagagttattgttgatggtaacctaatcaccagccaaggtcctgggacttctatggaattctcgcttgccatagtggagaaactctttggacgggagagagcccttgagctggccaaatccatggtttttatttgagttgaaatggtacgtgtacgtattaggtttctggagtatgtacttgtgtaaatcgaggcatgctatgttctttttcttgtggaatgtacttcaaatccccttttaaatagaaataagacgaacgcttgtaatgtgtttcatatgcagtaaaaggtttgaggcaaacattaagcga

SEQ ID NO: 1912 - DNA, 1478 bp, Pseudoroegneria spicata
  misc_feature (187)..(187): n is a, c, g, or t
  misc_feature (1149)..(1149): n is a, c, g, or t
  misc_feature (1444)..(1448): n is a, c, g, or t
ctacgccgcctccaaaccctaacccgcgcgcttgcgtcctcctccccgcagcccatggcgtcgtctcctgccccgaagaaggtgctggtgccgatcgcgaacgggtcggagccgatggaggctgcaatcatcatcgacgtgctgcgtcgcgcgggggcggacgtcgccgtcgcctccgtcgagcctnggaccacgcaggtcgccgcatcctggagcgtcaagcttgccgccgacgcgctcctcgccgaccttgccgaagctgattttgaccttatctcgcttcccggagggatgcctggggcttccacctttagagactgcaaaattttggagaatatggttaaaaaacatgcagagaagggcaagctttatgctgcagtatgtgctgcaccagctgtggcactgggagcttggggtttgctcaatggattaaaggcaacttgtcatccttctttcatggacaaacttccttcagaggtgcaagctgtacaatcaagggtacagattgatgggaattgtgtgactagccgtgggccaggaacaaccatggagtattctgttgttttggttgaacaactgtatggcaaagaaaaggccgatgaagttgctgggccaatggttatgcgtccccagcatggtgcagagttttcagtgaaggagctgaattcgactagttggaatgttggcgaaaatcctcaaattctcgtaccaattgctaatggcacagaggagatggaggcaattatgataattgacattcttagaagggcgaaagcaaatgttgtcgttgcatctttggaaggcactttggagattgttgcatccaggaatgtgaagatggttgctgatgtgctgttggatgatgcccttaagcagcagtacgatatcattttgttacctggtggtcttggtggtgcccaagcatacgccaaatcagataaactgattggtttgatcaagaagcaagccgaggcaagcaaactgtatggagccatatgtgcctcccctgcaattgcccttgagccacatggcctgctgaaggggaagaaggctacatcctatcctgctatgtggagcaaactcgcggaccaaagcgaatgcaagaacagagtcgtcgtggatggcaacctgatcacgagccaaggtccnggcacttccatggaattctcgctcgccatcgtggagaagctttttggaaaggaaagggccctcgagctggccaaagcaatggttttcgtgtgagttctgttgctactagagagtgacactgtttgtgaatatacgaggggatgctatgttagccggtggtttttgcttctcactagaataacgcaacagctcgtaatggatggaaatgcaataaagagttcagatgaatacgatgcagttacgaatgccacgccttctgaaaaacatgtttagtcgcttgactttgtggaacttnnnnnggctccaaagtcagacatatttatccgcca

SEQ ID NO: 1913 - DNA, 1627 bp, Leymus cinereus x Leymus triticoides
  misc_feature (530)..(530): n is a, c, g, or t
  misc_feature (581)..(581): n is a, c, g, or t
  misc_feature (758)..(758): n is a, c, g, or t
cacacggtgtccgcccttctggaacagcccaccgaagctcagagaaaagagcaccgaaagaaatggccacgcggccacccgtcttctccactctcacaacgtccttctccccctccccaccacctctcctacgccgcctctaaaccctaacccgcgcgcttgcgtcctcctccccgcagcccatggcgtcgtctcctcccccgaagaaggtgctggtgccgatcgcgaacgggacggagccgatggaggctgtaatcaccatcgacgtgctgcgccgcgcgggggcggacgtcgtcgtcgcctccgtcgagcctggggccgcgcaggtcgccgcatcctggggcgtcaagcttgccgccgacgcgctccttgccgacctagccgaagctgattttgaccttatctcgcttcccggtgggatgcctggggcttccacctttagagactgcacagttttggagaatatggttaaaaaacatgcagagaagggcaagctttatgctgcaatatgtgctgcaccagctgtggcnctgggagcttggggtttgctcaatggattaaaggcaacttgtcatccttcnttcatggacaaacttccttcagaggtgcaagctgtagaatcaagggtacagattgatgggaattgtgtgactagccgtgggccaggaacaaccatggagtattctgttgttttggttgaacaactgtatggcaaagaaaaggccgatgaagttgctgggccaatggttatgcgtccncagcatggcgcagagttttcagtgaaggagctgaattcgactagttggaatgttggtgaaaatcctcaaattctcgtaccaattgctaatggcacagaggagatggaggcagttatgataattgacattcttcggagagcgaaagcaaatgttgtcgttgcatctttggaaggtactttggagattgttgcatccaggaatgtgaagatggttgctgatgtgctgttggatgatgcccttaagcagcagtacgatctcattttgttacctggtggtctcggtggtgcccaagcatacgccaaatcagataaactgattggtttgatcaagaagcaagccgaggcaaacaaactgtatggagcaatatgtgcctccccagcaattgcccttgagccgcatggcctgctgaagggaaagaaggctacatcctatcctgctatgtggagcaaactcgcggaccaaagcgaatgcaagaacagagtcgtcgtcgatggcaacctgatcactagccaaggtccaggcacttccatggaattctcgcttgctatcgtggagaagctctttggaagggaaagggccctcgagctggccaaaacaatggttttcgtgtgagttccgttgctacgaggaagttcttggtcagactagagtgacactgtttgtgaatatgccaggggatgccatgtcagctggtgttttttgtttcttactacaataacgcacagctcgtaatggatagaaatgcaataaagagtttagatgaacatgatgcagttacgaatgcggaatgccgcgccttctgaaaaatatgtttagtcgcatgacttgagcttgtcgtggttcttaatcacagacatgtttatccgcta

SEQ ID NO: 1914 - DNA, 1190 bp, Sorghum bicolor
cgagccacgtttgtgcgtaggcgtacgtgagagctatagccaactccacccaaagactggcctagatcgacggagtgacggacgtacacggatcatgatgctgctctcacactcttcgtctacaaccaccaccaccaccaccacctggcggctagcagccgcagcgccgccgccggctcgctccaggcgcgcgcgcctcctgcctccacgcgcgcgggccgccgacacgacgacgggcgtttctggcgccgccgaccgcgcggccgaggcgcttctccagagcgggctgcgcccggagtcgctgccgcggcacgtcgcggtggtgatggacgggaactcacggtgggcgcgcgcgcggggtctgacgcccgccgacggccacaaggccggcggccgcaacctggagcggatcgttggcctctcgcgcgcctggggcatccgcgctctcaccgccttcgtctgctcccgcgaaaacttgagccgccccaaggctgaggtggactacatgatgggtttgtcggagtggctgataggcgacaacatcgacaagctgtcaaggcaggggatccggctgcaggtcatcggcgacgccacacagatgccagcgtctctgcggagcgcggcggagcaagccgacgaggcgacgcggcacaactcgcagctgcacgtgatgctggcgatctgctacagcgggcgatgggacatggtccaggcgtgccgggagctcgtccgggaggcgcaggcggggcggctcagcccggacgacgtcgacgagtcgctggtcgccggcaagctcgcgacgagcgccgccggccacggcgagttctcctgccctgaccttgtcgtcagaaccagcggcgagctgaggctcagcaacttcctgctgtggcagtcggcgtactcggagttcttcttcaccgacaagatgtggccggactttggggaggctgagtacctggaagcgttgcgctccttccaggccagagatcggcgattcggtcaatcaaaattactctagagcccaaaaaaaaaaaaaaaggtgtcgatgtcgcgtgtaatagtaggcagcatttgttcaatgaacacgtgactttgtgtgggaaaagcagaatcacacatcaaccggttgttgtttctgtcctcaacaggagagattttacagccgtcagatcttcggccgccatcatttc

SEQ ID NO: 1915 - DNA, 1598 bp, Zea mays
agttaaaaaacatttaatttttcgaaaagtgacagccacaactagcacatatacaggaaccattattgcatctgactcttgatctaacggacacccgacgctgatagtatagtacagttgttgccagaaaccagatacgtatccactgacgtaaatggtattccgtaccttctgacgatactgtgcgatgaagtaacctccttttaccactggatccttggcgcttcctcgtcacgttcccagacctcgaaagactattcccctcaaccctccaaaagaagagaggactgttgaaacttggatgccatggcatacgtccacacgccaccgtaccagtcgagatcaagacggcaataatagacaagaacaaggtgcgtggcagtgcactcgacgatattaatggagctgctttgcacgggcggcagacagccgtagacagagcagtgacggtcgtcgtacacagatcacgatgctgctcccacactcttcgtcagcctctgcaactgctaccactcgtgggctagcactagcagcagcagcagcagcaccgccgcgtccgaccgctcgcccccggcgcgcgcgcctcctgcctccacgcgcgcgggccgagacgcatgcgacgggcgttggcgccgaccgcgcggccgaggcgcttctccaaagcgggctgcgccgtgagtcgctgccgcggcacgtcgcggtggtgatggacgggaactcgcggtgggcgcgcgagcgggggctgacgcccgcggacggccacaaggccgggggccgcaacctggagcgggtcgttgcgctgtcgcgcgcctggggcatccgcgcgctcaccgccttcgtctgctcccgcgagaacttgagccgccccaaggcacggccctcgatccctgcttttcaataaactcgcgtacacatcggacgacgaccctgacacgcactggtgcgttcttgtcttcccgctcatcgtatctgcaggccgaggtcgactacatgatgggcttgtccgagtggctgataggcgacaacatcgacaagctctcgaggtcgtcgtcgtcggctaataaaaacctgcagtgatcttgcatagcacagcgccacagtataccgtttgaattttttttacatgttctgcttccgcgttcaggcaggggatccggctgcaggtgatcggcgacgccgcgaagatgccagcctctctgcggagcgcagcggcgcaggccgacgaggccacgaggcacaactcgcagctgcacgtgatgctggccatctgctacagcgggcgatgggacatggtccaggcgtgccgggagctggcccgggaggcgcaggcgaaccggctcagtccggacgacatcgacgagtcgatcatcgccggcaagctcgcgacgagcgccgccggcgagttctcctgtcccgacctggtcatcagaaccagcggcgagatgaggctcagcaacttcttgctgtggcagtcggcgtactcggagttgttcttcaccgccaagatgtggcctgactttggggaggctgagtacctggaagcgttgcgctccttccagggcagagaccgccgcttcggccaatcaaaattactctaa

SEQ ID NO: 1916 - DNA, 1378 bp, Hordeum vulgare
gagttggatatgggcaactgcaagatttgaccaatcgaataagattggcgagggaggttatggaccagggtataagggaacactcagggacggaacaactgttgcagtaaaggtgctctctttgcagtctaggcaaggcgcgagggaatttcttagcgaacttattacgatctctgatatttcccatgagaatcttgtcaaactttatggctgttgtgtggaaggaagccacaagatccttgtctataattatcttgaaaataatagccttgcacaaacccttctaggttctcggcatagcagcatccagtttaattggagaactcgagtaaatatttgcattggtgttgcccaggggctagcatacctccatgacggtgtccgacctcatgttgtccaccgggacatcaaagctagcaatatacttctcgatcaggatcttaccccgaaaatttccgatttcggcttggcgaagcttctaccttcagatgtatcacatattagcacaagagtcgcaggaacgctaggttacttggctcccgaatacgccatccgaggacaagtgacccggaaatcagatgtttacagcttcggtgttctgctgatagaaatagtcagtggaagatgcaacactgatacaaaactaccgtatgaagatcagattcttcttgagaagacatgggcatactacgaccaggggcagctggaggagatcatcgacagctccctgggcgatgacctggacgtggacgaggcatgcaggttcctgaaggtggggctcctgtgcacgaagaacgtgacgaaacgccgtcccgacatgtcgacggtgacccggatgctgaagggcgaggaggacgtggagtcgcaggagatcaccaagcccgacgtgatccgggacttcagggacctgaagctgaggagcaaggccacgtcgtcgtcgctgctgacctccatcgtggcgcgctcctcgccatcgtcgtcgtcgtccaccggtaacaccacccgcacctccatcaccttcaccgccatatcagaccgaccctgaaagaagtggcgcgcgggagggaaaacagacacgaagagactgcagagaaaactgtagatagccgtagcgcagcccagttttttttcctttttttattgtgcttgtatggtctgtgtggtatagtagccttcatgctttaattcacttcacttgattgtttctctctgtataaaagggttataccgattttttatcaatagaaaccaagctacatgtagttcacagcagaacccttctcccgagggtcatcacacagcctatatgcatcagtttttttagacaatcccttttttctttctctttttgagaaactagagacgatcctattttttt

SEQ ID NO: 1917 - DNA, 1378 bp, Hordeum vulgare
gagttggatatgggcaactgcaagatttgaccaatcgaataagattggcgagggaggttatggaccagggtataagggaacactcagggacggaacaactgttgcagtaaaggtgctctctttgcagtctaggcaaggcgcgagggaatttcttagcgaacttattacgatctctgatatttcccatgagaatcttgtcaaactttatggctgttgtgtggaaggaagccacaagatccttgtctataattatcttgaaaataatagccttgcacaaacccttctaggttctcggcatagcagcatccagtttaattggagaactcgagtaaatatttgcattggtgttgcccagggactagcatacctccatgacggtgtccgacctcatgttgtccaccgggacatcaaagctagcaatatacttctcgatcaggatcttaccccgaaaatttccgatttcggcttggcgaagcttctaccttcagatgtatcacatattagcacaagagtcgcaggaacgctaggttacttggctcccgaatacgccatccgaggacaagtgacccggaaatcagatgtttacagcttcggtgttctgctgatagaaatagtcagtggaagatgcaacactgatacaaaactaccgtatgaagatcagattcttcttgagaagacatgggcatactacgaccaggggcagctggaggagatcatcgacagctccctgggcgatgacctggacgtggacgaggcatgcaggttcctgaaggtggggctcctgtgcacgaagaacgtgacgaaacgccgtcccgacatgtcgacggtgacccggatgctgaagggcgaggaggacgtggagtcgcaggagatcaccaagcccgacgtgatccgggacttcagggacctgaagctgaggagcaaggccacgtcgtcgtcgctgctgacctccatcgtggcgcgctcctcgccatcgtcgtcgtcgtccaccggtaacaccacccgcacctccatcaccttcaccgccatatcagaccgaccctgaaagaagtggcgcgcgggagggaaaacagacacgaagagactgcagagaaaactgtagatagccgtagcgcagcccagttttttttcctttttttattgtgcttgtatggtctgtgtggtatagtagccttcatgctttaattcacttcacttgattgtttctctctgtataaaagggttataccgattttttatcaatagaaaccaagctacatgtagttcacagcagaacccttctcccgagggtcatcacacagcctatatgcatcagtttttttagacaatcccttttttctttctctttttgagaaactagagacgatcctattttttt

SEQ ID NO: 1918 - DNA, 1935 bp, Brachypodium distachyon
gtcttctcttcgtttcccacctactccgtgctttggaggaaccggaagaagctctggaggccgccaaccaaaccttctcattccaatcttctcctcctcctcctcctattgtgctgtagcctgtgcatctcgccgccgagcgctgacgcccgagttgacagactctggcgcgtcgcctacttcgtgctctctggccggggagtctcgctgcgtcgggttgttcggcggcgggttccgtcggtgcgcgggcgggctaattttgcgggccgagaccgtcaatttctccggtcgggttcggctcttctgccactgccgcgcgggttcagggtatgattactgttgttgaaggctggtgaactatgttccaagatatgattgctgttgtcgaaggatgaaaatctatgcgcttgtggttagatcgatgttaaactgatatttcaattaagcgaacctcagtacaatagcttgaaaattgaaacaactctgtaatgagttgtttttctctctttttcaagaggataggggtgacccatcaacaaaatgatccgtgcaatgaagacttctctggtactgagaatataacaagattcagctacaaggagctggttaaggcaacagcaaagtttgaccaatccaataagatcggtgagggaggttatggacctgtgtacaagggaacgctcaaggatggaacagctgttgctgtaaaggtgctttctttgcagtctagacaaggcaaaaaggaatttcttagtgaactccttgcgatctccaatgtgtcacatgagaatcttgtcaaactctatggctgttgtgtcgaagaaagccacaaaattcttgtctataattatcttgaaaataatagcctctcacaaacccttctaggttctcgacatagcagcatccagtttaactggagaactcgagtaaatatctgcattggtgttgccaagggactagcatacctccatgatgtcatccgccctcacattgtccatcgggacatcaaagcaagcaatatacttctcgatgatgatcttaccccaaaaatttctgatttcggtttagcaaagcttctaccttcagatgtatcgcatattagcacaagagttgcaggaacactaggttacttggctcctgaatatgccattcgaggacaagtgacacggaaatcagatgtttacagctttggtgttctgcttgtagaaatagtcagtggaaggtgcaacactgatacaagactgccttatgaagatcagattcttcttgagaagacttgggcatactatgaccaagggaacctggacaagatcatagacagtaatctgggcgacgaccttgatgtcgatgaagcctgcaggttcctgaaagtcggcctcctgtgtaccaagaacatcacaaagcgccggcctgacatgtccacggtcctcgccatgcttcgaggcgaggtggacgtggactcgcaggagatcagcaagcccgacgtgatccgggacttcagggacctcaccctgaggagcaaggccacatcgtcgtcgatgctgagctccatcgtggcgcgctcctcctccccgcagtcgtcgtccgggtccggcgacaccgtcaccacacgcacctccatcaccttcaccgcgatatccgaccgcccatgacctggcgcgaaatggacacagacggacgtggggaaggcgggaacgaaatacagagtaaggaagagggaaactgtgcatacgaagcattacagcccagatttatttatttttgttttattttattaacctcgtacgatttttttgtcgttgtactgtctaggttttgtttacgcacacattgtctgtagagcttgagaatttgttctcagatacgtactgtataaatgtaaaacccacagtatgtttttttttcctgaagacctgaactgatctctcaacgaaa

SEQ ID NO: 1919 - DNA, 1850 bp, Oryza sativa
tactctctcctcctttccctctctttcctctctatctctcttcgttttgttttttcgcttcggggcgagaagaaaaacctgccatttttcaatctgccggagcagagattttcctctgccgcgcgcggcgtgggccggccgggtctcgactggcgccggaggcggaagccgtcgggttcttcgatctttctcgcttgccggtttcgactggagatcgtcggtttcgccgcttggatcgaggatacaatggctgttgctgaacatctatgatctctgtgtgcatacatcgaacaacatctcaattaagccaggcacaacacagctgtgttttccatagcttgaaacatctcagtgatgagttgtttttctctctttttcaagaggtcaaggaccgggcagcaacaaagtgatccatataatgaagtcttctctggtgctgagaacataacaagatacagctataaggagctggctaaggcaacactgaattttgaccaatccaataagattggtgagggaggttttggacctgtatacaagggaactctcaaggatggaacagatgttgctgtgaagttgctgtcgttacaatctagacaaggtgtgaaggagttccttaatgaacttatggcaatctctgacatttcacatgagaatcttgtcaaactgcatggctgttgtgtggaagggaggcacagaatccttgtgtacaattatcttgaaaacaatagccttgcacatacccttctaggttctaggcaaagtaacatacagttcaactggagggctcgagtaaatatatgcatcggtgttgccaagggactagcattcctccatgatggtgtccggcctcacattgttcaccgtgacatcaaggcgagcaatatacttcttgataaggacctcacgccaaaaatttctgattttggtttagcgaagcttctgccttcagatgcatcacatgttagtacaagagtcgcaggaacactaggttacttggctcctgaatatgccatccgaggacaagtgacacgcaagtcagatgtttacagctttggtgttcttcttgtggaaatagttagtggaagatgcaacactgacacaaaattgccctacgaagaccagatccttcttgagaagacatggaaatgttatgatcaggggtgtttggagaaggccatagacagctctatggtcgatgacgtggatgtcgacgaagcctgcagattcttgaaagtcggtcttttgtgcacccaggacatctcgaaacgtcgacccaccatgtcaatggtcatcagcatgctgacaggcgagatggaggtcgacaaagagaagatcagcaagcctgatgtaatcagggatttcagggacctcaagctcaggagcaaggccacatcctcctcctcactgttgacctccatcatggcgcgctcaactccctcgtcgtctcaggagacgacgcgcacctccatcacggtcaccgccatatcggaccgcgactgatgggtctctttctgaaagtgtaaagttgtgtagaggaaaaccgtagcgtagacgatattatcttcattttttgtgcttgcatgatctttatgtagaatttgcatcatccccattcactgagcctgaacacattgctgagtcacacacacacacacacacacacacatatatatatatatatatatacagcccatttctgtcctgaattaactctgtcaattgtcaaagtgtcatcaagaaaccactactccagtgaattgctgaaagcctggaaaggaagttgcatacattccaactgagaactgtgcttcagaatactattaaatgcaattagttcaatttccttc

SEQ ID NO: 1920 - DNA, 1538 bp, Triticum aestivum
tattttctagaggtagtcagaggggggcagccaagatcaaaatcttctgtagcgactcgatcggatctccagccgacgccggcgaccatggctcgccgtcaccacctcgtcctcctcctccctctcctcgcgcttgccgtctccttcgtcgccgccgcccctgagggacatggagatgccgccgccgccttcatcgacggcgcgccgcaccgctacctgcgggatcagcaggacgaccaggccacgtcgatgtcacttgatgaagtttctgcagctgtttccgtcttgcttggttttgcaccacctgccatgcttcccgcgccttcttctgcaaagttaaacaagctgctactcccaaagccatttgacaggcctcgtgctgttttcttgatgcaaattgatggatcccatgactctgtcgatagcttcgtatctgatgccggtagtatttacaaaaccaagattgagggtgcacaaaatgctgctacagggcttacagataaggatgaattgattgtcattcgttcagatgaatcttctggatcagatgttcttgataatgaactcaccgacttggcaacctggttggagggatcctaccagaaggctgatggcaaattaaacatccccttgaagagtggaaacagtcttactttgctcctcaataaggaagtagacgttgaatttgcatccagcttgatctcccttctcaaaaccatcaaaaggggtattcaggttcatgaagatttctcaggaggcatcgtgagccctgcagagttattagtatgccgcttcacgggcattaaggctctggaagatgaatatggttctgcagaaattgttaagcagggagctgaagtagttcagacagctctcaccaaagcatttgatcaattgcagggagcatataacgggaaaattgttgggctggtaatatccactaaggaggcttcaacatccttggcatccatcatcgatggaccatcttcattgcatatctcaagacggcttgcagaagcatcgaaaactaatgctacagcttctatagctgctatatatcttgttagattgagtcttgcatggattacagggatcatcctccttgtctcaactctcattgggatctgcctgctcatgaacatgccgcttaccagggacacgctcctatattcaaatgtcaagatggattagttttacatatgaattttcgcacgatggcatggaagttttcaatagtcatgcttggttttttcctttggaccttgggtttacagtagggacgctgagtgtgggcttgctgttcacccaccacccagtgtagcataaaaatactgttgctatgtgaaccgttcatctagaattgtactgccattgcctgcatgggcttctctcattttcccgtaaataaataaaaaacaatcgagaggagtgtattttgttaatatcagcgaagattgtactctattgttgtaaaaacccagtatctgaataaattcgccacttggatattcaatgggatagctgttgtcttcatatat

SEQ ID NO: 1921 - DNA, 1461 bp, Leymus cinereus x Leymus triticoides
  misc_feature (11)..(11): n is a, c, g, or t
  misc_feature (191)..(191): n is a, c, g, or t
  misc_feature (363)..(363): n is a, c, g, or t
  misc_feature (494)..(494): n is a, c, g, or t
  misc_feature (516)..(516): n is a, c, g, or t
  misc_feature (536)..(536): n is a, c, g, or t
  misc_feature (558)..(558): n is a, c, g, or t
  misc_feature (591)..(591): n is a, c, g, or t
  misc_feature (610)..(610): n is a, c, g, or t
  misc_feature (656)..(656): n is a, c, g, or t
  misc_feature (885)..(885): n is a, c, g, or t
  misc_feature (887)..(887): n is a, c, g, or t
  misc_feature (1322)..(1323): n is a, c, g, or t
  misc_feature (1335)..(1335): n is a, c, g, or t
  misc_feature (1337)..(1337): n is a, c, g, or t
  misc_feature (1353)..(1353): n is a, c, g, or t
  misc_feature (1356)..(1356): n is a, c, g, or t
  misc_feature (1359)..(1359): n is a, c, g, or t
  misc_feature (1371)..(1371): n is a, c, g, or t
  misc_feature (1415)..(1418): n is a, c, g, or t
cttcgctagcnactcgatcggatctccagccgacgccggcgaccatggctcgccaccacctcctcctccctctcctcgcgcttgccttctccttcgtcgtcgccgcccctgagggacagggagatgccgccgccttcatcgatggcgcgtcgcaccgctacctgcgggatcagcaagacgaccaggccacntcgatgtcacttgatgaagtttctgcagctgtttccgtcttgcttggttttgcaccacctgccatgcttcctgcaccttcttctgcaaagttaaacaagctgctactgccaaacccatttgacaggcctcgtgctgttttcttgatgcaacttgatggatcccatgactctnttgatagcttcatatctgatgccggtagtatttacaaaaccaagattgatggtgcaaaaaatgctgctacagggcttacagataaggatgaattgattgtcattcgttcagatgaatcttctggatcagangttcttgataatgaactcaccnacttggcaacctggttgganggatcctatcagaaggctgatngcaaattaaacatccccttgaagagtggaaacngtcttactttgctcctcantaaggaagtagacgttgaatttgcatccagcttgatctcccttctnaaaaccatcaaaaggggtattcaggttcacgaagatttctcaggaggcatcgtgagccctgcagagttattagtatgccacttcacgggcattaaggctctggaagatgaatatggttctgcagaaattgttaagcagggagctgaagtagttcggacagctctcaccaaagcatttgatcaattgcagggagcatataacgggaaaattgttgggctggtaatatccncnaaggaggcttcaacatccttggcatccatcatcgatgcaccgtcttcattgcatatctcaagacggcttgcagaagcatctaaacctaatgctacagcttctatagctgctatatatcttgttagattgagtcttgcatggattacagggatcatccttcttgtctcaactctcattgggatttgcttgctcatgaacatgccgcttaccagggacacgctcctatattcaaatgtcaagatggattagtttgtgctacatatgaattttcacacgacgacatggaggttttcaacagtcatgcttggttttttcctttggaccctggggtttacagtagggacgctgagtgtgggcttgctgttcacccagtgtagcataaaaatattgttgctatgtggatccttcatttagaattgtactgccactgcctgnntgggcttctctngnttttccgtaaataaanaanaanaatcgagaggantgtattttgttaatatcagcgaagattgtattgttgtaaaaaannnngtatctgaataaattcgccacttggatattcattgggatcgct

SEQ ID NO: 1922 - DNA, 1482 bp, Hordeum vulgare
atttcctagcgacaaccaaagatccaaatcttcgctagcgactcgatcggatctcatctccagccggcgccggcgaccatggctcgccgtcacctcctcctcctccctctcctcgcccttgccttctcctccgccgtcgccgcccctgagggacagggagatgccgccgccttcatcgatggcgcgtcgcaccgctacctgcgggatcagcaagacgaccaggccacgtccatgtcacttgatgaagtttctgcagctgtttccgtcttgcttggctttgcaccatctgccatgcttcctgcaccttcttctgcaaagttaaataagctgctactgccaaaaccatttgacaggcctcgtgctgttttcttggtgcaaattgatggatcccatgactctgttgatagcttcatatctgatgctggtagtgtttacaaaaccaagattgatagtgcaaaaaatgctgctacagggcttacagataaggatgaattgattgtcattcgttcagatgaatcttctggatcaggtgttcttgataatgaactgaccaacttggcaacctggttggagggttcctatcagaaggctgatggcaaattaaacatccccttgaagagtggaaacagtcttactttgctcctcaataaggaagtagacattaaatttgcatccagcttgatctctcttctgaaaaccatcaaaaggggtattcaggttcacgaagatttctcaggaggcatcgtgagccctgcagagttattagtttgccagttcacgggcattaaggctctggaagatgaatatggctctgcagaaattgttaagcagggagctgaagtagttaggacagctctcaccaaagcatttgatcaactgcagggagtatataacgggaaaattgttgggctagtaatgtccaccaaggaggcttcaacatccttgtcatccatcatcgatggaccctcttcattgcacatctcaagacggcttgcagaagcatccagaactaatgctacagcttctatagctgctatatatcttgttagactgagtcttgcatggattacagggatcatccttcttgtctcaacgctcattgggatttgcctgctcatgaacatgccgcttaccagggacacactcctatattcgaatgtcaagattgattagtttgtgctgcatatgaattttcacacgacggcatggaagtttttaacagtcatgcttgggtttttcctttggaccctggggtttaacagtagggacgctgagtctgggcttgctgttcaccctgtgtagcataaacatattgttgctatgtggatcattcattgagaactgtatactgacactgcctgtatgggcttctcttgcttttccgtaaataaataaaaataatcaagtggagtgtaattttgttaatatcatcgaagattgtactgtattgttgtaacaaaaagccagtatctgaataaattc

SEQ ID NO: 1923 - DNA, 1481 bp, Hordeum vulgare
agcgacaaccaaagatccaaatcttcgctagcgactcgatcggatctcatctccagccggcgccggcgaccatggctcgccgtcacctcctcctcctccctctcctcgcccttgccttctcctccgccgtcgccgcccctgagggacagggagatgccgccgccttcatcgatggcgcgtcgcaccgctacctgcgggatcagcaagacgaccaggccacgtccatgtcacttgatgaagtttctgcagctgtttccgtcttgcttggctttgcaccatctgccatgcttcctgcaccttcttctgcaaagttaaataagctgctactgccaaaaccatttgacaggcctcgtgctgttttcttggtgcaaattgatggatcccatgactctgttgatagcttcatatctgatgctggtagtgtttacaaaaccaagattgatagtgcaaaaaatgctgctacagggcttacagataaggatgaattgattgtcattcgttcagatgaatcttctggatcaggtgttcttgataatgaactgaccaacttggcaacctggttggagggttcctatcagaaggctgatggcaaattaaacatccccttgaagagtggaaacagtcttactttgctcctcaataaggaagtagacattaaatttgcatccagcttgatctctcttctgaaaccatcaaaagggtattcaggttcacgaagatttctcaggaggcatcgtgagccctgcagagttattagtttgccagttcacgggcattaaggctctggaagatgaatatggctctgcagaaattgttaagcagggagctgaagtagttaggacagctctcaccaaagcatttgatcaactgcagggagcatataacgggaaaattgttgggctagtaatgtccaccaaggaggcttcaacatccttgtcatccatcatcgatggaccctcttcattgcacatctcaagacggcttgcagaagcatccagaactaatgctacagcttctatagctgctatatatcttgttagactgagtcttgcatggattacagggatcatccttcttgtctcaacgctcattgggatttgcctgctcatgaacatgccgcttaccagggacacactcctatattcgaatgtcaagattgattagtttgtgctgcatatgaattttcacacgacggcatggaagtttttaacagtcatgcttgggtttttcctttggaccctggggtttaacagtagggacgctgagtctgggcttgctgttcaccctgtgtagcataaacatattgttgctatgtggatcattcattgagaactgtatactgacactgcctgtatgggcttctcttgcttttccgtaaataaataaaaataatcaagtggagtgtaattttgttaatatcatcgaagattgtactgtattgttgtaacaaaaagccagtatctgaataaattcgccacttg

SEQ ID NO: 1924 - DNA, 1494 bp, Hordeum vulgare
aaatcttctgtagccactcgatccgatctccagccgacgccggcgaccatggcttgccgtcacctcctcctcctccttcctctcatcgcgctcgctttctcctccgccgtcgccgcccctgagggtcagggacacgccgctgccgccttcatcgacggcgcgtcgcaccgctacctgcgggatcagcaagacgaccaggccatgtcgatgtcacttgatgaagtttctgcagctgtttctgtcttgcttggttttgcaccacctgccatgcttcctgcaccttcttctgcaaagttaaacgagttgctactgccaaaaccatttgacaggcctcgtgctgttttcttgatgcaaattgatggatcccatgactctgtcgatagcttcgtatctgatgccggtagtatttacaaaaccaagattgatggtgcaaaaagtgctgctacagggcttacagataaggatgaattgattgtcattcgttcagatgaatcttctggatcagatgttcttgacaatgaactcaccgacttggcaatctggttagagggatcctatcagaaggctgatagcaaattaaacatcccattgaagagtggaaacagtcttactttgctcctcaagaaggaagtagacgttgaatttgcatccagcttgatctcccttcacaaaaccatcaaaagcggtattcaggttcacgaagatttctcaggaggcatcgtgagccctgcagagttattagtatgccacttcacgggcattaaggctctggaagatgaatatggttccacagaaattgtcaagcagggagctgaagtagttcaaacagctctcaccaaagcatttaatcaactgcagggagcatataacgggaaacttgttgggctggtaatatccactaaggaggcttcaacatccttggcatccatcactgatggaccgtcttcactgcatatctcaagactgcttgcagaagcatctaaaactaaggctacagcttctatagctgctatataccttgttagattgagtcttgcatggattacagggatcatccttcttgtctcaaccctcattgggatttgcctgctcatgaacatgccgcttaccaaggacacgctcctatattcaaatgtcaaaattgattagtttgtgctgcatatgaattttcacacgacggcaaggaagttttcaacagtcatgcttggctttttcctttggaccctggggtttacagtagggacactgagtctgggcttgctgtccaccctgtgtagcataaacatattgttgctatgtggatcattcattgagaactgtatactgacactgcttgtatgggcttctcttgcttttccataaataaataaaaatagttgaggggagtgtattttgtcaatttcagcgaatattgtactgtattgttgtaaaataccagtatgtgaacaaatttgctacttggatattcattgggatcactttagtcttaataca

SEQ ID NO: 1925 - DNA, 1496 bp, Hordeum vulgare
ccaaatcttctgtagccactcgatccgatctccagccgacgccggcgaccatggcttgccgtcacctcctcctcctccttcctctcatcgcgctcgctttctcctccgccgtcgccgcccctgagggtcagggacacgccgctgccgccttcatcgacggcgcgtcgcaccgctacctgcgggatcagcaagacgaccaggccatgtcgatgtcacttgatgaagtttctgcagctgtttctgtcttgcttggttttgcaccacctgccatgcttcctgcaccttcttctgcaaagttaaacgagttgctactgccaaaaccatttgacaggcctcgtgctgttttcttgatgcaaattgatggatcccatgactctgtcgatagcttcgtatctgatgccggtagtatttacaaaaccaagattgatggtgcaaaaagtgctgctacagggcttacagataaggatgaattgattgtcattcgttcagatgaatcttctggatcagatgttcttgacaatgaactcaccgacttggcaatctggttagagggatcctatcagaaggctgatagcaaattaaacatcccattgaagagtggaaacagtcttactttgctcctcaagaaggaagtagacgttgaatttgcatccagcttgatctcccttcacaaaaccatcaaaagcggtattcaggttcacgaagatttctcaggaggcatcgtgagccctgcagagttattagtatgccacttcacgggcattaaggctctggaagatgaatatggttccacagaaattgtcaagcagggagctgaagtagttcaaacagctctcaccaaagcatttaatcaactgcagggagcatataacgggaaacttgttgggctggtaatatccactaaggaggcttcaacatccttggcatccatcactgatggaccgtcttcactgcatatctcaagactgcttgcagaagcatctaaaactaaggctacagcttctatagctgctatataccttgttagattgagtcttgcatggattacagggatcatccttcttgtctcaaccctcattgggatttgcctgctcatgaacatgccgcttaccaaggacacgctcctatattcaaatgtcaaaattgattagtttgtgctgcatatgaattttcacacgacggcaaggaagttttcaacagtcatgcttggctttttcctttggaccctggggtttacagtagggacactgagtctgggcttgctgtccaccctgtgtagcataaacatattgttgctatgtggatcattcattgagaactgtatactgacactgcttgtatgggcttctcttgcttttccataaataaataaaaatagttgaggggagtgtattttgtcaatttcagcgaatattgtactgtattgttgtaaaataccagtatgtgaacaaatttgctacttggatattcattgggatcactttagtcttaataca

SEQ ID NO: 1926 - DNA, 2120 bp, Triticum aestivum
  misc_feature (1635)..(1636): n is a, c, g, or t
  misc_feature (1639)..(1639): n is a, c, g, or t
  misc_feature (1642)..(1642): n is a, c, g, or t
  misc_feature (1713)..(1714): n is a, c, g, or t
  misc_feature (1761)..(1763): n is a, c, g, or t
  misc_feature (1768)..(1768): n is a, c, g, or t
  misc_feature (1777)..(1777): n is a, c, g, or t
  misc_feature (1795)..(1795): n is a, c, g, or t
  misc_feature (1801)..(1801): n is a, c, g, or t
  misc_feature (1813)..(1813): n is a, c, g, or t
  misc_feature (1827)..(1827): n is a, c, g, or t
  misc_feature (1838)..(1838): n is a, c, g, or t
  misc_feature (1840)..(1840): n is a, c, g, or t
  misc_feature (1854)..(1855): n is a, c, g, or t
  misc_feature (1863)..(1863): n is a, c, g, or t
  misc_feature (1866)..(1866): n is a, c, g, or t
  misc_feature (1868)..(1868): n is a, c, g, or t
  misc_feature (1879)..(1879): n is a, c, g, or t
  misc_feature (1892)..(1892): n is a, c, g, or t
  misc_feature (1904)..(1905): n is a, c, g, or t
  misc_feature (1907)..(1907): n is a, c, g, or t
  misc_feature (1915)..(1915): n is a, c, g, or t
  misc_feature (1932)..(1932): n is a, c, g, or t
  misc_feature (1934)..(1934): n is a, c, g, or t
  misc_feature (1938)..(1938): n is a, c, g, or t
  misc_feature (1944)..(1944): n is a, c, g, or t
  misc_feature (1961)..(1961): n is a, c, g, or t
  misc_feature (1980)..(1980): n is a, c, g, or t
  misc_feature (1991)..(1991): n is a, c, g, or t
  misc_feature (1997)..(1997): n is a, c, g, or t
  misc_feature (2000)..(2002): n is a, c, g, or t
  misc_feature (2014)..(2015): n is a, c, g, or t
  misc_feature (2019)..(2019): n is a, c, g, or t
  misc_feature (2039)..(2040): n is a, c, g, or t
  misc_feature (2044)..(2044): n is a, c, g, or t
  misc_feature (2057)..(2057): n is a, c, g, or t
  misc_feature (2063)..(2063): n is a, c, g, or t
  misc_feature (2072)..(2072): n is a, c, g, or t
  misc_feature (2090)..(2090): n is a, c, g, or t
  misc_feature (2094)..(2094): n is a, c, g, or t
  misc_feature (2101)..(2102): n is a, c, g, or t
tcctgcctctcctcgaccaatcgactctcttgtctatgcagcttgcttcccctatctattttctagagggagggggagagagggacaaccaagatccaaatcttggcctggcattcaaaagaagatccaaatcttggccagcgactcgaccggatctccagccgacgccggcgaccatggctcgccatcacctccttctcttcctccctctcctcgcgcttgccttctcctttgtcgtcgccgcccctgagagacagggagatgctgccgccttcatcgatggcgcatcgcaccgctacctgagggatcagcaagaggaccaggccacgtccatgtcacttgatgaagtttctgcagctgtttctgtcttgcttggttttgcaccacctgctatgcttcctgcaccttcttctgcaaagttcaacaagctgctactcccaaacccatttgacaggcctcgttctgttttcttgatgcaacttgatggatcccatgactatgttgattgcttcatatctgatgccggcagtatttacaaaaccaagattgatggtgcaaaaagtgctgctatagagcttacagataaggatgaattgattgtcattcgttcggatgaatcttctggattagatgttcttgataacgaactcgccaacttggcaacctggttggcgggatcctatcagaaagctgatagcaaattaaacattcccttgaagagtggaaacagtcttactttgttcctcactaaggaagcagacgttgaatttgcatccagcttgatctcccttcttaaaaccatcgaaaggggtattcaggttcacgaagatttctcaggaggcatcgtgagccctgcagagttattagtatgccacttcacgggcattaaggctctggaagatgaatatggttccgcagaaattgttaagcagggagctgaagtagttcagacagctctcacaaaagcatttgatcaattgcagggagcatataatggaaaaattgttggactggtaatatccgctaaggaggcttcaacatccttggcatccatcatcgatgcaccgtcttcattgcatatctcaagacggcttgcagaagcatctaaaactaatgctacagcttctatagctgctatatatcttgttagattgagtcttgcatggattacagggatcatccttctcgtctcaactctcattgggatttgcttgctcatgaacatgccgcttacgagggacacactcctatattcaaatgtcaagattgattagtttgtgctacatatgaattttcacacgatgacatgaaggttttcaacagtcatgcttggtttttcctttggaccctggggtttacagtaggaacgtgagtgtgggcttgctgttcatccagtttagcataaaaatactgttgctttgtccatttagaatcgtactgccactgcctgtttgggcttctcatgtttttccgtaaataaataacaataatcgagtggggtgtattttgttaatatcggtcatgattgtattgttgcaaaaagcattatctgaataaattcgccactcgaatattcattgggatagattttgtcttcatatatgacgttaaatgatttattgagttgaaatttcnnaanaanaaaaaaaaaaaaaagaaaaaaaaaaaaaaaaaaaaaaaaaaaaaaaaaaaaaaaaaaaaaaaaaaaaaaanngggggggggccccctaaaaatttcccccggggggcccaaatttaccnnnccccnttttttttnaaaaaaggggcccctaangggggnccttttaaaatnggggcctggccccntttttaaaacncngggaagggaaaaanntctaattnggnanttttggaaagnaaccttctttggngggggggaaaanntnggcaaacnctcccccaaaattttangncctnaggggnaaataaaaaattttaanggggaaaaaggggaaaaanaaccccaaatncttgcnccnnnaaaaattttccnntccnggggttgttttttaaaaaanntttncccccggggcccngggggntccaaatgntttggggatttaaaaaanaacngccccanngggttttttttgggcccc

SEQ ID NO: 1927 - DNA, 1608 bp, Triticum aestivum
tcctgcctctcctcgaccaatcgactctcttgtctatgcagcttgcttcccctatctattttctagagggagggggagagagggacaaccaagatccaaatcttggcctggcattcaaaagaagatccaaatcttggccagcgactcgaccggatctccagccgacgccggcgaccatggctcgccatcacctccttctcttcctccctctcctcgcgcttgccttctcctttgtcgtcgccgcccctgagagacagggagatgctgccgccttcatcgatggcgcatcgcaccgctacctgagggatcagcaagaggaccaggccacgtccatgtcacttgatgaagtttctgcagctgtttctgtcttgcttggttttgcaccacctgctatgcttcctgcaccttcttctgcaaagttcaacaagctgctactcccaaacccatttgacaggcctcgttctgttttcttgatgcaacttgatggatcccatgactatgttgattgcttcatatctgatgccggcagtatttacaaaaccaagattgatggtgcaaaaagtgctgctatagagcttacagataaggatgaattgattgtcattcgttcggatgaatcttctggattagatgttcttgataacgaactcgccaacttggcaacctggttggcgggatcctatcagaaagctgatagcaaattaaacattcccttgaagagtggaaacagtcttactttgttcctcactaaggaagcagacgttgaatttgcatccagcttgatctcccttcttaaaaccatcaaaaggggtattcaggttcacgaagatttctcaggaggcatcgtgagccatgcagagttattagtatgccacttcacgggcattaaggctctggaagatgaatatggttccgcagaaattgttaagcagggagctgaagtagttcagacagctctcacaaaagcattggatcaattgcagggagcatataatggaaaaattgttggactggtaatatccgctaaggaggcttcaacatccttggcatccatcatcgatgcactgtcttcattgcatatctcaagacggcttgcagaagcatctaaaactaatgctacagcttctatagctgctatatatcttgttagattgagtcttgcatggattacagggatcatccttctcgtctcaactctcattgggatttgcttgctcatgaacatgccgcttacgagggacacactcctatattcaaatgtcaagattgattagtttgtgctacatatgaattttcacacgatgacatgaaggttttcaacagtcatgcttggtttttcctttggaccctggggtttacagtaggaacgtgagtgtgggcttgctgttcatccagtttagcataaaaatactgttgctttgtccatttagaatcgtactgccactgcctgtttgggcttctcatgtttttccgtaaataaataacaataatcgagtggggtgtattttgttaatatcggtcatgattgtattgttgcaaaaagcagtatctgaataaattcgccactcgaatattaattgggatagattttgtcttcatatatgacgt

SEQ ID NO: 1928 - DNA, 1542 bp, Triticum aestivum
cagcttgcttcccctatctattttctagagggagggggagagagggacaaccaagatccaaatcttggccagcgactcgatcggatctccagccgacgccggcgaccatggctcgccatcacctccttctcttcctccctcttctcgcgcttgccttctcctttgtcatcgccgcccctgagagacagggagatgccgcggccttcatcgatggcgcatcgcaccgctacctgagggatcagccagaggaccaggccacgtccatgtcacttggtgaagtttctgcagctgtttctgtcttgcttggttttgcaccacctgccattcttcctgcaccttcttctgcaaagttaaacaagctgctactcccaaacccatttgacagacctcgttctgttttcttgatgcaacttgatggatcccatgactatgttaatggcttcatatctgatgccggcagtatttacaaaaccaagattgatggtgcaaaaagtgctgctatagagctttcagataaggatgaattgattgtcattcgttcggatgaatcttctggattagatgttcttgataacgaactcgccaacttggcaacctggttggcgggatcctatcagaaagctgatagcaaattaaacattcccttgaagagtggaaacagtcttactttgttcctcactaaggaagcagacgttgaatttgcatccagcttgatctcccttcttaaaaccatcgaaaggggtattcaggttcacgaagatttctcaggaggcatggtgagccctgcagagttattagtatgccacttcacgggcattaaggctctggaagatgaatatggttccgcagaaattgttaagcagggagctgaagtagttcagacagctctcacaaaagcatttgatcaattgcagggagcatataatggaaaaattgttggactggtaatatccgctaaggaggcttcaacatccttggcatccatcatcgatgcaccgtcttcattgcatatctcaagacggcttgcagaagcatctaaaactaatgctacagcttctatagctgctatatatcttgttagattgagtcttgcatggattacagggatcatccttctcgtctcaactctcattgggatttgcttgctcatgaacatgccgcttacgagggacacactcctatattcaaatgccaagattgattagtttgtgctacatacgaattttcacacgatgacatgaaagttttcaacagtcatgcttggtttttcctttggatcctggggtttacagtaggaacgtgagtgtgggcttgctgttcatgcagtgtagcataaaaatactgttgctatgtccttcatttagaatcatactgccactgcctgtttgggcttctcatgtttttccgtaaataaataacaatattcgagtggggtttattttgttaatatcggtcatgattgtatttttgcaaaaagcagtatctgaataaattcgccactcgaatattcattgggatatattttgtcttcatatatgacgt

SEQ ID NO: 1929 - DNA, 1518 bp, Triticum aestivum
gaggggggcagccaagatccaaatcttctgtggcgactcgatcggatctccagccgacgccggcgaccatggctcaccgtcaccacctccttctcctccttcctctcctcgcgcttgccgtctccttcgtcgtcgccgcccctgagggacatggagattccgccgccttcatcgacggcgcgtcgcaccgctacctgcgggatcagcaggacgaccaggccacgtcgatgtcacttgatgaagtttccgcagctgtttctgtcttgcttggttttgcaccacctgccatgcttcctctgccttcttctgcaaagttaaacaagctgctactcccaaagccatttgacaggcctcgtgctgttttcttgatgcaaattgatggatcccatgactctgtcgatagcttcatatctgatgccggtagtatttacaaaaccaagattgatggtgcaaacaatgctgctacagggcttacagataaggatgaattgattgtcatttgttcagatgaatcttctggatcagatgttcttgataatgaactcaccgacttggcaacctggttggagggatcctaccagaaagctgatggcaaattaaacatccccttgaagagtggaaacagtcttactttgctcctcaataaggaagtagacgttgaatttgcatccagcttgatctcgcttctcaaaaccatcaaaaggggtattcaggttcatgaagatttttcaggaggcatcgtgagccctgcagagttattagtatgccgcttcacgggcattaaggctctggaagatgaatatggttctgcagaaattgttaagcagggagctgaagtagttcggacagctctgaccaaagcatttgatcaattgcagggagcatataacgggaaaattgttgggctggtaatatccactgaggaggcttcaacatccttggcatccatcatcgatggaccgtcttcattgcatatctcgagacggcttgcagaagcatcgaaaactaatgctacagcttctatagctgctatatatcttgttagattgagtcttgcatggattacagggatcatccttcttgtctcaactctcattgggatttgcctgctcatgaacatgccgcttaccagggacacactcctatattcaaatgtcaagatggattagtttgtgctacatatgaattttcacgtgatggcatggaagttttcaacagccatgcttggttttttccgttggaccctggggtttacagtagggaggctgagtgtggacttgctgttcacccagtgtagcataaacatactgttgctatgtggatccttatttagaattgtatactgccactgcctgtatgggcttctcttgcttttccgtaaataaataaaaataaccgggaggggtgtattttgttaatatcagcgaagattgtactgtattgttgtaaaaaaaaccagtatctggataaattcgcaacttggatattcaatgggatagctgttgtcttcatatatga

SEQ ID NO: 1930 - DNA, 1538 bp, Triticum aestivum
tattttctagaggtagtcagaggggggcagccaagatcaaaatcttctgtagcgactcgatcggatctccagccgacgccggcgaccatggctcgccgtcaccacctcgtcgtcctcctccctctcctcgcgcttgccgtctccttcgtcgccgccgcccctgagggacatggagatgccgccgccgccttcatcgacggcgcgccgcaccgctacctgcgggatcagcaggacgaccaggccacgtcgatgtcacttgatgaagtttctgcagctgtttccgtcttgcttggttttgcaccacctgccatgcttcccgcgccttcttctgcaaagttaaacaagctgctactcccaaagccatttgacaggcctcgtgctgttttcttgatgcaaattgatggatcccatgactctgtcgatagcttcgtatctgatgccggtagtatttacaaaaccaagattgagggtgcacaaaatgctgctacagggcttacagataaggatgaattgattgtcattcgttcagatgaatcttctggatcagatgttcttgataatgaactcaccgacttggcaacctggttggagggatcctaccagaaggctgatggcaaattaaacatccccttgaagagtggaaacagtcttactttgctcctcaataaggaagtagacgttgaatttgcatccagcttgatctcccttctcaaaaccatcaaaaggggtattcaggttcatgaagatttctcaggaggcatcgtgagccctgcagagttattagtatgccgcttcacgggcattaaggctctggaagatgaatatggttctgcagaaattgttaagcagggagctgaagtagttcagacagctctcaccaaagcatttgatcaattgcagggagcatataacgggaaaattgttgggctggtaatatccactaaggaggcttcaacatccttggcatccatcatcgatggaccatcttcattgcatatctcaagacggcttgcagaagcatcgaaaactaatgctacagcttctatagctgctatatatcttgttagattgagtcttgcatggattacagggatcatcctccttgtctcaactctcattgggatctgcctgctcatgaacatgccgcttaccagggacacgctcctatattcaaatgtcaagatggattagttttacatatgaattttcgcacgatggcatggaagttttcaatagtcatgcttggttttttcctttggaccttgggtttacagtagggacgctgagtgtgggcttgctgttcacccaccacccagtgtagcataaaaatactgttgctatgtgaaccgttcatctagaattgtactgccattgcctgcatgggcttctctcattttcccgtaaataaataaaaaacaatcgagaggagtgtattttgttaatatcagcgaagattgtactctattgttgtaaaaacccagtatctgaataaattcgccacttggatattcattgggatagctgttgtcttcatatat

SEQ ID NO: 1931 - DNA, 1502 bp, Triticum aestivum
aagatccaaatcttggccagcgactcgatcggatctccagccgacgccggcgaccatggctcgccatcacctccttctcttcctccctcttctcgcgcttgccttctcctttgtcatcgccgcccctgagagacagggagatgccgcggccttcatcgatggcgcatcgcaccgctacctgagggatcagccagaggaccaggccacgtccatgtcacttggtgaagtttctgcagctgtttctgtcttgcttggttttgcaccacctgccattcttcctgcaccttcttctgcaaagttaaacaagctgctactcccaaacccatttgacagacctcgttctgttttcttgatgcaacttgatggatcccatgactatgttaatggcttcatatctgatgccggcagtatttacaaaaccaagattgatggtgcaaaaagtgctgctatagagctttcagataaggatgaattgattgtcattcgttcggatgaatcttctggattagatgttcttgataacgaactcgccaacttggcaacctggttggcgggatcctatcagaaagctgatagcaaattaaacattcccttgaagagtggaaacagtcttactttgttcctcactaaggaagcagacgttgaatttgcatccagcttgatctcccttcttaaaaccatcgaaaggggtattcaggttcacgaagatttctcaggaggcatggtgagccctgcagagttattagtatgccacttcacgggcattaaggctctggaagatgaatatggttccgcagaaattgttaagcagggagctgaagtagttcagacagctctcacaaaagcatttgatcaattgcagggagcatataatggaaaaattgttggactggtaatatccgctaaggaggcttcaacatccttggcatccatcatcgatgcaccgtcttcattgcatatctcaagacggcttgcagaagcatctaaaactaatgctacagcttctatagctgctatatatcttgttagattgagtcttgcatggattacagggatcatccttctcgtctcaactctcattgggatttgcttgctcatgaacatgccgcttacgagggacacactcctatattcaaatgccaagattgattagtttgtgctacatacgaattttcacacgatgacatgaaagttttcaacagtcatgcttggtttttcctttggatcctggggtttacagtaggaacgtgagtgtgggcttgctgttcatgcagtgtagcataaaaatactgttgctatgtccttcatttagaatcatactgccactgcctgtttgggcttctcatgtttttccgtaaataaataacaatattcgagtggggtttattttgttaatatcggtcatgattgtatttttgcaaaaagcagtatctgaataaattcgccactcgaatattcattgggatatattttgtcttcatatatgacgttaaatgatttat

SEQ ID NO: 1932 - DNA, 1638 bp, Avena sativa
gaatcgatcgactactactccttctctgtgttccccaatctattccagagagagaaagagaggggcacgacgcagctcggcaaccaagatccaaatcttcgccagcgacccggcgatccgatccggatctacagtcaacgccggcgcgccatggctcgccaccacctcctcctgctcctccctctcctcgcgctcaccttctccgtcgccgtcgcgtccactgagggacagggagactccgccgccttcatcgatggcgcgtcgcaccgctacctgcgggatcagcaagacgaccaggccactttgatgtcacttgatgaagtttctgcagctgtttctgtcttgcttggttttgctccaccggccatgctaccttcgcattcttctgcaaagttgaacaaagtgctgctccctaacccatttgacagaccccgtgctgttttcttgatgcaactcgatggatccaagacctctgtcgatagctttgtatctgaagccggtggtattttcagaaccaaggttgaaggtgcaaaaaatgctgcaacagggcttacagataaggatgaattaattgttattcgttcggacgaatctctagatgctcattctggatcagattctcttgataatgaactcaccgatttggcaatttggttagagggatcatatcagaagactgatggcaaattgaacattcccttggagagtggaaacagtcttactttacttgtctctaaggatgcagacttggaatttgcatccagcttgatctcccttcttaaaaccatcacaaggggtattcaggttcaccaagatttctcaggaggcatcgtgagccctgcagagttattagtatgccgctttacaggcatgaaggctctggaaggtgaatatggttctgcggaagttgttaagcagggagctgaagtagttcggacagctctcaccaaagcatttgatcagctgcaggcagcatataacgggaaaattgttgggctggtaatatccacaaatgaagcatcaacatccttggcatccatcattgatgcaccatcttcattgcatatctcaagacggctagcagaagcaagcaaaactaatgcttcagcttctatagctgctattattcttgttagattgagtttggcatggactactgggatcatccttcttatctcgactctcatagggatttgcttgctcatgaacatgccgcttaccagggataccctcctgtattcaaatgtcaagcttgattagtttgtgttatatatgatttttcacacgacgacatggaagttttctacagcctgtgtctttttcttgtgaatcctgggttttacagtatagccgatcgtttgtttgctgtacacccagtgtagcataaaacactgcttctatgcggatccctcatgtgaaactgtattgctactgcctgtatgggcttctcttgtttccagtaaatatcaataatcgggaggagtgtattttgttaatatctttgacgattgtattatcgcggaatgcttagtatctgaataaattcactgctcgaatattcagtgtgatggctgttgtcactatggtgaatctgttggtgttaattttcctgagcctgctggaatttcaaatgaatcg

SEQ ID NO: 1933 - DNA, 1489 bp, Brachypodium distachyon
gtctcctccgctgcgcctcggaaagaaagacagagagagacaccaacaccaacaccaacgccaagatccaaatccctttcgctagcgagcgcgacctggcggcgatccgatccgatctcctgccgccggcgaccatggctcgccgtcacctcctccttcctctcctcgcgctcgccttctccgtctccctcgccgcccctcagggactgggagatgtcgccgccttcatcgatggtgcgtcgcaccgctacctgaggcatcagcaacacgaccaggcctcttcaatgtcgcttgatgaagtttctgcagctgtttctgtcttgcttggttttgcaccaccagcctcgctacctgcgctttcttcttcaaagttaaacaaagtgctactccctaacccatttgatagaccccgtgctgttttcttgatgcaactcgatggatcccacgcctccgtcgatagcttcatatctgaagccggtactattttcagaacaaggattgatggtgcaaaaaatcttgccacgggtcttacagacaaggatgaattaattgtcatccactcagatgaatctcttgctgttcaagataatgacctcaccaacttggccaattggttggagggatcatatcagaaggctgatggcaaattgaaaattcccctggagagtggaaacagtcttactctgttcatttctaaggaagcagacctggaatttgcctccagcttgatctcccttcttaaaaccatcaaaaggagcatccaggttcacgaagatttctcaggaggcattgtgagccctgcagagttattagtatgccacttcacaggcattaaggctctggaagatgaatatggttccgcggaaattgttaagcagggagctgaagtagtccggacagcactttccaaagcatttgatcttctgcagggagcatacagagggaaaattgttgggctggtaatatccgcaaaggaggcatctacatccttggcatccatcattgatgcaccatcctcaatgcatatctcaagacggctagaagaagcaagcagaactaatgctgcagcttctatagctgcgatatatcttgttagattgagtttggcatggattactgggatcatccttcttgtctcgactctcattggggtttgtttgctgatgaacatgccgctcacgagggacacactcctgtattcaaatgtcaagattgattagttggtactacatatgcaccttgacacgaccctgggttttacattagatctgcaagtgtttacctgctgcttactcagtgtagcaaaatatactgttgctatgtggatccttcatttagaattgtactgctgctgctgcatgtatgggctcgtcttgttttttggtaaataataataagcaaggggagtgtattttgttgatattccagacaaattgtttttgtggaatatactggtatctgaataaatttgtggctcaaacgtttaagg

SEQ ID NO: 1934 - DNA, 1531 bp, Triticum aestivum
gcagcttgcttcccctatctattttcttagagggagggggagagagggacaaccaagatccaaatcttggccagcgactcgatcggatctccagccgacgccggcgaccatggctcgccatcacctccttctcttcccccctctcctcgcgcttgccttctcctttgtcgtcgccgcccctgagggagatgccgccgccttcatcgatggcgcatcacaccgctacctgagggatcagcaagaggaccaggccacgtccatgtcacttgatgaagtttctgcagctgtttctgtcttgcttggttttgcaccacctgccatgcttcctgcaccttcttctgcaaagttaaacaagctgctactcccaaacccatttgacaggcctcgttctgttttcttgatgcaacttgatggatcccatgactatgttgatggcttcatatctgatgctggcagtatttacaaaaccaagattgatggtgcaaaaagtgctgctatagagcttacagataaggatgaattgattgtcattcgttcggatgaatcttctggattagatgttcttgataacgaactcgccaacttggcaacctggttggcgggatcctatcagaaagctgatagcaaattaaacattcccttgaagagtggaaacagtcttactttgttcctcactaaggaagcagacgttgaatttgcatccagcttgatctcccttcttaaaaccatcgaaaggggtattcaggttcacgaagatttctcaggaggcatcgtgagccctgcagagttattagtatgccacttcacgggcattaaggctctggaagatgaatatggttccgcagaaattgttaagcagggagctgaagtagttcagacagctctcacaaaagcattggatcaattgcagggagcatataatggaaaaattgttggactggtaatatccgctaaggaggcttcaacatccttggcatccatcatcgatgcactgtcttcattgcatatctcaagacggcttgcagaagcatctaaaactaatgctacagcttctatagctgctatatatcttgttagattgagtcttgcatggattacagggatcatccttctcgtctcaactctcattgggatttgcttgctcatgaacatgccgcttacgagggacacactcctatattcaaatgtcaagattgattagtttgtgctacatatgaattttcacatgatgacatgaaggttttcaacagtcatgcttggtttttcctttggaccctggggtttacagtaggaacgtgagtgtgggcttgctgttcatccagtgttgcataaaaatactgttgcttgtccatttagaatctactgccactgcctgtttgggcttctcatgtttttccgtaaataaataacaataatcgagtggggtgtattttgttaatatcggtcatgattgtattgttgcaaaaagcagtatctgaataaattcgccactcgaatattaattgggatagattttgtcttcatatatgac

SEQ ID NO: 1935 - DNA, 664 bp, Saccharum officinarum
aagagagagactgacagcagaaggaagagtccgatcctgagccattcatacaacatggcagcctcagtcatggcctctttgtctctgaaaccatctccattcttggatcggtcgaggttcacaggtgtccagccatcagcaagatcttcaaccttcagagtaatggccaagaaaacaaagaagatccaaacatcccagcctttcgggcctgcaggagggttgaacttgaaggatggtgttgatgcatctggaaggccagccaaggggaagggtgcctaccagttcaccaataaatacggagcaaatgttgatggatacagtccaatatataacccagaagaatggtctccaagtggtgacgtttatgttggaggaaagacagggttgttgctctgggcagtcactcttacgggaatgttgctgggtggtgctcttcttgtttacaatactagcgccctggcttcttgaagcctggctgcagcaaataaaattatgtgccatgcagtgtcacgttgtttagatatatctgtatccagctgtccctagatctataggatatgtgaatgacacatccataaataattatcattgctatgtgttgtacaatgtgacaaactgacgaaattcagtaagggggaagaaactatcgcttgaccaaataaat

SEQ ID NO: 1936 - DNA, 715 bp, Panicum virgatum
ggccaaagaaaagaaaaaaactggcagaaaaagggagggagtgatcttgagccattatacaagtatacaaccatacaacatggaagccactgtcatggcctctttggctctgaaaccatctccattcttggatcgatcgaggttcccaggcgtcaagccatcagcaagatcttcagccttcagagtaatggcgaagaaagctaagaagatccaaacttctcagcctttcggccctgcaggaggattgaacttaaaggatggtgttgatgcatctggaaggccagccaaggggaagggtgtctaccagttctccagcaaatacggggcaaatgttgatgggtacagcccaatatataatccagaagaatggtctccaagcggcgatgtttatgttggagggaagacagggttgttgctctgggcaatcactcttgctggaattttgctgggtggtgctcttcttgtctacaatactagcgccttggcttcttgaagcctggcttcagaaaatataaactgtggaccatgtagtgtcgtttcgtttagatatatctgtatccagctatgtcactagaatccgtatgagatgtaaatgaaaaatccttaaataagtaatgctcttatgtgttgtggctagaaaatagctgacacttgtgaagttttatagatttgaaactcgattgatgaaagaatagaaagattaattccatgcaga

SEQ ID NO: 1937 - DNA, 836 bp, Brachypodium distachyon
ttccttcaaattctatcatcttcaagagttcaaggtcatgtgaaggacagcgaaagatcacacagttgtggtccatgaacctattggcaccacacagcaactgacacttgtcaagcaaagctcaatcacttgcttctaaattcaacctgcatccttgtatttaaagcaagtattgcacatgatttagcaaagaaaataaagactgacagcaaaaggaagagcgagagcgagcttactgtcatacgcatggcggcctcagtcatggcttctacggctttgaaaccatctccatctccatttatcgggcagccgcggctccgagccatccagccttcagcaagatcaccatctttcagagtaatgtccaaaaaggcaaagaaggtccagacttctcagcctttcgggcctgggggaggattggaattgaaagacggtgttgatgcatcgggaaggccagccaaggggaaaggtgtctaccaatttgccagcaagtacggagcaaatgttgatgggtacagcccaatatataacccagaagaatggtctccaagtggtgacttctatgctggaggaaagacggggttgttgctctgggcagtcactttggctggaattctgctgggtggtgcacttcttatctacaatactagttctttggcttcttaaatcctaggagcaacaaacctaagcatgtagcatacaaggattacacaatctaaaatagatattcgctcacctatgttcctagactaattaccatatgtgaataaaaatccataagtaattaatgttcttatttgttgtgcaatgtgattgtgataacgtaacagaaactc

SEQ ID NO: 1938 - DNA, 655 bp, Oryza sativa
aagaaaagagactgacagcaaattggagagtaagagatagcatcttacgcatggcaacctctgtcatggcctcttgtgctctaaaaccatctccatctccatttttggaacagacgcgaatccgagccatccaaccatcatcaaggccatccttgttcagagtaatggccaaaaaagcaaagaagatccagacttctcagcctttcggacctggaggaggactgaacctgaaagacggtgttgacgcgtccggaaggccaatcaaggggaaaggggtctaccagtttgccagcaagtatggagctaatgttgatggatacagcccaatatataacccagaggaatggtcaccaagtggtgatctttatactggaggaaagacagggttgttgctctgggcagtcactctttctggaattctgctggctggtgctcttcttgtctacaatactagtgccttggcttcttgaagcttgttttgaagaaaaccaacttattgtagtgccatgcaaggtttacatattctagaatggatctgtgtacagctatgttcctagaattaacttctgagtgaataaaactatgtaagtaatgttcttatgtgttcgtgcaataatatagaagctcaataagcagagtaaacatatggggttca

SEQ ID NO: 1939 - DNA, 825 bp, Triticum aestivum
agaagcaaattagactagcagcaaaaaaggaagagcgagagcttactgtcattcgcatggcgacctcgatcatggcttctatggctctgaaatcatctccatcgccattttctgggcagtcgcagctccagcgcatccagccttcagcacgatcatcatctttcagagtaatgtccaaaaaggcaaagaaagttcagacttctcagcctttcgggcccgggggaggattggaactgaaagatggtgttgatgcatctggaaggccagccaaggggaagggcgtctaccagtttgccagcaagtatggagcaaatgttgatgggtacagcccaatatataacccagaagaatggtctccaagtggtgactactatgcgggaggaaagacagggttgttgctctgggtggctactcttgctggaattctgctgggtggtgctctgcttgtttacaatactagtgctttggcttcttgaagcctggtatcgcaaaccaaattgtgtaccatgcaaggatttacatcatctagggtagatattcagacacctacatccctagacttaattaccacaagcaataaatttccgatatgcaaataatggtcttatatcttgtgcaattgatgtaatcaagactaaataatcagcaaaatgctacgccttcagttaacaaggcagtggatatgagtgcacagagtctgacttgaacaaaatagctgaacatgacataactgaaatatgggacagctcatgacgaaatagtacaatttgttttctcttagcacgtctccgctaatgctctgcatagcatttggttccagcgtgt

SEQ ID NO: 1940 - DNA, 563 bp, Festuca arundinacea
ccgcccgggcaggtagagaacttactgtcgtacgcatggggacctcggtcatggcttctatggctctgaaaccatctccatttcaatttttcgggaagtcacggctccaaggcatccagccttcaacaagatcatcatctttcagagtaatgtccaaaaaagcaaagaaggtcaagactactcagcctttcgggcctgggggaggactggaactgaaagatggtgtcgatgcatcaggaaggcaagccaaggggaagggcgtctaccagtttgccaacaagtatggagcaaatgttgatgggtacagcccgatatataacccagaagaatggtctccaagtggtgactattatgctggtggaaagacgggattgttgctctgggtagccactctttctggaattctgctgggtggtgctcttcttgtttacaatactagtgctttggcttcttgaagcctgggtacagcaaaccaaattatgtaccatgcaaggattacatcatctagagtagatatatgaccacctatgtccctagactaaactatcaaaagtggtaaattt

SEQ ID NO: 1941 - DNA, 1781 bp, Solanum tuberosum
ctttttgggtatctttactccaacaatggcggctacacaccttgtctcacactcttcatcacttcacaagtccctcaaatacccatcaaatgcatcacaaaaactttattttttcaaacccaattttccgttgaagcccatttcaagaaatcttagcataagggcatctgtatcaacttctgagccccaaactcagaaatttcagcattgtttcaagaaatctgaagatgggtttttgtattgtgagggtgttaaggttgaagatgttatggagaccgtggaaagacgacccttttatttatatagtaagccccaaattactaggaatgttgaggcttataaggcggctttagaaggtttgaattcgattattggttatgctattaaggccaataataatctcaagattttggaacatttgaggggccttggctgtggagctgttttggttagtgggaatgaactcaaattggcacttactgctggatttgatcctaccaagtgtatttttaatggaaatggaaagctgttagaggacttagtgctagctgcccaagcaggtgtgtttgtaaacatcgacagcgaatttgacttggataacattgtagcagctgcaaggctggctgggaagaaagttaacgtgctactcaggattaatccagatgtggatccccaggttcatccttatgttgccaccggcaataagagctccaaatttggcatcagaaatgagaagctgcaatggtttctagatgctgtcaaggcacatcctcaggaattgaaacttgttggagctcattgtcatcttgggtcaactatcaccaaggtagacatttttcgagatgcagctgtcttgatggtgaactacattgacgaaatccgatctcaaggatttgaaattgattacctgaatattggaggtggtttagggattgattactatcatgctggagctatccttccttcacctagagatcttattaatacggtacgagaattggtcctttctcgaaacctcaatctcattattgaacctggaagatcactaattgcaaacacatgctgcttggttaacagagttaccggagttaaaaccaatgggaccaaaaactttattgtgattgatggtagtatggctgagcttatacgtccaagtctttatgatgcttatcagcacatagagcttgtttcccctccacctccggaagctgcaattgcgaagtttgatgttgttggtcctgtatgtgaatcggctgatttcctggggaaggaccgtgaacttcccgcccctactaggggcactggtttggtagttcacgatgcaggtgcttactgcatgagtatggcatcaacttacaatcttaagatgcgcccaccagagtattgggtggaagaagatggatcactgtccaaaatccgtcatggggagacattcgaagaccatttaagattctttgatggtctgtaaaattatggtttcttttaagcacttaaacatgacaggatgtgaaactcagaaattcctctggtagtttggttcctgtcaatgttgacaattctgtatttggattgttccaattaatggattttcccagcggccgctaacgagctgttcccaccgaggatgctaaagaatttgcacaaaaagaaagattgttcttcttagagacatctgcaatggaggccacaaacgtcgaggatgccttcttaaccgttttgacagatatcttcaacattgtgaacaagaagaatcttgccgcgggtgattatcaagcatatgg

SEQ ID NO: 1942 - DNA, 1645 bp, Solanum phureja
aatctgtgcaaacccttgcaatttcacaaagtctaaaagcctttttgggtatctttactccaacaatggcggctacacaccttgtctcacactcttcatcacttcacaagtccctcaaatacccatcaaatgcatcacaaaaactttattttttcaaacccaattttccgttgaagcccatttcaagaaatcttagcataagggcatctgtatcaacttctgagccccaaactcagaaatttcagcattgtttcaagaaatctgaagatgggtttttgtattgtgagggtgttaaggttgaagatgttatggagaccgtggaaagacgacccttttatttatatagtaagccccaaattactaggaatgttgaggcttataaggcggctttagaaggtttgaattcgattattggttatgctattaaggccaataataatctcaagattttggaacatttgaggggccttggctgtggagctgttttggttagtgggaatgaactcaaattggcacttactgctggatttgatcctaccaagtgtatttttaatggaaatggaaagctgttagaggacttagtgctagctgcccaagcaggtgtgtttgtaaacatcgacagcgaatttgacttggataacattgtagcagctgcaaggctggctgggaagaaagttaacgtgctactcaggattaatccagatgtggatccccaggttcatccttatgttgccaccggcaataagagctccaaatttggcatcagaaatgagaagctgcaatggtttctagatgctgtcaaggcacatcctcaggaattgaaacttgttggagctcattgtcatcttgggtcaactatcaccaaggtagacatttttcgagatgcagctgtcttgatggtgaactacattgacgaaatccgatctcaaggatttgaaattgattacctgaatattggaggtggtttagggattgattactatcatgctggagctatccttccttcacctagagatcttattaatacggtacgagaattggtcctttctcgaaacctcaatctcattattgaacctggaagatcactaattgcaaacacatgctgcttggttaacagagttaccggagttaaaaccaatgggaccaaaaactttattgtgattgatggtagtatggctgagcttatacgtccaagtctttatgatgcttatcagcacatagagcttgtttcccctccacctccggaagctgcaattgcgaagtttgatgttgttggtcctgtatgtgaatcggctgatttcctggggaaggaccgtgaacttcccgcccctactaggggcactggtttggtagttcacgatgcaggtgcttactgcatgagtatggcatcaacttacaatcttaagatgcgcccaccagagtattgggtggaagaagatggatcactgtccaaaatccgtcatggggagacattcgaagaccatttaagattctttgatggtctgtaaaattatggtttcttttaagcacttaaacatgacaggatgtgaaactcagaaattcctctggtagtttggttcctgtcaatgttgacaattctgtatttggattgttccaattaatggattttccctatgactttcca

SEQ ID NO: 1943 - DNA, 1773 bp, Nicotiana tabacum
  misc_feature (906)..(906): n is a, c, g, or t
  misc_feature (1022)..(1022): n is a, c, g, or t
  misc_feature (1450)..(1450): n is a, c, g, or t
  misc_feature (1459)..(1459): n is a, c, g, or t
  misc_feature (1474)..(1474): n is a, c, g, or t
  misc_feature (1477)..(1477): n is a, c, g, or t
  misc_feature (1516)..(1516): n is a, c, g, or t
  misc_feature (1738)..(1738): n is a, c, g, or t
acagtcatcatgaatcatgagttacatttttctgtttccctcacgcaaaccgtaaacaaataattgccttctaaacctaaacctaaacccctttgactcatatagcctgaaaaggccttacaatttcgcagtctaaagccttgtgtctgtatcttttgctccaaaaatggcggctacgcaccttgtctctcactctccatcacttcccaaatctctcaaatacccttcaaacccaacaccaaagctctcatttttcaaacccattttcccattaaagcccatttcaagaaatctatgcgtaagagcagctgtatcaacttctgagcctcaaactcagaaatttcagcactgtttcatgaaatctggagatgggtttttgtattgtgaaggtgttaaggttcaagatgttatggaaactgtagaaaaaaggcctttttatttgtatagtaagccccaaattactaggaatgttgaggcttataaggcagctttagagggtttgaattccattattggttatgctattaaggccaataataatctcaagattttggaacatctgagagggcttggttgtggggctgttttggttagtgggaatgagctcaagttggctcttcgtgctggatttgatcctaccaagtgtatttttaatggaaatgggaagctgttggaggacctagtgatagctgcccaagaaggagtgtttgtaaacatcgacagcgaatttgacttggataacattgtagcagctgcaaggatttctgggaagaaggttaatgtgctactcaggattaatccagatgtggatcctcaggttcatccttatgttgccactggaaataagagctccaaatttggcatcagaaatgagaagctgcaatggttcctagatgctgtcaaggnacatcctcaggaactgaaacttgttggagctcattgtcatcttgggtcaactatcaccaaggtcgacatttttcgagatgcagctgtcttgatggtgaactacattgatgaaattngatcccaaggatttgaaatcaattacctgaacattggaggtggcttaggaattgattactatcattctggagctgtccttccgtcacctagagatcttattgatacggtccgagaattagtcctctcacggaagctcaatctcattattgaacccggaagatcactaattgcaaacacatgctgtttggttaacagagttactggagttaaaaccaatgggaccaaaaactttattgtgattgatggtagcatggcagagcttatacgtccaagtctttacgatgcttatcagcacatagagcttgtttcccctccacctccagaagctgcgatttctaggtttgatgttgttggtcctgtatgtgaatctgcagatttcctgggaaagggccgggaacttcccgcccctactaggggcactggtctngtagttcangatgcaggagcttantgnatgagtatggcatcaacttacaatctcaagatgcgaccncctgagtactgggtggaagaagatggatcaatatccaaaatccggcacggggagacatttgaagaccatttgagattctttgagggtctgtaaaatctctggtcattttaaccacttaaagcatagcaagatgtgaaacttgggaattcccctattagttttcatcttgtcaatgttgacattctgtactttggattatttcaaaattggatttttgttacnatttatgtgtgatgtgatgtggagcggccgcatga

SEQ ID NO: 1944 - DNA, 1720 bp, Cucumis melo
ttcaagtttcccttccactaacctaaatttaaatgcttacaaaatcactctcaacggtgatccagtaagaaatttcttagcaatggcggccacaaatctctactctccttctccttccctttccagcaccctcaaacactctctcaactcaaacccttttcaccgtattccatttcgtcttcacaaaccctttctcaaaactcccctttccctaaaagctgttctttctcaaaacccttctaaaacccagacccaatttcagcattgtttctccaaatcctcagatgggtttctttattgcgagggaattaaggtgcaggacatcatggaatctgttgataaacgccctttctatctttacagcaaaccccagataactagaaatgttgaagcttataaagaagctttggaaggactgaattccatcattggttatgcgattaaggctaataataatttgaaagtgctggagcatttgaggaagttgggttgtggagctgtgcttgttagtggaaatgagcttcgtttggctcttcatgctggttttgaccccaccaaatgtatttttaatgggaatggtaaacttttggaggatttggttctagcagcggaacaaggtgtttttgtcaatgtggatagtgagtttgacttggataatattgtagctgctgcaagaattgctggaaagaaagttaatgttttacttcgtattaatccggatgtggatcctcaggtacatccttacgttgccaccggtaataaaaactccaaatttggtattaggaatgaaaagttgcaatggtttctggatgctgttaaggcacatcctgatgaacttaagcttgttggggcccattgccatcttggttccaccatcaccaaggtggacatattcagagatgctgcagtattaatggtcaactacattgacgagatcagagatcaaggttttgaagttgattacctaaacattggaggtggacttggtatagattattatcatgctggagccattcttcctactcctagagatctcattaatacagtacgagagctggtgctttcacgaaatcttaatctaatcattgagcctgggagatcagtgattgccaatacttgctgtttggtgaatcgagtgactggagtcaaaactaatgggactaaaaactttattgtaatcgatggaagcatggctgagcttatccgccctagtctttatgatgcttatcaacacatagagttggttgctcctacgccacctgattctgagatctcgacttttgatgtggttggccctgtctgtgagtctgcagatttcttagggaagcaaagggaactcccaactccccccaagggggctggcttggttgtccatgatgctggtgcttactgcatgagtatggcatctacttacaatctcaagatgcgtcctccagagtactgggttgaagaagatggatcagtgtccaaaatcaggcatggtgagacatttgatgatcaccttcggttcttcgagaatctttgatcggaaatttgagtccattcctattgtcaggaaatatatctggtatggccattttccccatgtatgtttgagtgttccaactgattaatcattttgttatctaatgttgactagagttagacagtttcttgaacttgtgtaaactcagaaagcaaataaatatgatcacgttcttatctaaaaaaaaaaaaaaaa

SEQ ID NO: 1945 - DNA, 1730 bp, Triphysaria pusilla
agtacatcttcgccaacacaagttacacaacacactcactctctgggtcataaacccttcatttctgtgacaatggcggcttcaaatttcctctctcatcaaaccccaaaaacccttccttcaaaattcctacatctctttccgaacccccctttctccacaacccacattttacccttcaaaatcaaacacaattcaaaacctctatctctacgagcccttaccccaagtgctgtgctatccacatcggagcccaaaacccagaaattcgagcactgtttcgagaaatccaatgacgggtttttgtactgcgagggggttaaggtcgaagaaatcatggagggtgttgagaaaaggccgttttatttgtacagcaagccacagatcacgaggaacgtcgaggcgtataaggatgcgttggagggtttgaattcgattattggttacgcgattaaggcgaataataatctcaagattctggagcatttgcaggggttggggtgtggggctgttctggttagtgggaatgagcttaagttggctttgcgtgctgggtttgatcctaccaggtgtgtctttaatgggaatggtaaaatcgtggaggatctagtcttggctgcccaagaaggtgtatttgtgaacattgacagtgaatttgatttggaaaacattgtggctgctgcaagaattgctgggaagaaggttaatgtgttgttgcgtatcaatccagatgttgatcctcaggtacatccttatgttgctactggaaataagaactcgaaattcggaattagaaacgagaagcttcaatggtttttagatgctgtgaaagcacaccctaaagaattgaaacttgttggggcccactgtcatcttggttctactatcactaaggtagacatttttagagatgcagcttctttgatggtgaactacatagatgagattcggtcccaaggttttgagatagattatttgaatattggaggtggccttggaattgattattatcatactggagctgttcttccaactcctagagacctgatagacactgttcgtgaattggttctttcacgaaatctcaatctcataatcgaacctggaagatcacttattgccaacacttgctgctttgtcaatcatgtgactggagtaaaaaccaacgggacaaaaaacttcatcgtgatcgacggcagcatgtcagagcttattcgtccaagtttatatggagcttaccagcacatagagctcatttcaccttcggatgctgagatgtccacctttgatgtggtgggtcccgtttgtgagtctgctgatttcttgggaaaggatagggaactacccacaccatctaagggtgatggattggtagttcatgatgcgggtgcttactgcatgagcatggcttcgacatacaatctcaagatgcggccaccggaatactgggttgaagacgatggatcattatccaaaatccggcacggagagacattcgatgaccatttgagattgtttgagggtctttgatttttattgtttattagctctgtttcatcgtcaccagaactgactaggtaagaattggacgtcttgttttcgggcttcccccttttggtatttgcgtaacttgaatgttttgtcatgtaccatatttctactgcctgaaaaagagagatttttgtgttggctcaagttacaattcttatcaataaactgcattcttgttt

SEQ ID NO: 1946 - DNA, 1626 bp, Cucumis sativus
atccactgagaaaaattcttagcaatggccgccacaaacctctactctccttctccttcaccttccctttccagcaccctcaaacactctctcaactctaacccttttcaccgtattgcatttcttcctcacaaaccctttctcaaagctcccctttccctaaaagctgttctttctcaaaacccttctaaaacccagacccaatttcagcattgtttctccaaatcctcagatgggtttctttattgcgagggaattaaggtgcaggacatcatggaatctgttgataaacgccctttctatctttacagcaaaccccagataactagaaatgttgaagcttataaagaagctttggaagggctgaattcgatcattggttatgcgattaaggctaataataatttgaaagtgctggagcatttgaggaagttgggttgtggagctgtgcttgttagtggaaatgagcttcgtttggctcttcatgctggttttgaccccaccagatgtatttttaatgggaatggtaaacttttggaggatttggttctagctgcggaacaaggtgtttttgtcaatgtggatagtgagtttgacttggataatattgtagctgctgcaagaattgctagaaagaaagttaatgttttacttcgtattaatccggatgtggatcctcaggtacatccttacgttgccacgggtaataaaaattccaaatttggtattagaaatgaaaagttgcaatggtttctggatgctgttaaggcacatcctgatgaacttaagcttgttggggcccattgccatcttggttccaccatcaccaaggtggacatattcagagatgctgcagtattaatggtcaactacattgacgagatcagagatcaaggttttgaagttgattacctaaacattggaggtggacttgggatagattactatcatgctggagccattcttcctactcccagagatctcattaatacggtacgagagctggtgctttcacgaaatcttaatctaatcattgagcctgggagatcagtaattgccaatacttgctgtttggtgaatcgagtgacgggagtcaaaactaatgggactaaaaattttattgtaatcgatggaagcatggctgaactcatccgccctagtctttatgatgcttatcaacacatagagttggttgctcctacgccacctgattctgagatctcaacttttgacgtggttggccctgtctgtgagtctgcagatttcttagggaagcaaagggaactcccaactccgcccaagggggctggcttggttgtccacgatgctggtgcttactgcatgagtatggcatctacttacaatctcaagatgcgtcctccagagtactgggttgaagaagatggatcggtgtccaaaatcaggcatggtgagacatttgatgatcaccttcggttcttcgagaatctttgatcggaaatttgacaccattcctattgtcagggaatatatctggtacggtcattttccccatgtatgtgtgagtgttccaactgattaatgttgagtagagttagacagtttcttgaacttgtgtaaactcagaaagcaaataaatatgatcac

SEQ ID NO: 1947 - DNA, 1481 bp, Cucumis melo
  misc_feature (128)..(128): n is a, c, g, or t
  misc_feature (364)..(364): n is a, c, g, or t
  misc_feature (519)..(519): n is a, c, g, or t
  misc_feature (578)..(578): n is a, c, g, or t
  misc_feature (587)..(587): n is a, c, g, or t
  misc_feature (722)..(722): n is a, c, g, or t
  misc_feature (809)..(809): n is a, c, g, or t
  misc_feature (1417)..(1417): n is a, c, g, or t
atccagtaagaaatttcttagcaatggcggccacaaatctctactctccttctccttccctttccagcaccctcaaacactctctcaactcaaacccttttcaccgtattccatttcgtcttcacaanccctttctcaaaactcccctttccctaaaagctgttctttctcaaaacccttctaaaacccagacccaatttcagcattgtttctccaaatcctcagatgggtttctttattgcgagggaattaaggtgcaggacatcatggaatctgttgataaacgccctttctatctttacagcaaaccccagataactagaaatgttgaagcttataaagaagctttggaaggactgaattncatcattggttatgcgattaaggctaataataatttgaaagtgctggagcatttgaggaagttgggttgtggagctgtgcttgttagtggaaatgagcttcgtttggctcttcatgctggttttgaccccaccaaatgtatttttaatgggaatngtaaacttttggaggatttggttctagctgcggaacaaggtgtttttgtcaatgtgganagtgagttngacttggataatattgtagctgctgcaagaattgctggaaagaaagttaatgttttacttcgtattaatccggatgtggatcctcaggtacatccttacgttgccaccggtaataaaaactccaaatttggtatnaggaatgaaaagttgcaatggtttctggatgctgttaaggcacatcctgatgaacttaagcttgttggggcccattgccatcttggntccaccatcaccaaggtggacatattcagagatgctgcagtattaatggtcaactacattgacgagatcagagatcaaggttttgaagttgattacctaaacattggaggtggacttggtatagattacaatcatgctggagccattcttcctactcctagagatctcattaatacagtacgagagctggtgctttcgcgaaatcttaatctaatcattgagcctgggagatcagtgattgccaatacttgctgtttggtgaatcgagtgactggagtcaaaactaatgggactaaaaactttattgtaatcgatggaagcatggctgagcttatccgccctagtctttatgatgcttatcaacacatagagttggttgctcctacgccacctgattctgagatctcgacttttgatgtggttggccctgtctgtgagtctgcagatttcttagggaagcaaagggaactcccaactccgcccaagggggctggcttggttgtccatgatgctggtgcttactgcatgagtatggcatctacttacaatctcaagatgcgtcctccagagtactgggttgaagaagatggatcagtgtccaaaatcangcatggtgagacatttgatgatcacctttcggtcttcgagaatctttgatcggaaatttgagtc

SEQ ID NO: 1948 - DNA, 2170 bp, Quercus alba
gtcagagagaatctgatgatggggagagatgagttttgagtctaatgggttttgccttaagccgtttgacagagaaacgagagaaacgttaacggagaaattccactcacagctggtctggtcatgtgctctggacacatgtcattttaaaatccttgtccttttttagactctgtacctttttttacttttataaaagaccctaattcttttagagaccaattatcaaacagttctcaggcaatctttcttcgtcgatggcggctacaggtacacacttcctctgctactccccaacctttaccaaaaccttaaatcactctctcaaccaaaacccatttttcaaaatcccaactttatctctcaaaaccacccaaaagctgtctctttctcttaaagccatcctctcccaaaaccctgcaaaaaccctaaaccaaaacacctcatttcagcattgtttcaccaaatcctcagatgggtttctttactgtgagggccttaaggtccaggaagtcatggactctgttgagaagaggccattctatctctacagtaagccacagataactagaaactttgaggcttataaccaggctttggagggtctgagctctattattgggtatgctattaaggccaacaataacttgaagattttggaacatttgagacagcttggttgtggtgctgtgcttgtcagtggaaatgagctgaggctggcactccatgctggttttgatcccactaagtgtatttttaatgggaatggaaaacttttggaggatttggttttagccgccgaagcgggtgtctttgttaatgttgatagtgaatttgacttggagaatattgtagcagctgcaagaatagctggcaagaaggttaatgttttacttcggatcaacccagacgtggaccctcaagtccatccttatgttgccactgggaacaagaactccaaatttggtattagaaatgagaagttgcaatggttcttggatgctgtaaaggcacatcctaatgagctgaagctggtgggagctcattgccatcttgggtccaccatcaccaaggtggacatattcagggatgctgcggttcttatggtcaactacattgacgaaatccgagctcaaggttttgaagttgattacttaaatattggaggtggacttgggatagattattatcacgctggtgctatccttcccacacccagagatctaattgatactgttcgagagctggtcctttcacgaaatcttaaactcatcattgaacctgggagatcattgattgcaaatacttgttgcctggttaatcgcgttactggggtcaaaactaatggaacaaaaaactttgtggtgatcgatggaagcatggctgaacttatccgtcctagtctttatgatgcttatcaacacatagagctggtttctcctgcaccacctgatgcagagacctcaacctttgatgtggtgggccctgtctgtgagtcagcagatttcctgggaaaggatagagaacttccaactccagccaagggaactggtctggttgttcatgatgccggtgcttactgcatgagcatggcatcaacttataatcttaagatgcgcccgccagagtactgggttgaagaagatggatcggtgaccaaaatccggcatggagaaacatttggagatcatttaagattcttcgaagggctttaatcaacatcatgggttgtctgtaactatagattaagatacctgtgatttgctcttgatgcatggttgcattatttcatgctggatgttgtgaatttgaatattgaatttgcagatgcattttttgtttgcaccagcctcttatttgagaggaagattttcaatatcttgagaaagggagagtgagaactgagaagccctgataaatcaactaaataagatttcttcacatcctgcaaatttaaagttgtagtgtaaaacttgagtacatttaaaataggtgcagtatattagattctccaattagttagcaactatgtgtttgaatttaattaagaaacagaatgtacaatacctaaggaactatacttaagttttgttcaaaattatatataatttccagttgtaacagccacttgtttgttcatggctcatatatgtgggtttaatggtgcatc

SEQ ID NO: 1949 - DNA, 1935 bp, Gossypium hirsutum
acgagcggccagtatcaacgcagagtacatgggagtgaagacgaaaaacgacagtcaacaaacgcatagcattgcaatcttcatcactaatggcggctactcatcttctctctcactcctcatttcttcccaaaaccctaaaccactcattaaccaagaatccattttccaaatcccccattttgcctctcaagccctccaagaatgtcttcaagcatccctccctctccctctctctcaaagctgtcctctctcagaaccctgctaaaaccctcaacccaacttttcaacactgcttcactaaatccccagatgggtttctctactgtgaggataccaaggtccaggatgtcatggaaaaggtcgaaaagaggccgttttatttgtatagtaagcctcagattactaggaatgtggaagcttataaggaggcccttgaaggcttgaagaattccattattgggtacgccatcaaggcgaataacaatttcaagattttgcagcatttgaggatgttgggttgcggtgctgtgcttgttagtggcaatgaactcaagttggctcttcgtgccggcttcgatccaactaagtgtatctttaatgggaatgggaagatcttggaagatttggtactagctgcccaagaaggtgtttttgtcaatgtggatagtgaatttgatctggaaaatattgtagctgctgcaagaattgctggcagaaaggttaatgttttgcttcggatcaaccctgatgtagatcctcaggtccacccatatgttgctactgggaacaagaactctaaatttggtattaggaacgagaagctgcagtggtttctggatgctgtaaaggcacatcctaatgagctgaaacttgtaggggcccactgtcatcttggttcaaccattaccaaggtggatatatttagggatgctgctgttctcatggtcaactacattgatgaaattcgtgcccaaggtttcgaggttgattatttgaacattggaggtggtttgggtatagattactaccacagtggtgccgtccttcccacacctagagatctcattgacactgtcagagaattggtacattcaaggaatcttaatctcatcattgaaccaggaagatcactcattgcaaatacttgctgctttgtcaatcgtgtcactggagtcaaaactaatggaacaaaaaatttcattgtgattgatggtagtatggctgaactcatccgtcctagcctttatgatgcttatcaacatatagagttggtttctcctgctcctcctgctgctgaggtttctactttcgacgttgttggccctgtttgtgaatctgcagatttcttgggaaaggagagagaacttcccaccccagctaaggggactggcctggtcgtacatgatgcaggtgcttactgcatgagcatggcatcaacttacaatctcaagatgcgccctcccgagtactgggttgaagaagatggatcagtgaccaagattcgacatggggaaacatttgaagaccacatgcggttttttgaaggtctttaattcgatcaaggaacagtgtttgagggttgaaattggatctagaatgtaccatgtacatgaactttcattcaataaactgttgattttgttatggtctcatttttgtaagcctatttgacattgagcttgcaaccacgattgagtagatgaaacaatgccccctccccaccaccccaatggagaactatcatctcttggatagctaacaaaggatatctttttgcccgtttcatcattttctcaagctaaattgagattagggagtttaacaaattaaattttcaatctgattggtttgttggatgaattaatttgattgaaataattttaattatttaagatatgttttatatgaaaaaagaaaaaagtaccgactgcg

SEQ ID NO: 1950 - DNA, 1794 bp, Mimulus guttatus
ctactatccagttctgcagttcactcaagctcactctctcctccaacaatggcggctgctgccaatctcctctctccaaacccgacaaccctctccacaaaacccgccaaccttcattcggatctcttttccgtgacccgcgtattgcccttcaaatccaagcccatctcgagaacactaacatctctgcgggcccgtattgctccgaaggcggttatcgctacatcggagccgaagacgcagaattttcagcattgcttcacgaaatccgacgatgggtttctgtactgcgagggggttaaggttgaagaagtgatggaagctgtggagaaaaggcccttttatctgtacagcaagccgcaaattaccagaaacgtcgaggcgtacaaggaagcgctggagggtttgaattcgattatcggttacgcgattaaggcgaacaataatctgaaaatcttggagcatctgcagaaattggggtgtggagctgttcttgttagcgggaacgaggttaagttggctctccgtgctggatttgaccctaaaaggtgtgtctttaatgggaatgggaagatcttggatgatttagtcttggccgctcaagagggcgttttcgtcaatatcgacagcgagttcgatttggaaaacattgtggcagcggcaagaattgctgggaagaaggttaatgtgctattacgtatcaaccccgacgttgatcctcaggttcacccttatgttgccacggggaataaaaactcaaaattcggtatcagaaacgaaaagctgcagtggtttttagatgctgtaaaggcacaccctaaggaattgaaacttgtcggggcccattgccatcttggttctactattacaaaggtagacatatttagagacgctgctctgttgatggtgaactacatagacgagattcgttcgcaaggttttgaaatagattatttgaatattggaggcggactgggaatcgattattatcataccggagctgtacttcccactccgatggatttaatcaatactgttcgggaattggttgtttcacgaaatctcaatctagtaattgaacctggaagatcactcattgcaaacacttgctgttttgtcaatcatgtgactggagtgaaaaccaacgggacgaagaatttcattgtgattgatggtagcatgtcggaacttattcgcccgagtttatatggggcttaccagcacatagagctggtttcaccttcaccatcagatgccgagatttcgactttcgatgtggtgggtcccgtttgtgaatctgcagatttcctagggaaagacagggaattacccacacctactaagggtgctggattggtagttcacgatgccggtgcttactgcatgagcatggcatcgacatacaatctcaagatgcgcccccctgaatactgggttgaagatgatggatctttgtccaaaatccgacacggtgagacatttgacgaccatttaagattcttcgacggtctctaagttcgttctagatttaattcatcgtctcaacatcatctatcctgggtaagaatctcggatgctgattttctttttctttgcgtcctgaattctgcttgtgtattattttgctctgctgtttcagttcatattaaaaactcggctatgtgtttgatccttgtcaagaaataattgaatgtgttctacacaatatgcgtttatgtgtacacttgtgcgttttctagattccatataaattttacacacattcacatgtatacgtgtgtttgtgcatagtgc

SEQ ID NO: 1951 - DNA, 1913 bp, Citrus sinensis
cacgcgtccgctccatcttcctcaattgttcaccaatggccgccactcagctttgctctaattcagcctctctttccaaagccctaacccaaaacccatttccgaaaatccccatttcacccctcaaaaccaccttaaacttccaaagaaccctaaaacccttcactctcaaagcagtcctctcccaaaaccccgcgaaatcccagacacacacagccccagtcgagcactgcttcagcaagaaagctgacggctttctctactgtgaagatgttagagttcaggatgtcatggagacagttgaaaaaagacctttttatttgtacagtaagcctcagatcactagaaatgtggaggcttataaacaagcccttgaggggctgaattctatcattggttatgccattaaggctaataataactacaagattttggaacatttgagaaaattgggttgtggagctgttcttgttagtggcaatgagctgaggcttgctcttcgagctggatttgatcccaccaagtgtatctttaatgggaatgggaagcttttggaggatttggtgctggctgcacaagagggtgtgtttgttaatgttgatagtgagtttgacttggagaatattgttgtagcttcaagaattgctggcaagaaggttaatgtgttgcttcggattaatcctgatgtggatcctcaggtccatccttatgttgctactgggaacaagaactctaaatttggcattaggaatgagaagttgcaatggtttttggatgccgtgaaggcacatcctaatgagttgaagcttgtgggggctcattgccatcttggttccaccattaccaaggtggacatattcagggatgctgcagttcttatggtcaattacattgacaaaatccgcgcccaaggctttgaagttgattacttgaacattggaggtggtttaggaatagactattatcacactggtgctgtccttcccaaacccagaaatctgattgacaccgttagggagctggttctgtcgagaaatctgaatctcatcattgaaccagggagatcactcattgcaaatacctgctgcttggttaatcacgtcactggggttaaaactaatggaacaaaaaatttcattgtaattgatggcagcatggctgaacttatccgtccaagtctctatgatgcttatcaacacatagagctggtttctccagcacctcaagatgctgaaatttctaaatttgatgtggtgggtcctgtctgcgagtctgccgatttcctggggaaggagcgagaacttcctacccctgataggggagctggtctggttgttcatgatgcaggtgcttactgcatgagcatggcatcgacttacaatctgaagatgcgcccacctgagtactgggttgaagaagatgggtcagtgtccaaaatccggcatggagagacattcgaagaccacatgcggttctttgaaggtctttgaatgcagatacgtctttgtttgacatcccattggattcttgactacaactgcaaaaaatgaatctcaacaattcaaactctcctacctggatatcactaagcattccaaatttttgtctgatggagttgttacaatgattatactgtaatttaagttgtattgaggatgtatgttcagtgcatcacagtgatccgtaggttacccaatttaatttacttatgcctgatgccatggaactcatatcgtgcttttactcaaagttgaagccataacagctcaagtgtttgtatattgtacttcaacagttagtgattttgttcacaatcattgcgagggattaaaagtcgtagcagatatgattcggtgatacgacaatgtttagcaaatttttaaataaaatatgggaatctcattcttttaaaa

SEQ ID NO: 1952 - DNA, 1955 bp, Arabidopsis lyrata
caaaaccctgaaaatggcggcagctactcaatgtctctcccaaccttcatcatctctaaatccataccaactgaagaaccaaacctcacaactctccagaatcatccctatcttttctcttaaatccacattgaagccacttaaacgcctctccgtgaaagccaccgccgtttcccaaaactccaccaaaaccctcacgaagttcgaccactgtttcaagaaatcatcagatgggtttctctattgcgaaggaactaaagttgaggatatcatggagtcagtcgagagaagacctttttacttatatagtaaacctcagatcacgaggaacctcgaggcttataaagaagcattggaaggtgtgacatctgtcattggttacgctatcaaagctaataacaatctcaagattttggagcatttgaggtctttaagctgtggtgctgtgctcgtcagtggaaatgagctcagacttgctcttcttgctggtttcgatcccacaaagtgcattttcaatggaaatggcaagttgttggaagatttagttctagctgctcaggaaggtgttttcgttaatgtcgatagtgagtttgacttgaataacattgtggaagcttcaagaatttctggtaagcaggtcaatgtactgctgcgtatcaatcctgatgtcgatcctcaggtgcatccatatgtagctactgggaacaagaactcaaagtttggtatccggaacgagaagcttcaatggtttctggatcaggtcaaggcacatcccaaagagctgaagcttgttggagctcattgccatctaggttctaccattactaaggtggatatattcagagatgctgcagttctcatgatagaatacattgatgagatccggcgtcaaggttttgaagttagttacttgaacattggtggtggtttagggatagattattatcatgccggcgctgtccttcccacacccatggatctcatcaacacggtaagagagcttgttctttcacgagacctgaatctaataatcgagccagggagatctctgattgcaaacacttgctgtttcgtcaatcatgtaactggtgtgaagacgaatggaactaaaaacttcatagtgattgatggaagtatggctgagcttatccgtcccagtctttatgatgcttatcagcacattgagttggtctctcctccaccgcctgaagcagaggttaccaaattcgacgtagtgggtcctgtctgtgaatctgctgatttcttgggcaaagacagagagcttcccactcctccacagggagccggtctggtggttcatgacgctggtgcatactgtatgagcatggcttccacttacaatctcaagatgcgccctccggagtactgggttgaagaagatgggtcgatcagtaagataaggcatgctgagacattcgatgatcatttgcgtttctttgaaggtctatgaactctgagatttactcatcattgttggtttttatttgaattgtatgattatttggaatcagaaccataatgctattgctgttttagattttcacattctgtgctttgattcaaagtccccaatgaagtaatcatatgaataagaaaaaggtcacaagtcaagacagaaaataaaaggtgaatttgtttcttcttatttacttcaagtccaaagttgtccattgtccaaacacaataaagactcatctaagctttctttccatagctataggaagattttttcaagctttttgttcacaaatttgcttgcagaacaaaaggcgaacacgcaaccaatatcttgtcatcattaatcaagaacctaaaacaagatagttcatagttcacaggacaagtaaagtgaatttggtttattatgtagtgaattaccgtcactagtaaaattttatcatggtttattaggaagattccaaaataaacctttt

SEQ ID NO: 1953 - DNA, 1716 bp, Phaseolus coccineus
gaaatgaaaaaaacgcaacatggacgagggttttggtatgtgattttccttgtcttgtcggcaaaatcattcatcaacacagtgctatggcaggctcacaccttctttctcactcccaatcccttaccaaaacctataaccactcctttaaccagaaccctttatctcaaaagctacttctacccttcaaattcaaagccaccctcaaaccgcgtgctcttagagcggttctctcccagaacgcttctcaaaccgcggtagaggactcaaaaaaggctccttttcaacactgtttcaccaaattcgaagatgggtatctgtactgtgagggcctcaaggtacatgacatcatggaatctgttgagagaaggcctttctatctttacagcaagccccagataactaggaatgttgaagcctatagggatgcgttggatgggttgaactctgtaattggttatgccattaaggccaacaataacttgaagattctggaacatttgaggcacttgggctgtggagctgtgcttgttagtgggaatgagcttagattggctcttcgtgctggattcgatcccacaaggtgtatctttaatgggaatggtaaaatcttggaggacttggtcttggctgcccaggcaggtgtgtttgtcaacattgatagtgagtttgacttggaaaacattgtagaggctgcaaaaagggctggaaagaaggtcaatgttttacttcggattaatcctgatgtagatccacaggtccatccttatgttgccactgggaataagaactctaaatttggcattagaaatgagaagctgcaatggttcttagatgcagtgaaggagcatcctaatgagctcaaacttgttggggcccactgccatcttggttcaacaattaccaaggtagacattttcagggatgcagctaccattatgatcaactacattgatgaaattcgagctcagggttttgaagttgattatttaaatattggaggaggacttgggatagattattatcattctggtgccgtccttccttcacctagagatctcattgacactgtacgagatcttgttctttcccgtggtcttaatctcatcatcgaaccagggagatcactcattgctaacacatgttgcttagttaaccgggtaacaggtgttaaaactaatggatctaaaaacttcattgtaattgatggaagtatggcagagcttatccgccctagtctctatgatgcttaccagcatatagagttggtttcccctaccccatcaaatgctgagatagcaacctttgatgtggttggccctgtctgcgagtctgcagatttcttaggaaaaggaagagaacttcctactccagcgaagggtactggtttggtcgttcatgatgctggcgcttattgcatgagcatggcatcaacatacaatctaaagatgcggcctcctgagtattgggttgaagatgatggatcagtgagcaaaataaggcatggagagactttcgaagaccacattcggttctttgagggcctttgagctggtaatttatcctgtaggaaaggaagctcgaaaattgttgtgtattttggattttggatctttcctagtcactgaatgcattttagttgtgtttcttctattctagttcaatgctgacacttctgatatgaaaccaaaataaagttgatttcagttagatttt

SEQ ID NO: 1954 - DNA, 1619 bp, Brassica rapa
gagtgccacctcttccgtctcatctcaaacgctcacaatctcgccagccatggcgtcagctactcacctcctctcccaaccttcatcatctctccgaagaaacctaaaccaataccaatcgaaccaatctcccctctccagaatcccagtcctgtctctcaagtcaaccttgaagccacttcaacgcctctccgtcaaagccgccgcatcacccccaaactccgtcaaaaccgtgacgaaggactcaagcgatcagtccgcgttcaaccactgtttcaagaaatcatcagatgggttcctctactgcgagggaacaaaggtggaggacatcatggagagcgtggagagaagacctttttacttgtacagcaagcctcagatcacgaggaacgtcgaggcgtacaaagaggccttggaaggtgtgagctccgtcattggctacgccattaaggctaacaacaacctcaagattctggagcatttgaggagtttgggatgtggtgctgtcctcgttagtgggaatgagctaaggcttgctcttcgtgctggtttcgatcccacaaagtgtatcttcaatggaaatgggaagctgttggaggatttagttatagctgctcaagcaggtgttttcgtgaatgtggatagtgagttcgacttggataatattgtggaagcttcaagaatctccggtaaacaggtcaatgttctgctgcgtatcaatcctgatgttgatcctcaggtgcatccatatgtagctaccgggaacaagaactcgaagtttggtatcaggaacgagaagcttcagtggtttctcgacgaggtgaaggcgcatcctaatgagcttaagcttgttggtgctcattgccatctaggctctaccattacaaaggtggatatattcagagatgcggcggtacttatggtggaatacattgatgagatcaggcgtcaaggctttgaagttagctacttgaacattggtggtggcttagggatagattattaccatgccggagctattcttcctacaccaatggatctcatcaacaccgtaagagagcttgttctgtcacgtggcctgaatctaattatagagccagggaggtcgttgattgcaaacacgtgctgcttcgtcaaccatgtgaccggtgtgaagacgaatggaactaaaaactttatagtgatcgatggaagtatggctgagcttatccgtcctagtctttatgatgcttatcagcacattgagttggtctctcctccagcacctgaagcagaggtttccaaattcgatgtagtaggtcctgtttgtgaatctgctgatttcttggggaaggacagagagcttcccactcctccaaagggagctggtctggtggttcatgatgctggtgcatactgtatgagcatggcttccacttacaatctgaagatgcgtcctccagaatactgggttgaagatgatgggtccatcactaagatcaggcatgctgagacattcgaagaccatttgcgtttctttgaaggtctataaactctctgatttcctctttatcatttgtttgtcgctattttagttttactatattgattttaagaatcactattgtaatgctactgct

SEQ ID NO: 1955 - DNA, 1765 bp, Medicago truncatula
aactcttgaaaccaaacctctctatcatcatcaccatggtaggcacacacctcctctcccactcttgttccctccccaaaaccttcaatcactcattcaccaaaaacccattaccccaaaacttcattctccctctcaaatccaaatccaccaccaaacccattgttctcagagcagttctatccaaaaccccaccagaaaccaccaaaatcactaattttgaccattgtttcagcaaatccgaagatgggtatctccactgtgagaatctcaaggtggctgagattatggaatctgttgaaaaacgacctttttatctatacagtaagccacagattactagaaacgttgaagcatataaagatgcattggaaggtttaacatctattattggttatgctattaaggctaataataattacaagattttggagcatttgagaagcttgggttgtggtgctgttcttgtcagtggaaatgagcttaaactcgctcttcgtgctggatttgatcccacaaggtgtatctttaatggaaatgggaaaatcttggaggatttggttttggctgccgaagcaggcgtgtttgtcaacattgacagtgaatttgacttggaaaacattgtggcagctgcaagaattgctggaaagagggtgaatgttttgcttcggattaatcctgatgttgatccgcaggtccatccttatgttgccacagggaataagaactctaaatttggcattagaaatgagaagctgcagtggtttttagatgctgtcaaggagcaccctgttgagctaaagcttgtaggggcccactgtcatcttggatcaaccattaccaaggtagatattttcagggatgcggccactattatggtcaactacattgacgaaattcgagctcagggttttgaagttgattatttgaatatcggtggtggacttgggattgattattatcatgccggtgctgtccttcctaaacccagagatctaattgatactgtacgggagcttgttctttcccgtggtcttaaactcatcattgaaccagggagatcacttatagcaaacacctgttgcttagttagccgggtgacaggtgtcaaaaccaatggctctaaaaacttcattgtgattgatggaagtatggctgaacttatccgcccaagtctctatgatgcttatcagcatatagagctggtttctcctgccccagcaaatgccgagattacaacttttgatgtagttggccctgtttgtgagtctgcagatttcttgggaaaaggaagagaacttccaactcctgccaagggtactggtctggttgttcatgatgccggtgcttattgtatgagtatggcatctacttacaatctaaagatgcgacctcctgagtattgggttgaagatgatggatcactgagcaaaatcagacacggggagacattcgaagaccacatgcggttgtttgatggcctttgaactgataacttatctgaggcttgagatttgttgtattttgggtttggaccttttcttgctcaagaatgtgatatgttggttttgtttctttgattcagttatgtttaacacagcatttaatttcctctttctagtttcagtttagcaagtgtgagtgtttttgcagtcatcacatataatgtattgtggtgcttatggatgatggttgtatacgtttgataatgtacgatgaccaattgagtaatttagaatgtaagctcatttaataaggtttagtt

SEQ ID NO: 1956 - DNA, 1864 bp, Populus trichocarpa
tgctgcctgctactttttatctgactttcccattgacgcttcgctgtaaaaccctaaaaacaaatacttttctcttacactcgcttcacctccatcaatggcggctgctactaatttctctcactcgcccttcatttctaaaaccctaactcactctctaaaccataacccacttcccaaaaacccaactttgcctttcaaactctcaaaaagctactctctcaaggcagttatatcccagcaaaaccctgctacagccacaacacagaaaacgcagtttaagcattgttttacaaaatcccaagatggatttctctactgtgagagccttaaggttcaggagattatggagagtgttgagaagagaccattttatttgtacagtaagccacagattactagaaatgttgaggcttataaggatgctttacaaggattgagttctatcattgggtatgctattaaggctaataataacttgaagattttggagcatttgagagggttgggttgtggtgctgttttggttagtggtaacgagcttaggctggctctccgtgccggtttcgatcccacgaggtgtatttttaatggaaatgggaagctgttggatgatttggttttagctgctcaagaaggtgtttttgttaacgtggatagtgaattcgatttggaaaatattgtggctgctgctagaattgctggcaagaaggttaatgttctacttcggatcaacccagatgttgaccctcaggtccatccttatgttgctactgggaataagaactcgaaatttggtattagaaatgagaagctgcaatggtttctggatgctgtgaaggcacaccctaatgagctgaagcttgtgggggcccattgccatcttggatcaaccatcaccaaggtggacatattcagagatgctgcagctcttatggttaactacattgatgaaatccgagcccagggatttgaagttgattacttgaacattggaggtggtttgggtatagattattatcattctggtgctgtccttcctactccaagagatctcattgacactgttcgtgaactggtgctctcacgagatctcaatctcattattgaacctgggagatctctcattgcaaatacttgctgcctggtgaacagggtcactggggttaaaactaatggaacaaaaaattttgttgtgatagatggaagcatggctgaacttatccgccctagtctttatgatgcttatcaacacatagagcttgtttctcctgcgtcacccagtgcggaagtttcaacttttgatgtggttggtcctgtctgtgagtcagcagatttcctgggaaaggatagagaacttccaactcctgctaagggagctggtttggttgttcatgatgcaggtgcttactgtatgagcatggcatcgacatataatcttaagatgcgccctcctgagtactgggttgaagatgatggatcagtgtccaaaattcgacagggagagacatttgaagaccatattcggttcttcgagggtctttgattgcagactgtaaccatttctgctgaggcaattagacctaatttttgcccctatcgtgtaatctgcatatcccactctgctggttattatgtagaatccagatattcaattagcagctgcattgttgtcaaaatcgtcggtttactcgtaatatcagtaaaataatgagtttgcgagtttactaagatttgacttttgaaacctatatttttattttctatcatttgacatataattttaattctaaaataatattgtattaaaaattaaaatattattaaattagatctcagtattacttttaaagggatatttagc

SEQ ID NO: 1957 - DNA, 1681 bp, Brassica napus
tcacacttcgcacgtgttaacataattctcggacaaaaccctagtctcagcgccacctgttccgtctcatctcaaacgctcacaatctgccagccatggcgtcagctactcacctcctctcccaaccttcatcatctctccgaagaaacctaaaccaataccaatcgaaccgatcttccctctccagaatcccggttctgtctctcaagtcaaccttgaagccactgcaacgcctctccgtcaaagccgccgcttcatccccaaactctgtcaaaaccgagacgaagggatcggacgatgattccgcgttcaaccattgtttcaagaaacagtcagatgggtttctctattgcgaggggactaaagttgaggagatcatggagagcgtcgagagaagacctttttacttgtatagcaagcctcagatcactagaaacgtcgaggcttacaaagaggccttggaaggtgtgagttccgtcattggctacgctattaaggctaataacaatctcaagattttggagcatttgaggagtttgggatgtggtgctgtcctcgttagtggaaatgagctcaggcttgctcttcgtgcttgttttgatcccacaaagtgtatctttaatggaaatgggaagctgttggaggatttagttctcgctgctcaagcaggtgttttcgtgaacgttgatagtgaattcgacttggataatatagtggaagcttcaagaatatctggtaaacaggtcaatgttctcctgcgtatcaatcctgatgttgatcctcaggtgcatccatatgtagctactgggaacaagaactcgaagtttggtatcaggaacgagaagcttcagtggtttctcgatgaggtgaaggcacatcccaatgagcttaagcttgttggagctcattgccatctaggctctaccattactaaggtggatatattcagagatgctgcggtactcatggtggaatacattgatgagatcaggcgtcaaggctttgaagttagctacttgaacattggtggtggcttagggatagattattaccatgccggagctattcttcctgcaccaatggatctcatcaacaccgtgagagagcttgttctgtcacgtggactgaatctaataatagagccagggaggtcgttgattgcaaacacgtgctgtttcgtcaaccatgtgaccggtgtgaagacgaatggaactaaaaactttatagtgatcgatggaagtatggctgagctaatccgtcctagtctttatgatgcatatcagcatattgagttggtctctcctacaccacctgaagcagaggtttccaagttcgatgtagtgggtcctgtttgtgaatctgctgatttcctgggcaaagatagagagcttcctactcctccaaagggagctggtcttgtggttcatgatgctggtgcatactgtatgagcatggcttccacttacaatctcaagatgcgtcctccggaatactgggttgaagatgatgggtcgatcactaagatcaggcacgctgagacattcgaagaccatttgcgtttctttgaaggtctataaactctttgatttcctctgatcatttgcttgtcgctattttagttttactttattgattttcataatcattattgtaatgctatttgctggcttgatttttcata

SEQ ID NO: 1958 - DNA, 2194 bp, Glycine max
gataggggctaataacaattcttcttgtgcccaataggaattcccttgaccaaagagcagcctctagcctctgaagcccaaattgtcaccgtagtttagtagaaaatatgctaaattgctatatatatatataaaacacaaattagaacatgggcgagggttttgtcttgtgattatccttgcaacacacattgtcttgtcggcaaaatcttccaccaacaacacacagccatggcaggctcaaacattctttctcactctccttcccttcccaaaacctacagccactccttaaaccaaaacgcgttatcccaaaagcttttttttctgcccctcaaattcaaagccaccacaaaaccacgtgctctcagagcggttctctcgcagaacgctgtcaaaacctcggtggaggacacaaagaacgctcattttcagcactgtttcaccaaatccgaagatgggtatctgtactgtgagggcctcaaggtgcatgacatcatggaatctgttgagagaagacctttctatttgtacagcaagccccagataactaggaatgttgaagcctacaaggatgcattggaagggttgaactccataattggttatgccattaaggccaataataacttgaagattttggaacatttgaggcacttgggttgtggtgctgtgcttgttagtgggaatgagctgaagttggctcttcgagctggctttgatcccacaaggtgtatctttaatgggaatgggaaaatcttggaggatttggtcttggctgctcaggaaggtgtgtttgtcaacattgatagtgagtttgacttggaaaacattgtagaggctgcaaaaagggctgggaagaaggtcaatgttttacttcggattaatcctgatgtggatccacaggttcatccttatgttgccactgggaataagaactctaaatttggcattagaaatgagaagctgcagtgctttttagatgcagtgaaggaacatcctaatgagctcaaacttgtaggggcccactgccatcttggttcaacaattaccaaggttgacattttcagggatgcagccaccattatgatcaactacattgaccaaatccgagatcagggttttgaagttgattacttaaatattggtggaggacttgggatagattattatcattctggtgccatccttcctacacctagagatctcattgacactgtacgagatcttgttatttcacgtggtcttaatctcatcattgaaccaggaagatcactcattgcaaacacgtgttgcttagttaaccgggtgacaggtgttaaaactaatggatctaaaaacttcattgtaattgatggaagtatggctgaacttatccgccctagtctttatgatgcttaccagcatatagagctggtttcccctgccccgtcaaatgctgaaacagaaacttttgatgtggttggccctgtctgtgagtctgcagatttcttaggaaaaggaagagaacttcctactccagccaagggtactggtttggttgttcatgatgctggtgcttattgcatgagcatggcatcaacctacaatctaaagatgcggcctcctgagtattgggttgaagatgatggatcagtgagcaaaataagacatggagagacttttgaagaccacattcggttttttgaggggctttgagctaataatttatcttgtaggaaagaaggctggagaattgttatgtacttggagtttgaatctttcctcgtcaatgaatgcatgactcttgtagttctgtttcttccgttctaattgaatgttgactcccatgacaggaacagagaataaagttgatttcagttagattttacactgcattcaattgcctccttccaatgtcaatttaataaaagcgcaaatatgttatttattacagctatcaattgaattgtggagcataccttatgtatggtggttgtatatatttgagtcttactgtgtattgtactaattgcttcctatttagacctattgaccatttagatgcatgttggctttcaaattgagttcttggggtagcatcttaaagtcttaaattttacttacatgtacgtgtagacttgctggctctttctgcatctgtagtattgcttgaatctaagactttaacatgaacctttatattcaaaagggc

SEQ ID NO: 1959 - DNA, 1639 bp, Glycine max
atgggcgagggttttgtcttgtgattatccttgcaacacacattgtcttgtcggcaaaatcttccaccaacaacacacagccatggcaggctcaaacattctttctcactctccttcccttcccaaaacctacagccactccttaaaccaaaacgcgttatcccaaaagcttttttttctgcccctcaaattcaaagccaccacaaaaccacgtgctctcagagcggttctctcgcagaacgctgtcaaaacctcggtggaggacacaaagaacgctcattttcagcactgtttcaccaaatccgaagatgggtatctgtactgtgagggcctcaaggtgcatgacatcatggaatctgttgagagaagacctttctatttgtacagcaagccccagataactaggaatgttgaagcctacaaggatgcattggaagggttgaactccataattggttatgccattaaggccaataataacttgaagattttggaacatttgaggcacttgggttgtggtgctgtgcttgttagtgggaatgagctgaagttggctcttcgagctggctttgatcccacaaggtgtatctttaatgggaatgggaaaatcttggaggatttggtcttggctgctcaggaaggtgtgtttgtcaacattgatagtgagtttgacttggaaaacattgtagaggctgcaaaaagggctgggaagaaggtcaatgttttacttcggattaatcctgatgtggatccacaggttcatccttatgttgccactgggaataagaactctaaatttggcattagaaatgagaagctgcagtgctttttagatgcagtgaaggaacatcctaatgagctcaaacttgtaggggcccactgccatcttggttcaacaattaccaaggttgacattttcagggatgcagccaccattatgatcaactacattgaccaaatccgagatcagggttttgaagttgattacttaaatattggtggaggacttgggatagattattatcattctggtgccatccttcctacacctagagatctcattgacactgtacgagatcttgttatttcacgtggtcttaatctcatcattgaaccaggaagatcactcattgcaaacacgtgttgcttagttaaccgggtgacaggtgttaaaactaatggatctaaaaacttcattgtaattgatggaagtatggctgaacttatccgccctagtctttatgatgcttaccagcatatagagctggtttcccctgccccgtcaaatgctgaaacagaaacttttgatgtggttggccctgtctgtgagtctgcagatttcttaggaaaaggaagagaacttcctactccagccaagggtactggtttggttgttcatgatgctggtgcttattgcatgagcatggcatcaacctacaatctaaagatgcggcctcctgagtattgggttgaagatgatggatcagtgagcaaaataagacatggagagacttttgaagaccacattcggttttttgaggggctttgagctaataatttatcttgtaggaaagaaggctggagaattgttatgtacttggagtttgaatctttcctcgtcaatgaatgcatgactctt

SEQ ID NO: 1960 - DNA, 1830 bp, Gossypium hirsutum
gtggcactagcagtcaacaaacgcacacgctgctgcattttcatcatcaatggcggcgactactcaccaccatctctctcacgcctcatctcttcccaaaaccctaaaccatcctttgaagcaaaacccattttcccaactccccgttttgcccctcagggcctccaagaatctctttaggcgccaatctctctccctcaaagctgtgctctcccagaaccctgctaaaaccctcaaccccacttttcaacactgcttcacgaaatcccttgatgggttcctctactgtgaggataccaaggttcaggacatcatggagaaagtcgaaaagaggcccttttatttgtacagtaagcctcagattactaggaatgtggaagcttataaggaggctcttgaaggcttgaagaattccatcattgggtacgccatcaaggcgaataataatttgaagattttgcagcacttgaggaagttaggttgtggtgctgtgcttgttagtggcaatgaactcaagttggctcttcatgccggctttgatcctactaagtgtatatttaatggaaatgggaagatcttggaggatttgatcctagctgctcaagaaggtgtttttgtgaatgtggatagtgaatttgatctggagaatattgttacagctgcaaaagttgctggcaggaaggttaatgtgttgcttcggatcaacccggacgtggatccacaggtccatccatatgtcgctactgggaacaagaactctaaatttggtattaggaatgagaagctgcagtggtttctggatgctgtaaaggcacaccctaatgagctaaagcttgttggggcccattgtcatcttggttcaaccattaccaaggtggatatattcagggacgctgctgttctcatggtcaactacattgatgaaatccgtgcccaaggtttcgaggtagattatttaaacattggaggtggtttggggatagattactaccatagtggtgccgtccttcccacaccgagagatctcattgacactgtcagagaattggtcctctcaagaaaccttaaccttgtcattgaaccagggagatcactcattgcaaacacttgctgcttagtgaatcgtgtcactggagtcaaaactaatggaacaaaaaatttcattgtcattgatggcagtatggctgaacttatccgtcctagtctttatgacgcttaccaacacatagaactggtttctcctacacctcctgatgcagaggtctctacctttgatgttgtcggtcctgtctgtgaatctgcagatttcttgggaaaagagagagaacttccaaccccagctaaggggaccggcctggtggtgcatgatgcaggtgcttactgcatgagcatggcatcaacatacaatctcaaaatgcgccctcctgagtactgggtcgaagaagatggatctgtgaccagaatccggcatggggagacatttgaagaccacattcgttttttcgagggtctgtgatttgaacaaaacaagtgtccattttgaggcttgaaattggatattgtttttgcaaaattcatggatttatgtggtgtacttgaagtttcatttaacaagctgctgaattgggtatgatttcttttttataactttgaattggaattaatgtaatggcaatttcagcatctaaaagggtatgaacaagatttagaatacatcccaaaactatgatgccatatgggcatacaatcttcttatctgaataactcagcatgaagaataatactctacttttttacatcactcgaataaaaggtgggttcttgtactat

SEQ ID NO: 1961 - DNA, 1944 bp, Gossypium hirsutum
acattctgaaatggaccgatgaagaggatgaatagcccaatcctggatctgattctgaacttattattaaattaaactgcttcctacaaaacacaaattgaaaatcctttttctgtggcactagcagtcaacaaacgcacacgctgctgcattttcatcatcaatggcggcgactactcaccaccatctctctcacgcctcatctcttcccaaaaccctaaaccatcctttgaagcaaaacccattttcccaactccccgttttgcccctcagggcctccaagaatctctttaggcgccaatctctctccctcaaagctgtgctctcccagaaccctgctaaaaccctcaaccccacttttcaacactgcttcacgaaatcccctgatgggttcctctactgtgaggataccaaggttcaggacatcatggagaaagtcgaaaagaggcccttttatttgtacagtaagcctcagattactaggaatgtggaagcttataaggaggctcttgaaggcttgaagaattccatcattggttacgccatcaaggcgaataataatttgaagattttgcagcatttgaggaagttaggttgtggtgctgtgcttgttagtggcaatgaactcaagttggctcttcatgccggctttgatcctactaagtgtatatttaatggaaatgggaagatcttggaggatttgatcctagctgcccaagaaggtgtttttgtgaatgtggatagtgaatttgatctggagaatattgttacagctgcaaaagttgctggcaggaaggttaatgtgttgcttcggatcaacccggacgtggatccacaggtccatccatatgtcgctactgggaacaagaactctaaatttggtattaggaatgagaagctgcagtggtttctggatgctgtaaaggcacaccctaatgagctaaagcttgttggggcccattgtcatcttggttcaaccattaccaaggtggatatattcagggacgctgctgttctcatggtcaactacattgatgaaatccgtgcccaaggtttcgaggtagattatttaaacattggaggtggtttggggatagattactaccatagtggtgccgtccttcccacaccgagagatctcattgacactgtcagagaattggtcctctcaagaaaccttaaccttgtcattgaaccagggagatcactcattgcaaacacttgctgcttagtgaatcgtgtcactggagtcaaaactaatggaacaaaaaatttcattgtcattgatggcagtatggctgaacttatccgtcctagtctttatgacgcttaccaacacatagaactggtttctcctacacctcctgatgcagaggtctctacctttgatgttgtcggtcctgtctgtgaatctgcagatttcttgggaaaagagagagaacttccaaccccagctaaggggaccggcctggtggtgcatgatgcaggtgcttactgcatgagcatggcatcaacatacaatctcaaaatgcgccctcctgagtactgggtcgaagaagatggatctgtgaccagaatccggcatggggagacatttgaagaccacattcgttttttcgagggtctgtgatttgaacaaaacaagtgtccattttgaggcttgaaattggatattgtttttgcaaaattcatggatttatgtgatgtacttgaagtttcatttaacaagctgctgaattgggtatgatttcttttttataactttgaattggaattaatgtaatggcaatttcagcatctaaaagggtatgaacaagatttagaatacatcccaaaactatgatgccatatgggcatacaatcttcttatctgaataactcagcatgaagaataatactctacttttttacatcactcgaataaaaggtgggttcttgtactat

SEQ ID NO: 1962 - DNA, 2060 bp, Arabidopsis thaliana
atgggccagaccaattcagagacccaacaagctcgactgtatacacaaaattcacaaaaacagcttttgagaagttttcttcttcttcaccttattttcgggtatcaaagccacaaaaccctgagaatggcggcagctactcaatttctctcccaaccttcgtctctcaatccacaccaactgaagaaccaaacctcacaacgctccagaagcatccctgtcttgtctcttaaatccacattgaagccacttaaacgcctctccgtgaaagccgccgtcgtttctcaaaactcgtccaaaaccgtgacgaagttcgatcactgtttcaagaaatcatcagatgggtttctctattgtgaaggaactaaagttgaggatatcatggagtcagtggagagaagacccttttacttatatagcaaacctcagatcactagaaacctcgaggcttataaagaagcattggaaggagtgagctctgtgattggttacgctatcaaagctaataacaatcttaaaattttggagcatttgagaagtttaggctgtggtgctgtgctcgttagtggaaatgagcttagacttgctcttcgtgctggtttcgatcccacaaagtgcattttcaatggaaatggcaagtctttggaagatttagttctagctgctcaagaaggtgttttcgttaatgtcgatagtgagtttgacttgaataacattgtggaagcttcaagaatttctggtaagcaggtcaatgtactgctgcgtatcaatcctgatgttgatcctcaggtgcatccatatgttgctactgggaacaagaactcaaagtttggtatcaggaacgagaagcttcaatggtttctggatcaggtcaaggcacatcccaaagagctgaagcttgttggagctcattgccatctaggctctaccattactaaggtggatatattcagagatgcggcagttctcatgatagaatacattgacgagatccggcgtcaaggttttgaagttagttacttgaacattggtggtggtttagggattgattattaccatgccggcgctgtccttcccacacccatggatctcatcaacactgtaagagagcttgttctttcacgagacctgaatctaataatcgagccagggagatctctgattgcaaacacttgctgtttcgtcaaccatgtaactggtgtgaagacgaatggaactaagaacttcatagtcattgatggaagtatggctgagcttatccgtcccagtctttatgatgcttatcagcacattgagttggtctctcctccaccggctgaagcagaggttaccaaattcgacgtagtgggtcctgtctgtgaatctgctgatttcctgggcaaagacagagagcttcccactcctccacagggagctggtctggtggttcatgacgctggtgcatactgtatgagcatggcttccacttacaatctcaagatgcgtcctccggaatactgggttgaagaagatgggtcgatcactaagataaggcatgctgagacattcgatgaccatttgcgtttctttgaaggtctatgaactcttagatttactcatcattgttgcttttttgattgaattgtatgattattcggaatcaggaccataatgatattgctgttttagattttcacattatgtgctttgattcaaagtcaatgaagtgatcatatgaataagaaaacgttcacaagtcaagacagaaaataagaggtgattctgattataagaggagtctttcaagccaaagtcgtccattgtccaaacacataaacactcatctaagcttcttcccatagctataagaagattctttcaagctttttgttcacaagtttgcttgcagaactaaatgaatcaataactacaactactatgtcattaatcaagaaactaaaagaagatagttcatagttcacaggacaagtaaagtgaatttggtttatcatgtagtgacttaccgccacaagtctaatttcatcatgggttataaggaagattccaaaataaacctttta

SEQ ID NO: 1963 - DNA, 1980 bp, Arabidopsis thaliana
tcttcttcaccttattttcgggtatcaaagccacaaaaccctgagaatggcggcagctactcaatttctctcccaaccttcgtctctcaatccacaccaactgaagaaccaaacctcacaacgctccagaagcatccctgtcttgtctcttaaatccacattgaagccacttaaacgcctctccgtgaaagccgccgtcgtttctcaaaactcgtccaaaaccgtgacgaagttcgatcactgtttcaagaaatcatcagatgggtttctctattgtgaaggaactaaagttgaggatatcatggagtcagtggagagaagacccttttacttatatagcaaacctcagatcactagaaacctcgaggcttataaagaagcattggaaggagtgagctctgtgattggttacgctatcaaagctaataacaatcttaaaattttggagcatttgagaagtttaggctgtggtgctgtgctcgttagtggaaatgagcttagacttgctcttcgtgctggtttcgatcccacaaagtgcattttcaatggaaatggcaagtctttggaagatttagttctagctgctcaagaaggtgttttcgttaatgtcgatagtgagtttgacttgaataacattgtggaagcttcaagaatttctggtaagcaggtcaatgtactgctgcgtatcaatcctgatgttgatcctcaggtgcatccatatgttgctactgggaacaagaactcaaagtttggtatcaggaacgagaagcttcaatggtttctggatcaggtcaaggcacatcccaaagagctgaagcttgttggagctcattgccatctaggctctaccattactaaggtggatatattcagagatgcggcagttctcatgatagaatacattgacgagatccggcgtcaaggttttgaagttagttacttgaacattggtggtggtttagggattgattattaccatgccggcgctgtccttcccacacccatggatctcatcaacactgtaagagagcttgttctttcacgagacctgaatctaataatcgagccagggagatctctgattgcaaacacttgctgtttcgtcaaccatgtaactggtgtgaagacgaatggaactaagaacttcatagtcattgatggaagtatggctgagcttatccgtcccagtctttatgatgcttatcagcacattgagttggtctctcctccaccggctgaagcagaggttaccaaattcgacgtagtgggtcctgtctgtgaatctgctgatttcctgggcaaagacagagagcttcccactcctccacagggagctggtctggtggttcatgacgctggtgcatactgtatgagcatggcttccacttacaatctcaagatgcgtcctccggaatactgggttgaagaagatgggtcgatcactaagataaggcatgctgagacattcgatgaccatttgcgtttctttgaaggtctatgaactcttagatttactcatcattgttgcttttttgattgaattgtatgattattcggaatcaggaccataatgatattgctgttttagattttcacattatgtgctttgattcaaagtcaatgaagtgatcatatgaataagaaaacgttcacaagtcaagacagaaaataagaggtgattctgattataagaggagtctttcaagccaaagtcgtccattgtccaaacacataaacactcatctaagcttcttcccatagctataagaagattctttcaagctttttgttcacaagtttgcttgcagaactaaatgaatcaataactacaactactatgtcattaatcaagaaactaaaagaagatagttcatagttcacaggacaagtaaagtgaatttggtttatcatgtagtgacttaccgccacaagtctaatttcatcatgggttataaggaagattccaaaataaacctttta

SEQ ID NO: 1964 - DNA, 1871 bp, Tropaeolum majus
aaaagtcaacagctttccttcctcctctcagtcatggccgccactgctcacactctgtcaccagccccatcgctctcaagaaccctaaatcgcccgtcaacccgaactctattctcccaagtctccattttgccgcgaaacttatcgaaacgaaaacccctctcgattaaagcagtcatttctcaaacccctgccaaaaccccagctcaaccacaagaaggaacgaactcattcaatcactgtttctcgaaatcgaatgatggatttctgtactgtgagggagtcaaggttcaagaggtcatggaaaatgttgagaagcgacctttttacttatacagcaaaccgcagattaccagaaacgttgaggcgtataaggacgccctagaggggttgtcatcggtcattgggtacgcgattaaagctaacaataacctcaaaattttgcaacatctgagaggattgggatgtggagctgtgctagtgagtggaaatgaactacgacttgcaatcagtgctggattcgaccctgcaaaatgcatctttaatgggaatggaaagctattggaagatttggtgttagctgcccaggaaggtgtttttgttaatgttgatagtgagtttgacttggataatattgtggccgcttccaagattgctggcaagagggttagtgtattacttcggatcaatccagatgtggatcctcaggtccatccttatgttgctaccgggaacaagaactctaaatttggtattagaaatgagaagcttcaatggtttttggatgctgttaaggcacatcccaatgaactgaagcttgtaggagcccattgtcatcttggttcaaccatcacgaaggtggacatatttagggatgctgctgctcttatggtaaactacattgatgagattcgagctcagggttttgtagttaattatttgaacattggaggtggattagggattgattatcaccatgccggtgcggtgcttcctacaccaagagatctcatcgacactgtaagggagactgttctttcgagggaccttaatctcataatcgaaccaggaagatcacttattgcaaacacttgctgttttgtcaatcgtgtcactggggttaaaaccaatggaaccaaaaacttcattgtcattgatggcagcatggctgaacttatccgacccagtctctacgatgcctaccaacacatagaactggtttctcccgtaacacctggtgctgaaataacgaaattcgatgtcgtgggtcctgtctgcgagtctgcagatttcttagggaaagagagagaacttccaactccagatcagggaactggtcttgttgtccatgacgcgggtgcgtactgcatgagcatggcatcaacatacaatctcaagatgcgaccacccgagtactgggtcgaagaagatggaggtttggccaaaatccgacatggtgagacatttgaagaccatctacgattctttgagggtctttgatttgattgcaagctgaactttacaattggacgatgattactatggttctgtctgaattattgtgtttttatttggactttgtaagctcgttgttgaagttgtgaatgttgtatgtttcaatgtgattcgtcttgtgcgaaataaaatgagtcatagaactccacgccattgaacgaagttaaatgtacgtttggattttaaaccagtctctattccggacctttttgacttatttctttgggattaatctcccccacgaacgttgacatggcaaaagtgaagattggacgggtttaactgactcgggtaaaaaagatatattttcagatgtaaatactcgaagttgacgaattttagttaaacctattaat

SEQ ID NO: 1965 - DNA, 1709 bp, Glycine max
ggacgagggttttgacttgtgattttccttcaacacagtcggcaaaatctttcaccaccaacacacagccatggcaggctctcaccttctttctcactcaccctcccttcccaaaacctataactactccttaaaccaaaaccctttatcccaaaatcttttttttccacccctcaaattcaaaagcaccacaaaaccgcgtgttctcagagctgttctctcccaaaacgctgcaaaaaccgcggtagaggacacaaagaacgctcattttcagcattgtttcaccaaatccgaagatgggtatctgtactgtgagggcctcaaggtgcatgacatcatggaatctgttgagagaagacctttctatttgtacagcaagccccagataactaggaacgttgaagcctataaggatgcattggaagggttgagttctataattggttatgccattaaggctaacaacaatttgaagattttggaacatttgaggcacttgggttgtggtgctgtgcttgttagtgggaatgagcttaggttggctcttcgtgctggctttgatcccacgaggtgtatctttaatgggaatgggaaaatcttggaggatttggtcttggctgcccaagaaggtgtgtttgtcaacattgatagtgagtttgacttggaaaacattacagaggctgcaaaaagggctggaaagaaggtcaatgttttacttcggattaaccctgatgtggatccacaggttcatccttatgttgccactgggaataagaactctaaatttggcattagaaatgaaaagctgcagtggtttttagatgcagtgaaggagcttcctaatgagctcaaacttgtaggggcccactgtcatcttggttcaacaattaccaaggtagacattttcagggatgcagccaccattatgatcaactacattgaccaaatccgagatcagggttttgaagttgattacttaaatattggtggaggacttgggatagattattatcattctggtgccattcttcctacacctagagatctcattgacactgtacgagatcttgttatttcgcgtggtcttaatctcatcattgaaccagggagatctctgatcgcaaacacatgctgcttagttaaccgggtgacaggtgttaaaagtaatggatctaaaaattttattgttattgatggaagtatggctgaactgatccgccctagtctctatgatgcttaccagcatatagagctggtttcccctgccccatcaaatgctgagacaacaacttttgatgtggttggccctgtctgtgagtctgcagatttcttaggaaaaggaagagaactacctactccagccaagggtactggtttggttgttcatgatgctggtgcttattgcatgagcatggcatcaacctacaatcttaagatgcggcctcctgagtattgggttgaagatgatggatcagtgagcaaaataaggcatggagagacttttgaagatcacattcggttttttgaggggctttgatgatttattttgtaagaaagaagggtggagaattattgtgtatttggagtttgaatctttccttgtcaatgaatgcatgactcttagctctgtttcttccgttctaattgaatgttgacactcttgataggaacagagaataaagttgatttcagtttagtttttacactgc

SEQ ID NO: 1966 - DNA, 1765 bp, Glycine max
ggacgagggttttgacttgtgattttccttcaacacagtcggcaaaatctttcaccaccaacacacagccatggcaggctctcaccttctttctcactcaccctcccttcccaaaacctataactactccttaaaccaaaaccctttatcccaaaatcttttttttccacccctcaaattcaaaagcaccacaaaaccgcgtgttctcagagctgttctctcccaaaacgctgcaaaaaccgcggtagaggacacaaagaacgctcattttcagcattgtttcaccaaatccgaagatgggtatctgtactgtgagggcctcaaggtgcatgacatcatggaatctgttgagagaagacctttctatttgtacagcaagccccagataactaggaacgttgaagcctataaggatgcattggaagggttgagttctataattggttatgccattaaggctaacaacaatttgaagattttggaacatttgaggcacttgggttgtggtgctgtgcttgttagtgggaatgagcttaggttggctcttcgtgctggctttgatcccacgaggtgtatctttaatgggaatgggaaaatcttggaggatttggtcttggctgcccaagaaggtgtgtttgtcaacattgatagtgagtttgacttggaaaacattacagaggctgcaaaaagggctggaaagaaggtcaatgttttacttcggattaaccctgatgtggatccacaggttcatccttatgttgccactgggaataagaactctaaatttggcattagaaatgaaaagctgcagtggtttttagatgcagtgaaggagcttcctaatgagctcaaacttgtaggggcccactgtcatcttggttcaacaattaccaaggtagacattttcagggatgcagccaccattatgatcaactacattgaccaaatccgagatcagggttttgaagttgattacttaaatattggtggaggacttgggatagattattatcattctggtgccattcttcctacacctagagatctcattgacactgtacgagatcttgttatttcgcgtggtcttaatctcatcattgaaccagggagatctctgatcgcaaacacatgctgcttagttaaccgggtgacaggtgttaaaagtaatggatctaaaaattttattgttattgatggaagtatggctgaactgatccgccctagtctctatgatgcttaccagcatatagagctggtttcccctgccccatcaaatgctgagacaacaacttttgatgtggttggccctgtctgtgagtctgcagatttcttaggaaaaggaagagaactacctactccagccaagggtactggtttggttgttcatgatgctggtgcttattgcatgagcatggcatcaacctacaatcttaagatgcggcctcctgagtattgggttgaagatgatggatcagtgagcaaaataaggcatggagagacttttgaagatcacattcggttttttgaggggctttgatgatttattttgtaagaaagaagggtggagaattattgtgtatttggagtttgaatctttccttgtcaatgaatgcatgactcttagctctgtttcttccgttctaattgaatgttgacactcttgataggaacagagaataaagttgatttcagtttagtttttacactgcatttaattgcctcattccaagttcaatttaatcaaagcgcgaatatatttacattg

SEQ ID NO: 1967 - DNA, 1740 bp, Ricinus communis
gtttttagtcttaataacactccagtgtacagtacctttaaaccctcaaaatcttctgtctttacactttctggttcatcaatggcggcgactacaacccatcttgctcatccacctactctctcgaagaacatcacttttcatcatttaaagcaaaacccatttcttaaaacttcgactttacccgtcaaattcactagaacctctccaaagcccctctctcttactcttaaagcggttttatcacaaaacccaactctaactcaagaaactgctcaattcaagcattgtttcactaaatcaaatgatgggtttctctactgtgagaatcttaaggttcaggatgtcatggagagtgttgagaaaagacctttttatttgtatagtaagccacagattactagaaatgtggaggcttataagagtgctttagagggattaaattctattattggttatgcaattaaggctaataataatttcaagattttggaacacctgagacagttgggttgtggagctgtgcttgttagtggtaatgagcttaggttggctcttcgtgctggatatgatcccaaaaagtgtatttttaatggaaacgggaagctcttggaggacctggttttagctgctgaggaaggtgtttttgttaatgtagatagtgaatttgatttagagaatattgtagcagcttctagaattgctggagaaaagattaatgttttactccggatcaatccagatgtggatcctcaggtccatccttatgttgccactggtaacaagaactctaaatttggcattagaaatgagaagctgcaatggtttctggatgctgttaaggcacaccctaatgagcttaagcttgtgggagcccattgccatcttggttctaccattaccaaggtggacatattcagagatgctgcagttcttatggtcaactacattgatgaaattcgagctcaaggctttgaaattgattatctaaacattggcggtggtttgggtatagattattatcatgctggcgctgtccttcctactccgagagatctcatcgacactgttcgagaactggtgctctcacggaatctcaatctcatcattgaaccagggagatcattaattgcaaatacctgctgcctggtcaacagggtcactggagtgaaaactaatgggactaaaaactttattgtgatcgatggtagcatggctgaacttattcgtccaagtctttatgatgcatatcaacacatagaacttgtttctcctgcacaacctattgtcgaagtatcaacttttgatgtggtgggtcctgtctgtgaatctgctgatttcttaggaaagggtagagaacttccaaccccatctaagggagctggtttggttgttcatgatgctggagcttactgcatgagtatggcatcaacatacaatttgaagatgcgccctcctgagtactggattgaagaagatggttctgtaaccaaaatacggcacggggagacattcgaagaccatatgcggttctttgagggtctttgaacgcaaaaacttttagccatttctgccggagcacgcaggcttcagttgtgttcttatttttgacatacccaactatgccggttacattgtggttctatattttgtatcaccattttgctagatgctgttaaaacataatactcattatcagtgtcgaaactttcagatgtcattattatatcgttagcatgt

SEQ ID NO: 1968 - DNA, 1994 bp, Eucalyptus grandis
ttccatctccgataatggcggccgccgcgacctcccacctcctctccagccccgcctgccgccgccaccgccgcacactaacgaaccaccggctctcccaaaacccagttgccagaatacccgtcgcgcccctcaaagccgccgccgctggacccctgaagcgccttctgctgcgagccgccgtctcccagaacccggccgtggaccaacaggcgacggcgttcaagcactgcttctccaagtcccgggatgggttcctctactgcgaggacgtcaaggtcgaggacgtcatggagagcgtggagaggaggcccttctacctgtacagcaagaggcagatcacgaggaatgtggaggcttatagggaggcgttggaggggttggagggcgcggtcatcgggtacgccatcaaggcgaacaataatttgaagattttggagcatttgagagggttgggttgcggggcggtgttggtcagcgggaatgagctgagattggcacttcgtgctgggttcgatcccaccagatgcatttttaatggaaacgggaaactcttggaagatttggttctagcagcacaagcaggtgtctttgtcaatgttgacagcgaatttgacttggagaacatagttgctgctgcaaggatagcaggcaagaaggttaatgtcctacttcgtattaatccagacgtggatcctcaggtccatccatatgttgccacgggaaacaagaactctaagtttggaattaggaatgagaagctgcagtggtttcttgatgctgtaaaatcacatccaaatgagctgaagcttgtgggtgcccactgccatcttggttccacaattaccaaggttgacatattcagagatgctgcagttctcatggtaaattatatcgacctgattcgtgagcaaggatttgaggttaattatttgaatattggaggtggtcttggaatagattattaccacactggtgctgtccttcctatgcccagagatctcattgacacagtccgtgaactggtcctttcacggaatcttaagctcattattgaaccaggacgatcgctaattgcaaatacttgctgtttggtgaatcgtgtaactggagttaaaacgaatggaactaagaatttcattgttattgatggtagcatggcggaacttatccgtccgagtctttatgatgcatatcagcacatagagttgatctctcctaccccacctgatgctgatacttcgaccttcgatgtggtgggtcctgtgtgcgagtctgcagatttcttggggaaggacagagaacttccaacacccgctaagggagcgggcctcgttgtccatgatgcaggtgcatactgcatgagtatggcctcgacttacaatctcaagatgcggccccctgagtactgggttgaagaggacgggtcgatccgcaaaatccgtcatgcagagacttttgaagaccatttgcggttctttgagggcctgtgaacacgaacgctataaaaccgcacttcatggaggataggcaatttctttttgtagattgtcttttttcctagtctaaattctgctgttgcttctttgtaggttgtgtatttccttctcattttcttggaggttttagggatcgattcttgatacttaaaggaagaccatttgttccatctatcaatttaaatgttttcgggagggcactgatgaaactaagttaagctgctcgcaaggaatcgaaatttaattcgatgattactcgagatcggtctgcacatacttaaataaactcaagagtaaccaactcgcaagcctaattgagctcttaagtaattttttgtaattatttaatagtcataagataagaaaaagcctctaaatttacatgatacatacatgataattgatctctctttttttccaagatcaatctgctaatctaatgtaattcgatcgagtcaagtttgattgtctagaacttatgttgggagaattatt

SEQ ID NO: 1969 - DNA, 1626 bp, Prunus persica
tcaatggcggctacgcagctccctttccaaacctcatcatcatccttctccaaacccctaaggcactctttaacccgaaacccattttcccaaaaccccattctacccctcagacccgcctcccttaaacccctggttctcagagccgtcgtctcccaaaacccgtcaaaatccctcacccaagaccctcaaacgaccccctttaagcactgcttctccaaatcctcagatgggtttctctattgtgagggcctcaaggtacaggaggtcatcgattcggttgagaggcggcctttctacctctacagcaagccacagatcactagaaacgtcgaggcctataaggaggcattggaggggttgagttctgttattgggtatgcgattaaagccaacaacaattacaagatattggagcatctgagacagttgggttgtggtgctgttctggttagtgggaatgagctcaggttggctcttcgagctgggtttgatcccactaagtgcatttttaatgggaatggaaagttgttggaggacttggttttggctgcccaagaaggtgtttttatcaatgttgatagtgagtttgacttggaaaatattgttgctgctgcaagaattgctggaaagagggtcaatgttctacttcggattaatccagacgtagaccctcaggttcatccttatgttgccactgggaacaagaactccaaattcggtattagaaatgagaagctgcaatggtttttggatgctgtgaaggcacatccgaatgagctaaaacttgttggcgcccattgtcatcttggatccactattaccaaggtggatatatttcgggatgctgctgttcttatggttaagtacattgacgaaatccggtctcaaggttttcaagttgattacttaaatatcggtgggggacttgggatagattactatcatgctggtgccgtacttccgacacccagagatcttattgatactgttcgcgacgtggtccaatcacagggtctaaatcttatcattgaacctgggagatcacttattgcaaattcttgctgcttggtcaaccgagtaacaggtgtcaaaacaaatggcaccaaaaactttatcgtgatcgatggaagcatggctgaactcattcgccccagtctgtatgatgcttatcaacatatagagctggtttctcctgcttcacctgatgctgagatttctacttttgatgtggttggccctgtttgtgagtctgcggatttcttagggaaggatagagaacttccaactccacccaagggagctggtctggttgttcatgatgcaggcgcttactgcatgagcatggcttcaacttacaatcttaaaatgcgacctccagaatattgggttgaagaagatggatcagtggccaagatccgacatgcagagacatttgaagatcatatgcgattctttgacggtctttgattgcgctattctttgatggtctttgattgcgctaccttgattagttagagccagttaaaagtggccagaatttttctgttatgttgtttgttgtaacattggaacctttgtatttggatatgaagttagctctttaatatgaagttgtaccacctc

SEQ ID NO: 1970 - DNA, 1800 bp, Populus trichocarpa
cctaaaaacacaaactcttttccgacactcacttctccatcaatggcgactgctacagatctctctcagtcacgcttcatttccaaaaccctaactcactccctaaatcaaaacctattttccaaaaaatcaattttgccctttaaactaacaaaaaaaaactatctcaaacccctttctctcaaggcagttatttcccaacaaaaccccgctacaaccacagcacaggaaaccacacagtttaagcattgtttcaccaaatccaaagatgggtttctctgctgtgagaaccttaaggttcaggagattatggagaatgttgagaagagaccgttttatttgtatagtaagccacagattactagaaatgttgaggcttataaggatgccttacaaggactgaattctattattggttatgctattaaggctaataataatttgaagattttggagcatttgagagggttgggttgtggtgctgttttggtaagtggtaacgagcttaggttggctcttcgggccggtttcgatcccacaaggtgtatttttaatggaaatgggaagctgctggacgatttggttctggctgctcaagaaggtgtttttgttaacgtggatagtgaatttgatttggaaaatattgtggcagctgctagaattgctggcaagaaggttaatgttctactccggatcaacccagatgttgaccctcaggttcatccttatgttgctacagggaacaagaactctaaatttggtattagaaatgagaagctgcaatggtttctggatgctgtaaaggcacaccgtgatgagctgaagctcgtgggggcccattgccatctaggatcaaccatcaccaaggtggacatattcagggatgctgcagttctcatggttaactacattgatgaaatcagagctcagggctttgaagttgattacttaaacattggaggtggtttgggtatagattattatcattctggtgcagtccttcctactccaagagatctcattgacactgttcgtgaactggttctctcacgagatctcaatctcatcattgaacctgggagatcgctcattgcaaatacttgctgcttggtgaatagggtcactggggttaaaactaatggaacaaaaaattttgttgtgatagatggcagcatggctgaacttatccgtcctagtctttatgatgcttatcaacacatagagcttgtttctcctgcatcacccaaggctgaagtttcaacttttgatgtggttggtcctgtctgtgagtccgcagatttcctgggaaaggatagagaacttccaactccagctaagggagctggtttggttgttcatgatgcaggtgcttactgcatgagcatggcatcgacatacaatctcaagatgcgccctcctgagtactgggttgaagatggaacagtgtccaaaattcggcatggggagacattcgaagaccatattcggttctttgagggtctttgattgcagacagtaaccacttctactgaggcaatgaaacctgatttttgcttgtattgtgttttctgcgtatcccaccctgctggttatatcaattcagatattcaatcagctgctggatttattcattgcatcgattcccagccttaaatactcatcaagagttatatatatatatatatctgaattaaaaacatttttaaaaagtcacgtctacacatttttaaacatttaaacaggctttcaaaagaattgaatctaagcttgtgggctacgacggtttgtgccaagcttttc

SEQ ID NO: 1971 - DNA, 1723 bp, Manihot esculenta
tctctctctctctctctctctctctctcggtctctcggtctgtctactgcttgttcatcaatggccgccaccaccacccacctctctcatccaccatccctctctaaaacccgaacttttcctttgagccaaaacccatttcttaaaactcctcttttaaccgtcaaaagcactaaatcctctctaaagtctctgtctctcaaagcagttttgtcccaaaaccctgctagtaccctaccccaggaatctgctccttttaagcattgtttcaccaaatctcctgatggcttcctctattgcgagaaccttaaggtccaggatatcatggagaatgttgagaaaagacccttttatttgtacagtaagccacagattactcggaattttgaggcttatagagatgctttagagggattgagatcgattattgggtatgcaattaaggctaataataatttgaagattttggagcacttgaggcagttgggttgtggagctgtactggttagtggcaatgagctcaggttggctcttcatgcgggattcgatcccacaaggtgcattttgaatggaaacgggaagctgttggaggaattggtattagctgcccaggaaggtgtctttattaatgtggatagtgaatttgatttagagaatattgtagcagctgctagaattgctggcaaaaaggttaatgttttactacgaatcaatccagatgtggaccctcaggttcatccttatgttgccactgggaataagaactctaaatttggcattagaaatgagaagctgcaatggtttttggatgctgtaaaggcacatcctaatgagctgaagcttgtgggggcccattgccatcttggctcaaccattaccaaggtggacattttcagggatgctgcagttcttatggtcaactacattgaccaaatccgagctcaaggttttgaagttgattacctaaacattggaggtggtttaggcatagattattatcatactggtgctgtccttccttcaccaagagatctcattgacactgttcgagaattggtgctctcacggaatctcaatctcatcattgaaccagggagatcggtgattgcaaatacctgctgcctggtcaacaaggtcactggagtgaaaactaatggaaccaaaaattttattgtaattgatggtagcatggctgaacttattcgtcccagtctttatgatgcttatcaacacatagagcttgtttctcctcaaccagctaatgctgaagtttcaacttttgatgtggtgggtcctgtgtgtgaatctgctgatttcttaggaaagaatagagaacttccaactccagctaagggagccggtttggttgtccacgatgctggcgcttattgcatgagcatggcatcaacatacaatctgaagatgcgccctcctgagtactgggttgaagaagatggatcagtggccaaaatacggcacggggagacatttgaagaccatatccggttcttcaagggcctctgattgcaggcatcaaacgtttctgccggtgcagcaggctcgagatgtgctcctattgtattttattcatgtagtatcatgctggatttttgctgtattgatagcagctggatttcatattctgtcgtttggcgtatgttgttagaactttgcatactcatcagaggagaaagttcaaataaagaatagatgaaattgaagg

SEQ ID NO: 1972 - DNA, 1616 bp, Brassica napus
tcacctcctctcccaaccttcatcatctctccgaagaaacctaaaccaataccaatcgaaccaatctcccctctccagaatcccagtcctgtctctcaagtcaaccttgaagccacttcaacgcctctccgtcaaagccgccgcatcacccccaaactccgtcaaaaccgtgacgaaggactcaagcgatcagtccgcgttcaaccactgtttcaagaaatcatcagatgggttcctctactgcgagggaacaaaggtggaggacatcatggagagcgtggagagaagacctttttacttgtacagcaagcctcagatcacgaggaacgtcgaggcgtacaaagaggccttggaaggtgtgagctccgtcattggctacgccattaaggctaacaacaacctcaagattctggagcatttgaggggtttgggatgtggtgctgtgctagttagtgggaatgagctaaggcttgctcttcgtgctggtttcgatcccacaaagtgtatcttcaatggaaatgggaagctgttggaggatttagttatagctgctcaagcaggtgtcttcgtgaatgtggatagtgagttcgacttggataatattgtggaagcgtcaagaatctccggtaaacaggtcaatgttctgctgcgtatcaaccctgatgttgatcctcaggtgcatccatatgtagctaccgggaacaagaactcgaagtttggtatcaggaacgagaagcttcagtggtttctcgatgaggtgaaggcgcatcctaatgagctcaagcttgttggtgctcattgccatctaggctctaccatcacaaaggtggatatattcagagatgcggcggtactcatggtggaatacattgatgacatcaggcgtcaaggctttgaagttagctacttgaacattggtggtggcttagggatagattattaccatgctggtgctatccttcctacacccatggatctcatcaacaccgtgagagagcttgttctgtcacgtggcctgaatctaattatagagccagggaggtcgctgattgcaaacacgtgctgtttcgtcaaccatgtgaccggtgtgaagacgaatggaactaaaaactttatagtgattgatggaagtatggctgagctaatccgtccaagtctttatgatgcctatcagcatattgagttggtctctcctccagcacctgaagcagaggtttccaagttcgacgtagtgggtcctgtttgtgaatctgctgattttttggggaaagatagagagcttcctactcctccaaagggagctggtctggtggttcatgatgctggtgcatactgtatgagcatggcttccacttacaatctcaagatgcgtcctccggaatactgggttgaagatgatgggtccatcactaagatcaggcatgctgagacattcgaagaccatttgcgtttctttgacggtctataaactctttgatttcctctgatcatttgcttgtcgctattttagttttactttattgattttcataatcattattgtaatgccatttgctgtgttagatttttcatatattccctgttgtatccgaaaccttcaataagttgatgaataa

SEQ ID NO: 1973 - DNA, 1887 bp, Helianthus annuus
  misc_feature (58)..(58): n is a, c, g, or t
  misc_feature (146)..(146): n is a, c, g, or t
  misc_feature (162)..(162): n is a, c, g, or t
  misc_feature (1269)..(1269): n is a, c, g, or t
  misc_feature (1661)..(1661): n is a, c, g, or t
caccctcacaccacaccaatggcggctgcatcttctccttcatccgctcacccccaantcatttcattcaccaaaaccctaaacaacaaatccccattcacctccaaatccctaatctccttcaaacccactttcaaacccttcancatcaaagcaatcacntctgaaaaaccaacacaaacccacaaattcgaccactgtttcaccaaacaagatgatgggtatttgtactgtgagggtctcaaggttcaagaagtcatggaggctgttgaaaagagacccttttacctttacagtaagcctcagataacgagaaatgttgaggcgtataaggatgctttggaggggttgaattcgattattggttatgctattaaggcgaataataattttgtgattttgaagcatttgagagagttgggttgtggggctgttttggttagtgggaatgaacttagattggctcttgctgctggttttgatcctacaaggtgtgtttttaatggaaatggaaagcttttggaggatcttgttcttgctgctcaagaaggtgtgtttgttaacatagatagtgaatttgatttggataacattgtatcggcagcaagaattgctgggaaaaaggtcaatgtattgcttcgaatcaatccggatgttgaccctcaggtccatccttatgttgcaactggaaacaagaactccaaatttggtatacggaacgaaaaattgcaatggtttttagatgcagtgaagtcatatcctgatgaacttaagctagttggggcccattgccatctcggatccaccattaccaaggttgacattttcagagatgctgcagcaattatggtgaagttcatcgacgaaatccgtgcccaagggttcgatattagttatttaaacattggaggtggtctcgggatcgattactatcacaccggcaccgttcttcctaccccaagagatctcatcgacacagtgcgggagctagtcaagtctcgaaatctgaatttgattattgaacccgggaggtcactcattgctaacacttgctgttttgtgaatcgtgtaacgggtgtgaaaacaaacggtacaaaaaactttattgtgattgatggaagcatggctgaacttattcgtcctagcctatatgatgcttatcaacacatagaactggtttctcccccaccatctgattctgctgtttcgacttttgatgttgtgggcccggtttgcgagtcggctgatttcttggggaaaaatagggancttcctgcaccagccaggggttctgggcttgtagttcatgatgcaggtgcctactgcatgagtatggcttcaacttacaacctcaaaatgcgcccacctgagtactgggttgaagaagatggatcagtagccaagatcaggcatggggagacatttgatgaccatatgagattttttgagggcctctcagtctagcttatatcgcggccttcttatatctatgtgtttgtatctctatcttttgaatacaagattccaagttccatttgatggccaaatcatgtgatggattttgcctgccactagtattgcatctttcatgtttagaagattacaaggcatgatttgacatgtatcgaattgtttgatctttttcgtgtctttatgaaatngtccaactcttagggatgaaagaaaaaaaaaagaaggggggaaaaaaaccttgtcgggccgccccggcccagtgaactctaaacccaagcaagtttttgcttggggccgcatttccagacacctggatgggccgtctttttaaaggtctagtcccacctaaacccggggggaccgagctcgattccgggcgtattaacaaaaaggccgccccgaatcccccttccc

SEQ ID NO: 1974 - DNA, 1961 bp, Saccharum officinarum
gtggaattgtggcagacgaggtggcctgttggtgcggcgggagtttgcgagttgggcggtctcggttggtgagtgagcgaaggtgttgttgggcgcgtggatctggccggcggcgggcgatgggaaggagggactagggctggattggagggaaaggcacgatcttgggggttcccatgggcggatgcttctcgcaggaggagcaccggctccagagcagaccagctgaagctgctggaccagacggactgcggaagtctaaatccgattctaaagctatagcaagtgttcttgctcctccaaaagatgtggtggacctgcaagtagaaggatatggaaatgtgaatattttcacatatgacgaaatgagagcagccacaaaaaacttccgaccagatcaaattcttggagagggtgggtttggagttgtttacaaaggtgtaattgatgaaaatgttagagcaggtttcccatccagacaggttgctgtgaaagaactaaacccagagggctttcaaggggacaaggagtggctggcagaagtcaactatcttgggcaacttagtcatccaaatcttgttgaactgattggctattgctgtgagggttcacatagactgcttgtctatgagtacatggcttgtggaagcctcgaaaagcacctttttcgccgggtttgccttaatatgccatggtcaacacgcatgaagattgcattgggtgctgcaaggggtctcgagtaccttcacggagctgagagatccatcatttatcgagatttcaagacatcaaacatcttgctagatgcggattacaatgctaagctttcagactttggtctcgcaagaacaggtcctagtggagaccaaacccatgtgtcaactcgggtcatgggaacttatggatatgcagctccagaatatgtcatgactggccatctgacggcacgaagtgatgtttatggctttggagttgtgcttctagagatgattattggaagaagggctgtggacaagagccggccgagccgcgagcataacctagttgattgggcacggcccctcctcgtccataacaggaagctgttccgaataatcgatccaagaatggaagggcagtactccaccaaggctgccattgaggtggcaagccttgcataccgctgcctcagccagaatcccaaaggacgaccaaccatgagccaagttgttgagacctttgaggcggtgcagaacatgcctgaatgccaagacatactcctccagaacagtatcacaggtgccgtgacgctctatgaggtcccaaaggagcctgcagacagagttgagttggagaaggccaagcaggaaccggcagtaaagactgccgcaatgccacccgtgaatggaaagccagtcccccagagcaggcgaacacggcctgggaatggccggagcaagagcgagccatcgttggagtgtaagatgtacatcccgtcaccagactctgacggacagcagctcggcctggaggcactcgcatctccaaatggaagcataaaggaccctcctgatgaggatttgtacaagatataacaccagagcaattttttttcgacgtcgtgagccctcgttgcttgccttttgcaccttcacccctgttctcaaagatcaatcagttataaatttttctccgatggccaccggccacgctagggttcttattcttccgattagcaattgtatgtaaaggagagttgtgatggaaagcatgtgtgactgcctgccaacctgatacacttctttctggggggatttccactccaaaaatggaagtggagagatgtgtcctgacaattggtgctgatacccgtctgttgagttacttgtaaagatgcttgttcttcgttgtaatcttgaacagtcctgcgggaaatcaacaccaccatggaaattgatagattagtcactgtgttgtcaatt

SEQ ID NO: 1975 - DNA, 2519 bp, Zea mays
acggctcaccccctagtcgcctcgccccgccccgccccgccccgccccgcccccgcggcccgcgttgttgttcttgtagtacgcggcagcagctttcttttacctattccaaccctctgggctctggcacacagctactccgcctcctcgcccttttctcctcatccctcgctttcgcttcgccgttccaacgcggagcccccacggaaaataaaggccaagaagtgatggtagtggagtaaaaccacgcgttggagggcagagggacaggttggtggaggacgcgcacccagcgtggagagcagcaggagctacgcgaattcgggccgcgagtgcgccggttcaggttgccgccgccggtggaattgtggcagacgaggtggcctgttggtagccgcgggagtttgcgagtaggtcggttccggttggtgtgcgagcgaaggtgctgttggaggcgtggatctggccggcggcgggcgatgggaaggagggactagggctcgattggagggaaaggcgcgatcttggaggttcccatgggcggatgcctctcgcaggaggagcaccggctccagagcaggccagctgaagctgctggagcagatggattgcggaagtctaaatctgattctaaagctgtagcaagtgttcttgctcctccaaaagatgtggtggacctgcaagtagaaggatatggaaatgtgaatattttcacatatgacgaattaagagcagccacaaaaaacttccggccagatcaaattcttggagagggtggatttggagttgtttacaaaggtgtaattgatgaaaatgttagagcaggtttcccatcgagacaggttgctgtgaaagaactaaacccagagggctttcaaggggacaaggagtggcttgcagaagtcaactatcttgggcaacttagtcatccaaatcttgttgaattgattggctattgctgtgagggttcacatagactgcttgtctatgagtacatggcttgtggaagcctcgaaaagcacctttttcgccgggtttgccttaatatgccatggtcaacacgcatgaagattgcattgggtgctgcaagggggctcgagtaccttcacggagctgagagatccatcatttatcgagatttcaagacatcaaacatcttgctagatgcggattacaatgctaagctttcagactttggtctcgcaagaacaggtcctagtggagaccaaacccatgtgtcaactcgggtcatgggaacttatggatacgcagctccagaatatgtcatgactggccatctgacggcacgaagtgatgtttatggcttcggagtggtgcttctagagatgattatcggaagaagggctgtggacaagagccggccaagccgtgagcataacctagttgactgggcacggcccctcctcgtccataacaggaagctgttccgaataatcgatccgagaatggaagggcaatactccaccaaggctgccactgaggtggcaagccttgcataccgctgcctgagccagaaccccaagggacgaccaaccatgagccaagtcgtcgagacctttgaggccgtgcagaacatgcctgaatgccaagacatactcctccagaacagcatcacaggtgccgtgacgctctatgaggtccccaaggagcctgcagacagagttgagctggagaaggccaagcaggaaccggcagtaaagagcgccgcgatgccgcccatgaacggaaagccagtcccccagagcaggcggacgcggcctgggaatggccggagcaagagcgagccatcgttggagtgcaagatgtacatcccgtcaccggactctgatggacaccagctcggcctggaggcagtcgcatccccagatggaagcataagggaccctcctgatgaggatttgtacaagatataacaccagggcagtttttcttcaacaacgaggggcagatctggcgcagtgttgagttgtgggttttcaaaccagcctcttcgcatttagggaggaagatttgcatctgtttatctctttctcatacctcatttacgtgggagcctcgatctgcctttttaacgtgagcccgcgttgctcacctttggcgccgccactcccgttcttaaagatcaatcagctgtaattttttctctgatggccactggccacggtagcgttcatattcttccgattagcaattgtatgtagaggagagttgtgatggaaagcatgtgtgtgtttgccatgacgacgctgtaaaaacctgaaacacttatttctaggggggtttccactccaaaatggaagtggagagatgtgtcctgataattggtgccgttacccgtgtgttgagtttttacccccctccacaatccccttctttcaaacaaggctggtttggatccatgggcaatcaccatgccctgaagaacgttgcaatctggaacagttctgcgggaaatcaacaccaccatggaaattgatactccaaacctgatgtgatga

SEQ ID NO: 1976 - DNA, 2365 bp, Zea mays
acggctcaccccctagtcgcctcgccccgccccgccccgccccgccccgcccccgcggcccgcgttgttgttcttgtagtacgcggcagcagctttcttttacctattccaaccctctgggctctggcacacagctactccgcctcctcgcccttttctcctcatccctcgctttcgcttcgccgttccaacgcggagcccccacggaaaataaaggccaagaagtgatggtagtggagtaaaaccacgcgttggagggcagagggacaggttggtggaggacgcgcacccagcgtggagagcagcaggagctacgcgaattcgggccgcgagtgcgccggttcaggttgccgccgccggtggaattgtggcagacgaggtggcctgttggtagccgcgggagtttgcgagtaggtcggttccggttggtgtgcgagcgaaggtgctgttggaggcgtggatctggccggcggcgggcgatgggaaggagggactagggctcgattggagggaaaggcgcgatcttggaggttcccatgggcggatgcctctcgcaggaggagcaccggctccagagcaggccagctgaagctgctggagcagatggattgcggaagtctaaatctgattctaaagctgtagcaagtgttcttgctcctccaaaagatgtggtggacctgcaagtagaaggatatggaaatgtgaatattttcacatatgacgaattaagagcagccacaaaaaacttccggccagatcaaattcttggagagggtggatttggagttgtttacaaaggtgtaattgatgaaaatgttagagcaggtttcccatcgagacaggttgctgtgaaagaactaaacccagagggctttcaaggggacaaggagtggcttgcagaagtcaactatcttgggcaacttagtcatccaaatcttgttgaattgattggctattgctgtgagggttcacatagactgcttgtctatgagtacatggcttgtggaagcctcgaaaagcacctttttcgccgggtttgccttaatatgccatggtcaacacgcatgaagattgcattgggtgctgcaagggggctcgagtaccttcacggagctgagagatccatcatttatcgagatttcaagacatcaaacatcttgctagatgcggattacaatgctaagctttcagactttggtctcgcaagaacaggtcctagtggagaccaaacccatgtgtcaactcgggtcatgggaacttatggatacgcagctccagaatatgtcatgactggccatctgacggcacgaagtgatgtttatggcttcggagtggtgcttctagagatgattatcggaagaagggctgtggacaagagccggccaagccgtgagcataacctagttgactgggcacggcccctcctcgtccataacaggaagctgttccgaataatcgatccgagaatggaagggcaatactccaccaaggctgccactgaggtggcaagccttgcataccgctgcctgagccagaaccccaagggacgaccaaccatgagccaagtcgtcgagacctttgaggccgtgcagaacatgcctgaatgccaagacatactcctccagaacagcatcacaggtgccgtgacgctctatgaggtccccaaggagcctgcagacagagttgagctggagaaggccaagcaggaaccggcagtaaagagcgccgcgatgccgcccatgaacggaaagccagtcccccagagcaggcggacgcggcctgggaatggccggagcaagagcgagccatcgttggagtgcaagatgtacatcccgtcaccggactctgatggacaccagctcggcctggaggcagtcgcatccccagatggaagcataagggaccctcctgatgaggatttgtacaagatataacaccagggcagtttttcttcaacaacgaggggcagatctggcgcagtgttgagttgtgggttttcaaaccagcctcttcgcatttagggaggaagatttgcatctgtttatctctttctcatacctcatttacgtgggagcctcgatctgcctttttaacgtgagcccgcgttgctcacctttggcgccgccactcccgttcttaaagatcaatcagctgtaattttttctctgatggccactggccacggtagcgttcatattcttccgattagcaattgtatgtagaggagagttgtgatggaaagcatgtgtgtgtttgccatgacgacgctgtaaaaacctgaaacacttatttctaggggggtttccactccaaaatggaagtggagagatgtgtcctgataattggtgccgttacccgtgtgttg

SEQ ID NO: 1977 - DNA, 2254 bp, Setaria italica
agacgtgccgtgctctaaacctctggcacagctaatccgcctcctcgcctttttttcctccatctcctcgccttcgctgctacattcgagcgccccccaacggaaaataaaggccaagaagtggtgctagtggagtaaaaccacgcgcccgagaggagagggacaggttggtggaagacgcgcatccggaaggcgcgcagcaggagctgcggcggcgaattcgggcggcgagcgcgccagttcaggctgccgtcggcggcgggcgtaattgttgcggacgaagcggccggttggtgcggcgggagtttgcgggtagggcggtcccggctggtgaaggggcgaaggtgctgcttggggcgtggatctggccggaggcgggcgatgtggaggagggagtagggccggattggagggaaaggcgcgatcttgtgggttcccatgggcgcatgcttctcgcaggaggagcaccggctccagagcaggccagctgaagctgctggaccagatggcctgagaaagtctaaatcggattctaaagctatagcaagtgtccttgctcctccaaaagatgttgtggacttgcaagtagaaggatatggaaatgttaatattttcacatacaatgaactgagggcagccacaaaaaacttccggccagaccaaattcttggagagggtggatttggagttgtttacaaaggtgtaattgatgaaaatgttagagtaggttttccatctagacaggttgctgttaaagaactaaacccagagggctttcagggagacaaggaatggctggccgaagtcaactatcttgggcaactaagtcatccaaatctagtcgaactgattggctattgctgtgagggttcacatagacttcttgtctacgagtacatggcttgtggcagccttgaaaaacacctttttcgccgggtttgccttaatatgccatggtcaacacgcatgaagattgcgctgggtgccgcaagggggcttgagtaccttcatggagccgagagatccatcatctatcgggatttcaagacgtcaaacatcttgttagatgcggactacaatgctaagctttcagactttggtctcgcaagaacaggacctagtggagaccaaacccatgtgtcaactcgggtcatgggaacttatggatatgcagctccagaatatgtcatgactggccatctgaccgcacgaagtgatgtttacggctttggcgttgtgcttctagagatgattattggaaggagggctgtggacaagagtcggccaacccgtgagcataacctagttgattgggcacgccccctccttgtccacaaccggaagctattcaggatcattgatcccagaatggaggggcagtactccaccaaggccgccattgaggtggcaagcctcgcataccgttgcctgagtcagaaccccaaagggcgaccaactatgagccaagttgttgagacctttgaggcggtgcagaacatgcctgaatgccaagacatactcctccagaacagtatcactggtgctgtgacactctatgaggtcccgaaggagcctgcagagagtgttgagaaggagaaggccaaacaggaaccagcagtaaagaccgccgctgtgccgcctgtgaatggaaaaccagtcccccagagcaggcgaacacggcctgggaacggccggagcaagagtgagccgtcgttggagtgcaagatgtacatcccgtcaccagactctgacggacagcagctcggcctggagacgcttgcatccccttccagaaacggaagtatgcaggaccctcctgacgaggatttgtacaagatttaacatcagagaagttttttttcccaacgactgagctgtcgttggtcatcttttgcgccaccatccatgttcttaagaacagtcagccagtgttaattttttcgatgatggccatgctagggttcttgttcatccgattagcaattgtatgtagatgagagttgtgatggaaagcatgtaatgtgagtgccttccatgacgacgctgtaaaaacctgagacggttctttccgggagaattccacgccaaaaatggaagtggagagatgtgtcctgatagtcagtgccgttgccagtgtgttcgagttacttgtaaagatgcttgttctacattgtaaacttgaaattgagagattatattagccagtgtccacatcctgtcagttttcttaattgtccagttatttctatgaatg

SEQ ID NO: 1978 - DNA, 2254 bp, Zea mays
gacaaggttggtagaggacgcgcacccggggtggagctgagagcaacaggagctcctgcggcgaattcgggccccgagtacgccggttcaggcggccgccgccggtggaattgtgccagtcgaggtggcctgctggtgcggcgggagtttgcgagtagggcggttccggttttgagtgagcgaaggtgttgttgggggcgtggatctggccggcggcgggcgatgggaaggagggactagggctcgattggagggaaaggcgtgatccatgggcggatgcttctcgcaggaggagcaccggctccagagcaggccagctgaagctgctggaccagacggactgcagaagtcaaaatctgattctaaagctacagcaagtgttcttgctccaccaaaagctgtggtggatctgcaagtggaaggatatggaaatgtgaatattttcacatatgacgaattgagcgcagccacaaaaaacttccgaccagatcaaattcttggagagggtgggtttggagttgtttacaaaggtgtaattgatgaaaatgttagagcaggtttcccatccaggcaggttgctgtgaaagaactaaacccagagggttttcaaggggacaaggagtggctggcagaagtcaactatcttgggcaacttagtcatccaaatcttgttgaactgattggctattgctgtgagggttcacatagactgcttgtgtatgagtacatggcttgtggaagcctcgaaaagcacctttttcggcgggtttgccttaatatgccatggtcaacacgcatgaagattgcattgggtgctgcaagggggctcgagtaccttcacagagctgagagatccatcatttatcgagatttcaagacatcaaacatcttgctagatgcggattataatgctaagctttcagactttggtctcgcaagaacaggtcctagtggagaccaaacccacgtgtcaactcgtgttatgggaacttatggatacgcggctccagaatatgtcatgactggccatctgacagcacgaagtgatgtttatggctttggagtcgtgcttctagagatgattattggaagaagggctgtggacgatagccggccgagccgtgagcataacctagttgactgggcacggcccctcctcgtccataacaggaagctgttccggataatcgatccaagaatggaagggcagtactccaccaaggctgccaccgaggtggcaagccttgcataccgctgcctgagccagaaccccaaaggacgaccaaccatgagccaagttgttgagacctttgaggccgtgcagaacatgcctgaatgccaggacatactcctccagaacggcatcacaggtgccgtgacgctctacgaggtcccaaaggagcctgcagacagagttgagctggagaaggccaagcaggaaccggcagtaaagaccgccgcaatcccgcccgtgaacggaaagccggccccccagagcaggcgaacgcggcctgggaatggccggagcaagagcgagccatcgttggagtgtaagatgtacatcccatcaccagactctgacgaacagcagctcggcctggaggcactggcgtccccaaatggcagcatgaaggaccatcctgacgaggatttgtacaagatataaaatcaggagccctcgttgctcgccttttgcgccgccaccccagctctcaaagatcggtcagttacaattttttctctgatagccaccggcctcgctagggttcttattcttccgattagcaattgtatgtagagggagagttgtgatggaaagcatgtgtgtgcttgccatgacgatgctgtagagatctgatacacttctttctggggaatttccactccaaaaatggaagttgagagatgtgtcctgacgattggtgcgttttacccgtgtgttgagtttacttgtaaagatgcttcttcgttgtaatcttcagttctgcgggaaatcaacaccagcatagaaattgatagattagtcactgtgttgtcaatttgttcaaatctccaagcggtgaagtttttatttatctatttatttttttcgcacaactagagtggtaagttcatgaatattagttcaaagcatctgtatcctactttataaatccgtacatatctgagaagttttaaaacttaatctcaaggttgatataaaatacatgcataaacacacatactttataaatacactatctgagaagtttaa

SEQ ID NO: 1979 - DNA, 2020 bp, Zea mays
gacaaggttggtagaggacgcgcacccggggtggagctgagagcaacaggagctcctgcggcgaattcgggccccgagtacgccggttcaggcggccgccgccggtggaattgtgccagtcgaggtggcctgctggtgcggcgggagtttgcgagtagggcggttccggttttgagtgagcgaaggtgttgttgggggcgtggatctggccggcggcgggcgatgggaaggagggactagggctcgattggagggaaaggcgtgatccatgggcggatgcttctcgcaggaggagcaccggctccagagcaggccagctgaagctgctggaccagacggactgcagaagtcaaaatctgattctaaagctacagcaagtgttcttgctccaccaaaagctgtggtggatctgcaagtggaaggatatggaaatgtgaatattttcacatatgacgaattgagcgcagccacaaaaaacttccgaccagatcaaattcttggagagggtgggtttggagttgtttacaaaggtgtaattgatgaaaatgttagagcaggtttcccatccaggcaggttgctgtgaaagaactaaacccagagggttttcaaggggacaaggagtggctggcagaagtcaactatcttgggcaacttagtcatccaaatcttgttgaactgattggctattgctgtgagggttcacatagactgcttgtgtatgagtacatggcttgtggaagcctcgaaaagcacctttttcggcgggtttgccttaatatgccatggtcaacacgcatgaagattgcattgggtgctgcaagggggctcgagtaccttcacagagctgagagatccatcatttatcgagatttcaagacatcaaacatcttgctagatgcggattataatgctaagctttcagactttggtctcgcaagaacaggtcctagtggagaccaaacccacgtgtcaactcgtgttatgggaacttatggatacgcggctccagaatatgtcatgactggccatctgacagcacgaagtgatgtttatggctttggagtcgtgcttctagagatgattattggaagaagggctgtggacgatagccggccgagccgtgagcataacctagttgactgggcacggcccctcctcgtccataacaggaagctgttccggataatcgatccaagaatggaagggcagtactccaccaaggctgccaccgaggtggcaagccttgcataccgctgcctgagccagaaccccaaaggacgaccaaccatgagccaagttgttgagacctttgaggccgtgcagaacatgcctgaatgccaggacatactcctccagaacggcatcacaggtgccgtgacgctctacgaggtcccaaaggagcctgcagacagagttgagctggagaaggccaagcaggaaccggcagtaaagaccgccgcaatcccgcccgtgaacggaaagccggccccccagagcaggcgaacgcggcctgggaatggccggagcaagagcgagccatcgttggagtgtaagatgtacatcccatcaccagactctgacgaacagcagctcggcctggaggcactggcgtccccaaatggcagcatgaaggaccatcctgacgaggatttgtacaagatataaaaccagagccctcgttgctcgccttttgcgccgccaccccagttctcaaagatcggtcagttacaattttttctctgatagccaccggcctcgctagggttcttattcttccgattagcaatagtatgtagagggagagttgtgatggaaagcatgtgtgtgcttgccatgacgatgctgtagagatctgatacacttctttctggggaatttccactccaaaaatggaagttgagagatgtgtcctgacgattggtgcgttttacccgtgtgttgagtttacttgtaaagatgcttcttcgttgtaatcttcagttctgcgggaaatcaacaccagcatagaaattgatagat

SEQ ID NO: 1980 - DNA, 2263 bp, Oryza sativa
gcttccctctggcacagctaatccaaatcctcctctttttcttgttttttttttctttcttcgtcttctccaacgcccaaagtaaaacaaaggaaaaaagaaaagccgcatccaagaacgcaccagaaatttcggcgacggttgcgcgcgaatccatccatccaccggcggtcggagggcggcggcggcggagcaattccgcccaaccaagcggcggagtcggtgcgggcgaaatttccgggttggtgcgcggggcttgggttggtggtggtggactggtggtggtgtgtgttcttgggagtggatctggcaggaggctggcgatggggaggcgggagtagggggagcggcggattggagtgggaggcgcggtgttgggggctcccatgggcggatgcttctcgctggaggagcaccggctccagggcaagacagaagctggtgggccagatgggttaaggaaatgcaaatctgattctaaagctacagcaagtgtccttgcccctccaaaagatgtggaggacctgcaaatcgaaggatacggaaatgttaatattttcacatataatgaactaagagcagccacaaaaaacttccggcctgaccaaattcttggagagggtgggtttggtgttgtttacaaaggtgtaattgatgaaaatgttagagcgggctttccatccacacaagttgctgtgaaagaattaaacccagagggatttcagggtgacaaggaatggttggcagaagtcaactaccttgggcaacttagccatccaaatctagtcgaactgattgggtattgctgtgaaggctctcatagactgcttgtttacgagtacatggcttgcggcagccttgaaaagcatctttttcgccgggtttgccttaatatgccatggtctactcgaatgaagattgctctaggtgctgcaagggggctggaatatcttcacggagctgagagatcaattatatatcgagatttcaaaacatcaaacatcttgttagatgcggattataatgccaagctgtcagactttggcctagcacgaactggacctagtggagaccaaacccatgtatcaactcgggtcatgggtacttatggctatgcagctcctgaatatgtcatgacaggccatctgacagcacgaagtgatgtctatggctttggtgtcgtccttctcgagatgatcataggcaggagggctgtggacaagagccggcctagccgtgagcacaacctagttgagtgggcacgtcccctcctcgtgcacaatcggaagctgttcaggattatcgatccaagaatggaagggcagtactccaccaaggctgccattgaggtggcaggccttgcgtaccgatgcttgagccagaatcccaaaggacgacccaccatgagccaggttgttgagacctttgaggctgtgcaaaacatgcctgaatgccaagacatactcttgcagaactgcatgacgggtgcagtgacactctacgaggttgcaaaggaccctacggagagcgtcgagccggagaagataaaacaagaacaaccagcagcaaaaacggtcaccgtggcaccggcaccggtaaatggaaaacccgtgcctcagagcaggagaacacggccagggaatggccggagcaagagcgagccgtctttggaatgcaagctgtacatcccatctccagactctgatggccagcagccaggcctggaggcattgtcatccccttccagagatggaagcataaaggatccaccggacgaggatttgtacaagatataaaagtcacacagaagttttttatgacgattcaagttttcgctaccggcgatttcgcattgccatccatccatcttgttgtcaagatcgatcagagtcaaagttggtgttaaaattttttctgatggcggaagaactctacctcgttaggtttcttgctgttccgactagcaattgtatgtagagaggagcgttgtggaaagcatttgtaatgtgagatgcctgccgcgacgaaaagttcgtgttgtaaacttgaaaccattctctgggaagaggaagatccacatcataatcgatgtgtcagtgttgttgttgctcgagtgtttttgacttttctgtatagatgatgatgtccttgcaaacttggtacagttctacaggaaatcaacaagaagatggaaaaatataagatgaatcagtgtccgtttgttgacagtttgtttttggagtatggttttgttttcactgcc

SEQ ID NO: 1981 - DNA, 1830 bp, Brachypodium distachyon
aactctacggctgctggtggagggtgcccgggttgtggggggcgtggatctggccggaggcgggcgatgtggaggcgggagtagggttgtgttggaggggaagccgcgatcttgggggctcccatggggggatgcttctcgctggaggagcaacggctccagagcaggacaggcacttcagctgaagctggtggaccagatgggttgaggaagtgcaaatctgattctaaagccatatcaagtgttcttgcacctccaaaagatgtggaggacctgcaaactgaaggatatggaaatgttaatattttcacatacaacgaactgcgagcagccacgaagaactttcggcctgaccaaattcttggagagggtgggtttggagttgtttacaaaggcgtaattgatgaaaatgttagagtgggttttccatccacgcaagttgctgtgaaagaactgaacccagagggctttcagggagacaaggaatggttggcagaagtcaactatcttggccaacttagtcatccaaatctagttgaactaattggctattgctgtgagggttcgcacagattactcgtatatgagtacatggcttgtggcagccttgaaaagcacctttttcgccgagtttgtcttaatatgccatggtcaactcgcatgaagattgcactcggtgcagcaagggggcttgagtaccttcacggagccgagaggtccatcatatatagggatttcaagacgtcaaacatcttgttagatgcggattataatgctaagctttcagactttggcctggcaagaactggacccagtggggaccaaacccatgtctcaactcgggtcatgggaacttacggctatgcagctcctgaatatgtcatgactggccatttgacagcacggagcgatgtttatggctttggtgttgtgcttctcgagatgattattgggaggagggccgtggacaagagccggcccagccgtgagcataatctagttgagtgggcacgccccctcctggtccacaatcggaagctgtttaggatcattgatccaagaatggaaggccagtactccaccaaggctgccattgaggtggccagcctggcataccgatgcttgagccagaaccctaaagggcggcctactatgagccaggttgttgaaacctttgaggcggttcatagcatgcccgaatgccaggacatactcttgcagaactgtatgaccggtgctgtgacgctctacgaggtcccaaaggaacctgttgagcatgtcgaggcagagaaggtgaagcaggaaccaacagcgaagactgaagccgtggctgtggtaccagcgaatggaaagccagtgcctcagagcaggagaacacggccagcaaacggcaggagcaagagcgagccctctttggagtgcaagatgtacatcccttcgcctgactccgatggactgcagccggggctagaggcccttgcatccccttcccgaaccgggagtatgagggatcctcctccagatgaggatctatacaagatataagtaacaccaaacagtttttgacgataaatcgagtcttccttaccccgtgttcggcattgccattccatcttgtcgtcgagatcagtcagctggtgttgcattcttcttctttctgatggcggaactaccatgctagggtttcttgtttcttccggttagcaaattgtatgtagatgagcatcgcgggaagcatgtaatgttggtgttcatgctgtaaactccaaacagttctctgggaaagatccacaccaaaaatcaatggaaatggagaaaatttgtccggtg

SEQ ID NO: 1982 - DNA, 1991 bp, Triticum aestivum
gaaaaggccgcaccgcaccgcaaatttcggcgacggactcgcgccgcgcccgagcccgacccccacctcgctccggcggccgggaggaggagcgcacgcgcggcccgaccgcggcggaagcgggaggaaaattccccggccggcgggtgcgcggcgcggatctggccggggccgggcgatggggaggggctgggagtaggggaaggcgcgcgcggcgatctcggggcggcctcccatgggtggctgcttctcgctcgaggagcagcggctccagagcaggacaggcacttcggctgaagctggtggaccagatgggctgaggaagtgcaaatctgattctaaagctatttcaagtgttcttgctcctccgaaagatgtggaggacctgcaaacagaaggatatggaaatgtcaacattttcacatacaacgaactgcgagcagccacaaagaactttcggcctgatcagattcttggggagggtggatttggagttgtttacaaaggcgtcatcgatgaaaatgttagaataggttttccatccagacaggttgctgtgaaagaactgaacccagagggttttcagggagacaaggaatggttggcagaagtcaactatcttgggcaacttagtcatgcaaatctagtcgaactgattggctattgctgcgagggttcccatagattacttgtctatgagtacatggcttgtggcagccttgaaaagcacctttttcgacgggtttgccttaatatgccatggtcaactcgcatgaagattgcactcggtgcagcaagggggcttgagtatctccacggagctgagagatccatcatctatagggatttcaagacatcaaacatcttgctagacgcggattataatgctaagctttcagactttggcctagcaagaactggacctagtggagaccaaacccatgtctcaactcgggtcatgggaacttatggctatgcagctcctgaatatgtgatgactggccatttgacagcacggagtgatgtttatgggtttggtgttgtacttctcgagatgattattgggaggagggctgtggacaagagccggccgagccgtgagcataacctagttgagtgggcacgccccctccttgtccacaaccggaagctcttcagaatcattgatcctagaatggaaggccaatactccaccaaggctgccattgaagtggccagcctttgctaccgatgcttgagccagaaccctaaagggcggcctactatgagccaggttgttgaaacctttgaggaggttcaaagcatgccggaatgccaggacatactcctgcagaattgtatgaccggatctgtgacgctatacgaggtcccaaaggagcctgttgagcatgttgagacagagaaggcgaagcaagaaccaacagcaaagactgatgccgtggcggtggccgtgccaccgacgaacggaaagccagtgccccagagcaggaggacgcggccagcgaacggcaggagcaagagcgagccgcctctggagtgcaagctgtacatcccttcgcctgactccgacgggcatcagctggggctggaagccctggcatcacccccttccagaaacagcagcagggatgatcctcctcccgtggacgaagatctgtacaagatataaagtaataacagcagtttttgacgaggctcaacaagcctctgtttacccgtgtcgtctcgtgtcgccatccatcttgttgtcaagatcgatcagtcagtcagtcagctggtgtttttgttttttcttctgatggcggaactaccaaagctagggttcttgttcttgcggttagcgaattgtatgtagagagaggggcgtcgtgggaagcatgtaatgtgagttccatgatggtgttcgtgctgtaaactcggaacagttctctgggaaagatccacaccaaaatggaaatggagagatttgtccaaaaaaaaaaaaaaaacga

SEQ ID NO: 1983 - DNA, 1764 bp, Triticum aestivum
  misc_feature (220)..(220): n is a, c, g, or t
  misc_feature (223)..(223): n is a, c, g, or t
  misc_feature (225)..(225): n is a, c, g, or t
  misc_feature (227)..(227): n is a, c, g, or t
  misc_feature (499)..(499): n is a, c, g, or t
  misc_feature (547)..(547): n is a, c, g, or t
  misc_feature (565)..(565): n is a, c, g, or t
  misc_feature (568)..(568): n is a, c, g, or t
  misc_feature (592)..(592): n is a, c, g, or t
  misc_feature (616)..(616): n is a, c, g, or t
  misc_feature (949)..(949): n is a, c, g, or t
  misc_feature (1057)..(1057): n is a, c, g, or t
  misc_feature (1060)..(1060): n is a, c, g, or t
  misc_feature (1285)..(1285): n is a, c, g, or t
ctcggggcggtctcccatggggggctgcttctcgctcgaggagcagcggctccagagcaggacaggcacttcggctgaagctggtggaccagatgggctgaggaagtgcaaatctgattctaaagctatttcaagtgttcttgctcctccgaaagatgtggaggacctgcaaacagaaggatatggaaatgtcaacattttcacatacaacgaactgcgngcngncncaaagaactttcggcctgatcagattcttggggagggtggatttggagttgtttacaaaggcgtcatcgatgaaaatgttagaataggttttccatccagacaggttgctgtgaaagaactgaacccagaaggttttcaaggagacaaggaatggttggcagaagtcaactatcttgggcaacttagtcatgcaaatctagtcgaactgattggctattgctgcgagggttcacatagattacttgtctacgagtacatggcttgtggcagncttgaaaagcacctttttcgacgggtttgccttaatatgccatggtcnactcgcatgaagattgcnctnggtgcagcaagggggcttgagtanctccacggagctgagagatccatnatctatagggatttcaagacatcaaacatcttgctagacgcggattataatgctaagctttcagactttggcctagcaagaactggacctagtggagaccaaacccatgtctcaactcgggtcatgggaacttatggctatgcagctcctgaatatgtgatgactggccatttgacagcacggagtgatgtttatgggtttggtgttgtacttctcgagatgattattgggaggagggctgtggacaagagccggccgagccgtgagcataacctagttgagtgggcacgccccctccttgtccacaaccggaagctcttcagaatcattgancctagaatggaaggccaatactccaccaaggctgccattgaagtggccagcctttgctaccggtgcttgagccagaaccctaaagggcggcctactatgagccaggtngtngaaacctttgaggaggttcaaagcatgccggaatgccaggacatactcctgcagaattgtatgaccggatctgtgacgctatacgaggtcccaaaggagcctgttgagcatgtcgagacagagaaggcgaagcaagaaccaacagcaaagactgatgccgtggcggtggccgtgccaccggcgaacggaaagccagtgccccagagcaggaggacgcggccagcnaacggcaggagcaagagcgagccgcctctggagtgcaagctgtacatcccttcgcctgactccgacgggcatcagctggggctggaagccctggcatcacccccttccagaaacagcagcagggatgatcctcctcccgtggacgaagatctgtacaagatataaagtaataacagcagtttttgacgaggctcaagcctctgtttacccgtgtcgtctcgtgtcgccatccatcttgttgtcaagatcgatcggtcggtcagtcagtcagtcagctggtgtttttgttttttcttctgatggcggaactaccaaagctagggttcttgttcttgcggttagcgaattgtatgtagagagaggggcgtcgtgggaagcatgtaatgtgagttccatgatggtgttcgtgctgtaaactcggaacagttctctgggaaagatccacaccaaaatggaaatggagagatttgtcttgtcgc

SEQ ID NO: 1984 - DNA, 1695 bp, Hordeum vulgare
ctccagcaccaggacaggcacttcggctgaagctggtggacctgatgggttgaggaagtgcaaatctgattctaaagctatttcaagtgttcttgctcctccgaaagatgtcgaggacctgcaaacagaaggatatggaaatgttaatatcttcacatacaacgaactgcgagcagccacaaagaactttcggcctgatcaaattcttggagagggtgggtttggagttgtttacaaaggtgtcattgatgaaaatgttagaataggttttaaatccacacaggttgctgtgaaagaactaaacccagagggctttcagggagacaaggaatggttggcagaagtcaattatcttgggcaacttagtcatccaaatctagttgaactgattggctattgctgcgagggttcacataggttacttgtctatgagtacatggcttgtggcagtcttgagaagcacctttttcgacgggtttgccttaatatgccatggtcaactcgcatgaagattgcgctcggtgcagcaagggggcttgagtatctccacggagctgagagatccatcatctatagggatttcaagacatcaaacatcttgctagacgcggattataatgctaagctttcagactttggcctagcaagaaccggacctagtggagaccaaacccatgtctcaactcgagtcatgggaacctatggctatgcagctcctgaatatgtgatgactggccatttgacagcacggagcgatgtttatggctttggtgttgtgcttcttgagatgattattgggaggagggctgtggacaagagtcggccgagccgtgagcataacctagttgagtgggcacgccccctccttgtccacaaccggaagctcttcagaatcattgatcctagaatggaaggtcaatactccacaaaggctgccattgaagtggccagcctttgctatcgatgcttgagccagaaccctaaagggcgtcctactatgagccaggttgtcgaaacctttgaggaggttcaaagcatgccggaatgccaggacatactcctgcagaattgtatgaccggatctgtgacgctatacgaggtcccgaaggagcctgttgagcatgtcgagacagagaaggcgaagcaagaaccaacagcaaagactgatgccgtgtccgtggccgtgccaccgacgaacggaaagccagtgccccagagcaggaggacgcggccagcaaatggcaggagcaagagcgagccacctttggagtgcaagctgtacatcccttcgcctgactccgacgggcatcagttggggctggaaaccctggcatcgcccccttccagaaacagcagcagggatgatcctcctcctgtggacgaagatctgtacaagatataaagtaataacagcactttttgacgaggctcaagcctccgttgcccgtgtccgtctcgtgtcgccatccatcttgttgtcaagatcgatcagtcagtcagtcagtcagctggtgttttttgtttttcttctgatggcagaactaccaagctagggttcttgttcttgcggttagcgaattgtatgtagagagagaggcgtcatgggaaagcatgtaatgtgtgttccatgatggtgttcgtgctgtaaactcgaaacagttctctgggaaagatccacacccaaaatggaaatgg

SEQ ID NO: 1985 - DNA, 1695 bp, Hordeum vulgare
ctccagcaccaggacaggcacttcggctgaagctggtggacctgatgggttgaggaagtgcaaatctgattctaaagctatttcaagtgttcttgctcctccgaaagatgtcgaggacctgcaaacagaaggatatggaaatgttaatatcttcacatacaacgaactgcgagcagccacaaagaactttcggcctgatcaaattcttggagagggtgggtttggagttgtttacaaaggtgtcattgatgaaaatgttagaataggttttaaatccacacaggttgctgtgaaagaactaaacccagagggctttcagggagacaaggaatggttggcagaagtcaattatcttgggcaacttagtcatccaaatctagttgaactgattggctattgctgcgagggttcacataggttacttgtctatgagtacatggcttgtggcagtcttgagaagcacctttttcgacgggtttgccttaatatgccatggtcaactcgcatgaagattgcgctcggtgcagcaagggggcttgagtatctccacggagctgagagatccatcatctatagggatttcaagacatcaaacatcttgctagacgcggattataatgctaagctttcagactttggcctagcaagaaccggacctagtggagaccaaacccatgtctcaactcgagtcatgggaacctatggctatgcagctcctgaatatgtgatgactggccatttgacagcacggagcgatgtttatggctttggtgttgtgcttcttgagatgattattgggaggagggctgtggacaagagtcggccgagccgtgagcataacctagttgagtgggcacgccccctccttgtccacaaccggaagctcttcagaatcattgatcctagaatggaaggtcaatactccacaaaggctgccattgaagtggccagcctttgctatcgatgcttgagccagaaccctaaagggcgtcctactatgagccaggttgtcgaaacctttgaggaggttcaaagcatgccggaatgccaggacatactcctgcagaattgtatgaccggatctgtgacgctatacgaggtcccgaaggagcctgttgagcatgtcgagacagagaaggcgaagcaagaaccaacagcaaagactgatgccgtgtccgtggccgtgccaccgacgaacggaaagccagtgccccagagcaggaggacgcggccagcaaatggcaggagcaagagcgagccacctttggagtgcaagctgtacatcccttcgcctgactccgacgggcatcagttggggctggaaaccctggcatcgcccccttccagaaacagcagcagggatgatcctcctcctgtggacgaagatctgtacaagatataaagtaataacagcactttttgacgaggctcaagcctccgttgcccgtgtccgtctcgtgtcgccatccatcttgttgtcaagatcgatcagtcagtcagtcagtcagctggtgttttttgtttttcttctgatggcggaactaccaagctagggttcttgttcttgcggttagcgaattgtatgtagagagagaggcgtcatgggaaagcatgtaatgtgtgttccatgatggtgttcgtgctgtaaactcgaaacagttctctgggaaagatccacacccaaaatggaaatgg

SEQ ID NO: 1986 - DNA, 1585 bp, Pennisetum glaucum
gtagagggatatgaaaatgtaaatattttcacatacaatgaacggagggcagccacaaaaaacttcaggccagaccaaattcttggagagggtggatttggagttgtttacaaaggtgtaattgatgaaaatgttagagcaggttttccatctagacaggttgctgttaaagaactaaacccagagggctttcagggagacaaggaatggctggctgaagtcaactatcttgggcaactaagtcatccaaatctagtcgaactgattggctattgctgtgagggttcacatagacttcttgtctatgagtacatggcttgtggcagccttgaaaagcacctttttcgacgggtttgccttaatatgccatggtcaacacgcatgaagattgcgctgggtgctgcaagggggcttgagtaccttcatggagccgagagatccatcatctatcgggatttcaagacgtcaaacatcttgttagatgcggactacaatgctaagctttcagactttggtctcgcaagaacaggacctagtggagaccaaacccatgtgtcaactcgggtcatgggaacttatggatatgcagctccagaatatgtcatgactggccatctgaccgcacgaagtgacgtttatggctttggtgttgtgcttctagagatgattattggaaggagggctgtggacaagagtcggccaacccgtgagcataacctagttgattgggcacgcccgctcctcgtccacaaccgaaagctgttcagaatcattgatccaagaatggaagggcagtattcaaccaaggctgccatagaggtggcaagcctcgcataccgttgcctgagtcagaaccccaaagggcgaccaaccatgagccaagttgttgagaccttcgaggcagtgcagaacatgcctgaatgccaagacatacttctccaggacagtatcactggtgctgtgacactctatgaggtcccgaaggagcctgcagagagtgttgagaaggacaagcccaaagaggaaccagcagtaaagactgctgctgtgccgcctgtgaatggaaaaccagtcccccagagcaggcgcacacggcctgggaatgggcggagcaagagtgagccgaagttggagtgcaagatgtacatcccatcacccgactctgatggacagcagcttggcttggatgcccttgcatccccttccagaaacggaagtatgcaggaccctcctgacgaggatttgtacaagatttaacatcagagaagttttttccccaacgacttccgtcattggtcaacttttgcgccaccatccatgttcttaagaacagtcagccagtgttaattttttcgatggtggccatgctagggttcttgttcttccgattagcaattgtatgtagatgagagttgtgatggaaagcatgtaatgtgaatgcctgccatgacgacgctgtaaaaacctgagacggttctttccgggagaatttccacgccaaaaatggaagtggagagatgtgtcctgatagtctgtgccgttgccagtgtattcgagttacctgtaaagatgcttgttctacatc

SEQ ID NO: 1987 - DNA, 1077 bp, Triticum aestivum
ctatcatccaaagaccaacgagtacgccaacaagtgaagtgcaccgagctgagcagtgagtgagcggccggggacgcggtcgacgagccaagaatggcgacgcaccatcgtgctctcctcctcctgctcgccgtgctgctcccggcggcggccatcggccgacccggacgccgtgcaggacttctgcgtgccggaccccgggcgcggccggcccgtggagctcaacctcatccgctcctacccgtgcaggagcccggccaacctcaccgcgggcgacttcgccttctcgggcgtgcgcgcggcgggcaacttctcggccgacacggggttcgcgggggtgtccgtcacgccggcgcagttcccgggcctgcacaccctcggcatgtccttcgcgcgcgccgacctctcggccgccggcggcgtcaacccgccgcaccaccacccgcgcgccaccgagacggcgctcgtcctcgccggccgcgtctacgcgggcttcgtcgacacggggggccgcctcttcgccaaggtgctcgtggagggggaggtcatggtgttcccccgcggcatggtgcacttccagctcaacgtcggcgaccagcccgccaccgtctacggcaccttcaacagcgagaaccccgggatcgtgcgcatcccggccaccgtgttcgggtccgggatcagggacgccgtccttgagagggcttttgggctctcccccgaggagctccggcggatcgagaagaggttcggcgtgcccaagaaggccgagctggaggactagttaattcgtctattatacttcgttccttgctggtcggccatggccgcatgtgcatgattagatgacaggtagacttgtgggttgggagtatgggcaatactacttatttcttttccatttaattaatataatatacttgtggatttgtagtggtggttggtagggctcatccgtatgtgtaatgatatgaaaagtgtaaggtatacaaatgattgcgagtatatggtagtacatcatgtgaataataagcaagaacatgctgctacgctgtctgtacctcggccgcgaccacgcta

SEQ ID NO: 1988 - DNA, 917 bp, Triticum aestivum
ctatcatccaaagaccaacgagtacgccaacaagtgaagtgcaccgagctgagcagtgagtgagcggccggggacgcggtcgacgagccaagaatggcgacgcaccatcgtgctctcctcctcctgctcgccgtgctgctcccggcggcggccatcggcgccgacccggacgccgtgcaggacttctgcgtgccggaccccgggcgcggccggcccgtggagctcaacctcatccgctcctacccgtgcaggagcccggccaacctcaccgcgggcgacttcgccttctcgggcgtgcgcgcggcgggcaacttctcggccgacacggggttcgcgggggtgtccgtcacgccggcgcagttcccgggcctgcacaccctcggcatgtccttcgcgcgcgccgacctctcggccgccggcggcgtcaacccgccgcaccaccacccgcgcgccaccgagacggcgctcgtcctcgccggccgcgtctacgcgggcttcgtcgacacggggggccgcctcttcgccaaggtgctcgtggagggggaggtcatggtgttcccccgcggcatggtgcacttccagctcaacgtcggcgaccagcccgccaccgtctacggcaccttcaacagcgagaaccccgggatcgtgcgcatcccggccaccgtgttcgggtccgggatcagggacgccgtccttgagagggcttttgggctctcccccgaggagctccggcggatcgagaagaggttcggcgtgcccaagaaggccgagctggaggactagttaattcgtctattatacttcgttccttgctggtcggccatggccgcatgtgcatgattagatgacaggtagacttgtgggttgggagtatgggcaatactacttatttcttttccatttaattaaaaaaaaaa

SEQ ID NO: 1989 - DNA, 1127 bp, Oryza sativa
gatcaatacctgcatgattactggcaatgatcaactcaccttacaagacatcagtgctcgactacatatgtactactacgtgcaaagcaagcagctgtccaccgacgaacgagtgacagaacgagcgtagaatcgatggcgcatcgtcgtcgttgtctcctcctcttgctcgccgtgctgctgccggcgatggcggcaaggggcgatcccgacgcggtgcaggacttctgcgtgccggacgccgggcgtgggcggccggtggagctcgccatgctcccggcctacccgtgcaggagccccgccaacctgacggcgggcgacttcgccttctccggcgtgcgcgccgcggggaacttctcgccggagacggggttcgccggcgtgtccgtcaccccggcgcagttcccgggcctgcacaccctggggatgtccttcgcccgcgccgacctctcggcggccggcggcgtcaacccgccgcactaccacccgcgcgccaccgagacggcgctcgtcctcgccggccgcgtgtacgccgggttcgtcgactccggcggccgcctcttcgccaaggtgctcgagcagggggaggtgatggtgttcccgcgcgccatggtgcacttccagctcaacgtcggcgacacgccggccacggtctacggcgccttcaacagcgagaaccccggcatcgtccgcatcccggcgacggtgttcgggtccggcatcagggaggccgtcctcgagagggcgttcgggctcactccggcggagctccggcggctggagaagaggttcggcccgcccaagaaggcggagatggaggattagctagccgcttgtgcttgaccggccatggccgtcggtcgtgggcatgattaggttactccccgttagtgataattaatgggttatttcttttcatttcatttggttaatacagtactgtatcatttgtggcggtggttgggaaatggtgattatagcctggtaatgatttgaggtgtaaggttggtagagatgtataaggaggcacagatgaatggaacaatcgagagggtaactcaacttcaaaatatgctcagttttgtttgtttgttttttcctgaaatggtgtttcgtgctgaatgtac

SEQ ID NO: 1990 - DNA, 706 bp, Setaria italica
ggatggcggcgcatcacctcctcctcctcctgctcgccgtgctgctcccggcggcggccacggcggaccccgacgccgtgcaggactactgcgtgccggacgccggcgggcgcgggcggcccctggagctgtcgctgctccggacctacccgtgccggagccccgtcaacctgacggcgtccgacttcgccttcgccggcgtgcgcgccgcgggcaacttctccgcggacacgggcttcgcgggtgtctccgtcacgcccgcgcagttcccggcgctgcacaccctgggcgtgtcctttgcccgcgccgacctctccgcggcgggcggcgtcaacccgccgcactatcacccgcgcgccaccgagacggcgctcgtcctggcggggcgcgtctacgccggcttcgtcgactccggcggccgcatcttcgccaaggtgctcgagaagggggaggtgatggtgttccccatggggatggtgcacttccagatgaacgtcggcgacgagcccgccacggtgtacggcaccttcaacagcgagaaccccggcatcgtgcgcatcccggccaccgtgttcgggtccgggatcaagggcggcgtcctcgagagggcgttcgggctctccccggcggagctccgccggctcgagaagaggttcggcccgcccaagaccaagctgtccgagatggaggattagttacttaatca

SEQ ID NO: 1991 - DNA, 1133 bp, Pennisetum glaucum
ggcccagtcgccctcttcctcttaaggcaaagtctgcaattagctgatgcgagacagtggtgagcactgagcagacgcaccgtgaccgaccaaccgcgagccagccgacgaccgacactagctagcaagcaaccaggtggacatggcggcgcatcacctcctcctcctgctcctcgccgtgctgctcccggcggcggccacggcggaccccgacgccgtgcaggactactgcgtgccggacgccggcgggagcgggcggcccctggagctttcgctgctccgtacctacccgtgccggagccccgccaacctgacggcgtccgacttcgccttcgccggcgtgcgcgccgcgggcaacttctccgcggacacgggcttcgcgggggtctccgtcacgcccgcgcagttcccggcgctgcacaccctgggcgtgtccttcgcccgcgctgacctctccgcagcgggcggggtcaacccgccgcactaccacccgcgcgccaccgagacggcgctcgtcctggcgggccgcgtctacgccggcttcgtcgactccggcggccgcatcttcgccaaggtgctcgagaagggggaggtcatggtgttccccaaggggatggtgcacttccagatgaacgtcggcgacgagccggccacggtgtacggcaccttcaacagcgagaaccccggcatcgtgcgcatcccggccaccgtgttcgggtccgggatcaagggcggcgtcctcgagagggcgttcgggctctccccggcggagctccgccggcttgagaagaggttcggcccgcccaagaccaagctgtcggagatggaggattagttagttaatcagctgggtgatcaaccgtttacaggtagactttgcgagtcggagtacatttcttttgaattgttaatgttgtcgtagtatatgaattatctggcggtggttgtggtggatcgacattgtggtagacttggaatgattgtagcctttatttgaaggtggacggttagcaagatggtggtagcttttatttaggtgtcacattcgatccagtgtcaagtgtctgacatgtttatatcttacacaatttggaaaagaagatcgactttagttaaaaaaaaaaaaaaaaaaa

SEQ ID NO: 1992 - DNA, 1013 bp, Brachypodium distachyon
ggaaacaaacaagcaaaccaacaatgctgcgccatcatcatgtactcctcctccttctcgccgtgctgctgctccccgcggcggccacggccgacccggacgccctgcaggacttctgcgtgccggacccgggccgcggccgcccagtggagctcgccctgctccgcacctacccgtgcaagaacccttcaaacctcacggccggggacttcaccttctcgggcgcgcgcgccgcgggcaacttctccgcagacctgggcttcgcgggggtgtccgtgaccccggcccagtttcccggtctcaacacgctgggcatgtccttcgcccgcgccgacctgtccgcggccggcggcgtcaacccgccgcactaccacccgcgcgccacggagacggcgctcgtcctcgccggccgcgtctacgccggcttcgtggacaccggcgggcgactcttcgccagggtgctcgccaagggggacgtcatggtgttcccgcggggcatggtgcatttccagctcaacgtgggcgacgcgccggccacggtctacggcagcttcaacagcgagaacccgggcatcgtgcgcatcccggccacggtgttcggttccgggatcagggccgctgtcctggagagggcgttcgggctcaccgcggcggagctccgccggatcgaggagaagtttggaccgcccaagaaggccgagatggaggagtaattaatcaactgtatttcgttggttgggggcttggggcctttggggttggctgatcggacatggcggccgtgggtccatcccgcatgcatgcgtacatgattagttgacaggtagacttgggtgggtttgagtatgggtatactatttctttttcatttggtttatgtgcagtttatttgtggtggttgttaaggctcgtcattagctatcactgtaatgattcgttaaaaggtggaaggttggtacagctgaaaaaaattacagtacaaaattgaaataagcgatcactaatgatcaaaa

SEQ ID NO: 1993 - DNA, 1174 bp, Zea mays
atagatagtactccacagcgcagagatgaatgagaccagtcgccctctgccccaggcaaagctgcagctgcagctgccacagcggtgaccacgcacgctgcaccgcaccgcaccgacgggtgagacctgctgtgtccaccaaccgtgagcccagcaggcgaccgacgacgctagcttagactaggaaccaacaatggccacgcgccacctgctcctcctcctgctcgccgcgctgctcccggcggcggccacggcggacccggacgcggtgcaggactactgcgtgccggacacgggcggcgggcgcgggcgcgggcgggccgtggatctagcgctgctcccgtcctacccgtgcaggagccccgccaacctgacggcggcggacttcgccttcgcgggcgtgcgcgccgcgggcaacttctccgcggacacggggttcgcgggggtgtcggtgacccccgcgcagttcccggcgctgcacaccctcggcgtgtccttcgcgcgcgccgacctgtccgcggcgggcggggtcaacccgccgcactaccacccgcgcgccaccgagacggcgctggtcctggccggccgcgtctacgcgggattcgtcgactcgggcggccgcgtcttcgccaaggtgctcgagaaaggggaggtcatggtgttcccgcgcgccatggtgcacttccagatgaacgtcggcgacgagccggccacggtgtacggcaccttcaacagcgagaaccccggcatcgtgcgcatcccggcgaccgtgttcgggtccgggatcaaggacgccgtcctcgagagggcgttcggcctcgagccggaggagctccgccggctccagaagaggttcgggcctcctcccaagaccaagacggcggagatggacgattgatcggaagatcaggcactcgcgatcaagggggacatgattaattgattagttatattaagagcagcagactttgtgatctctggaatatatctccttccatttgttaatgtctgtatgaattatttggcggtggacggtggttatcatggaccgataatgccggtacgtacagatgggatgggcatgtggggttaggtgtcacattcaagtgtctacgagatgtttatgggtttatatatattgttaataaagcaggccgactttatttgctctgga

SEQ ID NO: 1994 - DNA, 1174 bp, Zea mays
atagagagtactccacagcccagagatgaatgagaccagtcgccctctgccccaggcaaagctgcagctgcagctgccacagcggtgaccacgcacgctgcaccgcaccgcaccgacgggtgagacctgctgtgtccaccaaccgtgagcccagcaggcgaccgacgacgctagcttagactaggaaccaacaatggccacgcgccacctgctcctcctcctgctcgccgcgctgctcccggcggcggccacggcggacccggacgcggtgcaggactactgcgtgccggacacgggcggcgggcgcgggcgcgggcgggccgtggatctagcgctgctcccgtcctacccgtgcaggagccccgccaacctgacggcggcggacttcgccttcgcgggcgtgcgcgccgcgggcaacttctccgcggacacggggttcgcgggggtgtcggtgacccccgcgcagttcccggcgctgcacaccctcggcgtgtccttcgcgcgcgccgacctgtccgcggcgggcggggtcaacccgccgcactaccacccgcgcgccaccgagacggcgctggtcctggccggccgcgtctacgcgggattcgtcgactcgggcggccgcgtcttcgccaaggtgctcgagaaaggggaggtcatggtgttcccgcgcgccatggtgcacttccagatgaacgtcggcgacgagccggccacggtgtacggcaccttcaacagcgagaaccccggcatcgtgcgcatcccggcgaccgtgttcgggtccgggatcaaggacgccgtcctcgagagggcgttcggcctcgagccggaggagctccgccggctccagaagaggttcgggcctcctcccaagaccaagacggcggagatggacgattgatcggaagatcaggcactcgcgatcaagggggacatgattaattgattagttatattaagagcagcagactttgtgatctctggaatatatctccttccatttgttaatgtctgtatgaattatttggcggtggacggtggttatcatggaccgataatgccggtacgtacagatgggatgggcatgtggggttaggtgtcacattcaagtgtctacgagatgtttatgggtttatatatattgttaataaagcaggccgactttatttgctctgga

SEQ ID NO: 1995 - DNA, 1017 bp, Eragrostis curvula
  misc_feature (16)..(16): n is a, c, g, or t
  misc_feature (22)..(22): n is a, c, g, or t
  misc_feature (26)..(26): n is a, c, g, or t
  misc_feature (29)..(30): n is a, c, g, or t
  misc_feature (34)..(34): n is a, c, g, or t
  misc_feature (41)..(41): n is a, c, g, or t
  misc_feature (67)..(67): n is a, c, g, or t
  misc_feature (86)..(89): n is a, c, g, or t
  misc_feature (92)..(92): n is a, c, g, or t
  misc_feature (94)..(94): n is a, c, g, or t
  misc_feature (98)..(98): n is a, c, g, or t
  misc_feature (100)..(100): n is a, c, g, or t
  misc_feature (668)..(668): n is a, c, g, or t
  misc_feature (702)..(702): n is a, c, g, or t
  misc_feature (721)..(721): n is a, c, g, or t
  misc_feature (737)..(737): n is a, c, g, or t
  misc_feature (751)..(751): n is a, c, g, or t
  misc_feature (787)..(787): n is a, c, g, or t
  misc_feature (800)..(800): n is a, c, g, or t
  misc_feature (841)..(841): n is a, c, g, or t
  misc_feature (848)..(848): n is a, c, g, or t
  misc_feature (851)..(851): n is a, c, g, or t
  misc_feature (859)..(859): n is a, c, g, or t
  misc_feature (861)..(861): n is a, c, g, or t
  misc_feature (865)..(865): n is a, c, g, or t
  misc_feature (879)..(879): n is a, c, g, or t
  misc_feature (886)..(886): n is a, c, g, or t
  misc_feature (890)..(890): n is a, c, g, or t
  misc_feature (892)..(892): n is a, c, g, or t
  misc_feature (898)..(900): n is a, c, g, or t
  misc_feature (902)..(902): n is a, c, g, or t
  misc_feature (905)..(905): n is a, c, g, or t
  misc_feature (928)..(928): n is a, c, g, or t
  misc_feature (935)..(935): n is a, c, g, or t
  misc_feature (944)..(944): n is a, c, g, or t
  misc_feature (950)..(951): n is a, c, g, or t
  misc_feature (962)..(962): n is a, c, g, or t
  misc_feature (964)..(965): n is a, c, g, or t
  misc_feature (969)..(969): n is a, c, g, or t
  misc_feature (976)..(977): n is a, c, g, or t
  misc_feature (986)..(986): n is a, c, g, or t
  misc_feature (988)..(988): n is a, c, g, or t
  misc_feature (991)..(991): n is a, c, g, or t
  misc_feature (996)..(996): n is a, c, g, or t
  misc_feature (1001)..(1001): n is a, c, g, or t
  misc_feature (1005)..(1005): n is a, c, g, or t
  misc_feature (1007)..(1008): n is a, c, g, or t
  misc_feature (1013)..(1013): n is a, c, g, or t
  misc_feature (1015)..(1015): n is a, c, g, or t
cttccaacggcaaggngggacntccntcnnggcnacttcgnctgcttccccagaacccggcctcganctcctctcccctccgcccnnnnagncncacncnctccgccgccgtcccgaggaaccgttctcggagccgtcgctgtcccgaggaaccattctcggagccgtcgccgtccgcccctcttctcgaccggcttcgagtagagatcccatcgggagttgagctgatttcctctttcgccgcatcccaataaggaggaagcaatgtcaggagttgtgacaaagttcgctgtgacatccatggtgatgtggatcgtcccggttgcgatcgtgtacgggttttactacgagatgattccaggtgtgagtcagctgtcatcctcgacgcagaccctggtcagtggattcctcgctgtcatatctgttaacctggtgatcggcttttacatatgcatggcaatgaaggagactccccaccaagagccgcagccagatccaactttcctggctaacgccaaagcaagtattaaccagccaacatcttctcaacccagtgacgattccaaggggaaggggaaggtcgagtaagcactgccgcaggtttactagggtttctcactattatatgagcatgttggtggatgaaagttctgctatgttatcagtcnatgccacacccttttagtttgatgctttcgctgnaaatcttgagagtcatggntatggaaccatatganaatggaccttttgnacccgttggatatggatcctatgtactatgttcaanatgttattttcgntagggatgctgaggaaaactccctttggttaatttttaggnccgtttnggngattgggncngtcnctgcaacatatgcnttgaacngggnantatgcnnncnggntatttgactactttttgggaaangaaaccnagaacatanttattnnctggtggttgncnncaanaaaaaannctaaaaaananaanaaaanataanaagngnncttgngntg

SEQ ID NO: 1996 - DNA, 707 bp, Panicum virgatum
ttctcgcttccgtctccggcgtcgagccccctccggccacctgtcaaactcggcggctgtgcaaggaagagcagcacctggaaggaattcttcaggattggaggtgccgtcggtgtccgcacctctgctgggccggcgtcaagcggagatcgaatcgggaaccgaactgatcccgtctttcgtcgaacttgcatcaggagaagcaatgtcaggagtgatcacaaagttcgcggttacatccatggtgatgtggatggccccggtcgcgatcatgtatgggttctactaccaggtgtttccaggtgtgagtcagatgtcatcctcagcgcagacactcgccagcgggttccttgccgtcatatcagttaatctggtgatcggcttctacatatgcatggcgatgaaggagactccacaccaggagccgcagcctgatcccaccttcttggcagatgctaaagcgagtatcaaccagccaacatcttctcaagtgaatgatgattccaaggggaaggggaaggttgagtaagctgtagcattttggcttgggtcttgtgtatgctatacgcatgtcactcaggaggaatagttgtgctatgccatcacacaatgccgtaaccttttaaatttcttaatttgctgtaaatcttgatggttatggttatggaaccatatgaagatgaatctcatgtatctgtttacgatgg

SEQ ID NO: 1997 - DNA, 926 bp, Setaria italica
gaagcaggaagtgccgcaagtggatgggagctggtgccgatgagcctccgaatgcgtcgaagggacggcggacgggcagacaaaggcgctagtttaatttgcttagccccaggtcaccggcgcttatctggagctgaagaatggggaggatcacaaagttcgcggttgcatccatggtgatgtggatggccccggttgcgatcgtgtatgggttctactaccaggtgtttccaggtgtgagtcagatgtcatcctcggcgcagacactcgccagcgggttccttgccgtcatatcagtcaatctggtgatcggcttttacatatgcatggcaatgaaggagactccgcaccaggagccgcagccagatcccaccttcttggcgaatgctaaagcgagtatcaaccagccaacatcttctcaagtgagtgatgattccaaggggaaggggaaggttgagtaagctgtagcatgttggcttgggtcttgtgtatgttaagagcatgttattcaggaggaatagttgtgctatgccaccacacaataccatggcctttaaaatttcacgatttcgctgtaaatcttgacggttatggttatggaaccatttgaagatgaacctcttgtatctgtttacaatggaaactgtgtccaatgtgttattttggttaggattctcatcaaaactaccggtggttatgtattagttcctttttggtgatttggttagatcctatttagtgtatgccttgaacatacatatgctgcaatgtggttccattctggcttgtgttgagatacaatccaacaacatagttaataggtgatatttgaatagtttgcttcagtgtacaatggatattttttctgtgcacgcttgtaatctgtagtaactctggtcaaacttgttatgtctgttaaatgacga

SEQ ID NO: 1998 - DNA, 718 bp, Sorghum bicolor
cgtggtaggcaacaggcaggttcgagttcgatccaatcgaccgcagccctccgtctcctctcgtcgcttcctccatctctcggcgtcgaatctcctcgggccaccgagcacactctactagccgctcggaaggagttcttccgggattggagccgttgctgccctcacctctgctggggcggcgtcgagcggagacccaatcggaaatcgaactgacttggtcttttgttgcttccccatccggagaagcaatgtcaggagtgatcacaaagtttgcggttacatccatggtgatgtggatggccccggttgcgatcatgtatgggttctactaccaggtgtttccaggtgtgagtcagatgtcatcctcggcgcagacactcgccagcgggttcctggctgttatatcagttaatctggtgatcggcttttacatattcatggcgatgaaggagactccacaccaagagccacagccagatcccaccttcctggcgaacgccaaagcgagtatcaaccagccaacatcctctcaagtgagtgatgattccaaggggaagggaaaggtcgagtaagctgtagcatgttggctctggtcttgtgtatgctaagtgcatgctatttaggaggaatagttgtgctacaccatcacactacaccgcaagtccgcaaccttttaaagctcatgattttgatgtaaattttatcagttatggtt

SEQ ID NO: 1999 - DNA, 782 bp, Panicum virgatum
ggcatcagttgagcttccgatccaatcgacggctccactgctctcgtcttctcgcttccgtctccggcgtcgagccgcctccggccacctgggcaaactctactcctttgcaaggaagagcgccacctggaaggaattcttcaggattagaggtgccgccggtgtccgcgcctctgctgggccggcgtcaagcggagatcgaatcgggaaccgaactgacctcgtctttcgtcgaacttccatcaggagaagcaatgtcaggagtgatcacaaagttcgcggttacatccatggtgatgtggatggccccagtcgccatcatgtatgggttctactaccaggtgtttccaggtgtgagtcagatgtcatcctcagcgcagacactggccagtgggttccttgccgtcatatcagttaatctggtgatcggcttctacatatgcatggcgatgaaggagactccacaccaggagccacagcctgatcccaccttcttggcaaatgctaaagcgagtgtcaaccagccaacatcctctcgagtgaatgatgattccaagggaaaggggaaggttgagtaagctgtagcattttgacttgggtcttgtgtatgctatacgcatgttggccatcacacaatgccgtaaccttttaaatttcttaatttgctgtaaatcttgatggttatggttatggaaccatatgaagatgaatcttctgtatccttttacgatggaaactatgtttgatgggttgttttgattaggatccttatcaaaattacc

SEQ ID NO: 2000 - DNA, 782 bp, Pennisetum glaucum
gcggctccaatcctggaagatccccttccggacggctcactcccctcgtcttctcgcttccgtctccggcgtccgaccccccctccggccaccgagcgcacactactccttggcaagggagaagcgccgcctggaaggggatcttccaggattggagccgccgccgctgttctcacccctgctgggccggcgtcgagcggagatccagttgaaaactaaactgacctcatcttttgccgcgttcccaccaggagaagcaatgtcaggagtgatcacaaagttcgcggttgcgtccatggtgatgtggatggccccggttgcgatcgtgtatgggttctactaccaggtgtttccaggtgtgagtcagatgtcatcttcggcgcagacacttgccagcggattccttgccgtcatatcagtcaatctggtgatcggcctttacatatggatggcgatgaaggagactccgcaccaggagccgcagccagatcccaccttcttggcagatgctaaagcgagtatcaaccagccaacatcttctcaagtgagcgatgattccaaggggaaggggaaggttgagtaagctgtagcatgttgccttgggtcttgtgtatgttataagagcatgttattgaggaggaatagttgtgctaggccatcgcactatgctttttaaatttcacgatttcgctgtaaatgttggcagtcatggttatggagcccgtatgaaaatgaacctcttgtatccagtggttatgtattagttcttttttggtgaaaaa

SEQ ID NO: 2001 - DNA, 651 bp, Cynodon dactylon
gggggagccaggcattccactcgacggcgacttcgctagccagtctcgccggtttcctgtagaactcgccgccctagaatcccctcccctccggccaccgagcacgcactccgccgtcgtccggaggagccatcttggagccgtgtccattcagtactctcctggacgggcttcgagtggagatcccatagaactctttgccccttttgctgcatcccaatacggaggaagcaatgtcggcagtggtgacgaagttcgctattacatctatggcgatgtggatcgtcccggttgcgattgtgtatgggttttactacgagatgattccaggtgtgagtcagctatcgtcctccacgcagaccctgatcagtggattcctcgccgtcatctctgtcaacctggtgatcggactttacatatgcatggccatgaaggagactccccaccaagagccacagccagatccaactttcctggctaacgcaaaagcaagtattaatgagccgacatcttctcaacccagtgatgattccaaggggaagggcaaggtcgagtaagcactgctcgggttgactagggttctatgttatcagcatgttaatggatagggagttttgttatatcatcactcaataatgccacatgcttttg

SEQ ID NO: 2002 - DNA, 445 bp, Pennisetum glaucum
gatcttccaggattggagccgccgccgctgttctcacccctgctgggccggcgtcgagcggagatccagttgaaaactaaactgacctcatcttttgccgcgttcccaccaggagaagcaatgtcaggagtgatcacaaagttcgcggctgcgtccatggtgatgtggatggcccggttgcgatcgtgtatgggttctactaccaggtgtttccaggtgtgagtcagatgtcatcttcggcgcagacacttgccagcggattccttgccgtcatatcagtcaatctggtgatcggcctttacatatggatggcgatgaaggagactccgcaccaggagccgcagccagatcccaccttcttggcagatgctaaagcgagtatcaaccagccaacatcttctcaagtgagcgatgattccaaggggaaggggaaggttgagtaagc

SEQ ID NO: 2003 - DNA, 821 bp, Saccharum officinarum
tccccctcgtgacaggcaggttcgatccaaacgacggctccgcagcctccggaccgcaaccctctgctctcgtcgcttcttcctccatctctcggcgtcgaatctcctccggccacggagcacactctactagccgctcggaaggagttcttccgggattggagccgttgctgccctctctgctggggcggcgtcgagcggagacccaatcggaaatcgaactgactttgtctcttgttgcttccccgtccggagaagcaatgtcaggagtgatcacaaagtttgcgattacatccatggtgatgtggatggccccggttgcgatcatgtatgggttctactacgagttgtttccaggtgtgagtcagatgtcatcctcggcgcagacactcgccagcgggttcctggccgtcatatcagttaatctggtgatcggcttttacatattcatggcgatgaaggagactccacaccaagagccacagccagatcccaccttcctggcgaacgccaaagctagtatcaaccagccaacatcctctcaagtgagtgatgattccaggggaagggaaaggtcgattaagcttgtagcatggtgggcttggtcttgtgtatgtaaagtgcatgctatttaagaggaatagttgtgctacgccatcacactacactgcaaccttttaaagctcatgattctgctgtaaatcttatcagttatggttatggagcaatacacagctgaacctcttgtacctattcaatttggaaactgtgttcaatggtattttagtacaatgctcattgaaactactggtggtgtattt

SEQ ID NO: 2004 - DNA, 763 bp, Cynodon dactylon
ggggggcgacttcgcccagtcttgccggcttcctctagaactcgcaggcctcgaatcccctcccctccggccaccgagcacgcactccgacgtcgtccggaggagccatcttggagccttcgccattcgtgcctctcctgaacgggcttcgagtggagatcccatcgggacctaactgattgcgtctttttactgcatcccaattcggaggaagcaatgtcggcagtggtaacgaagttcgctgttacatctatggcgatgtggatcgtccccgtcgcgattgtgtatgggttttactacgagatgattccaggtgtgagtcagctaccgtcctccacgcagaccctgatcagtggattcctcgccgtcatatctgtcaacctggtgatcggattttacatatgcatggccatgaaggagactccccaccaagagccacagccagatccaactttcctggctaacgcaaaagcaagtattaacgagccgacatcttctcaacccagtgatgattccaaagggaagggcaaggttgagtaagcactgctcgggttgactagggttctatatttctatgttatcagcatgttaatggagaggagttttgttatatcatcactcaatgccacatccttttgatttgatgattttgctgtaaatcttgagggctatggttatggatccataaagaggtggaccttttgtacccgtttgatatgtatactgtgttctctggttagggatctgaataaatctggttata

SEQ ID NO: 2005 - DNA, 749 bp, Brachypodium distachyon
agcccaagaaggcttcgttctcctctggcttcttcttcgctgctgctccttcttccccctcctcctctgcagacccagatcgcctcctccactgacccgcctccaaatcggtgaccctgttttcttcgtcgcaggaaatctccttcgcgttcgtgatcaacattcccatcaggagaagcaatgtcggcagtaatcacaaagttcgctgttacatctatggtgatgtggatggccccagttgcaattgtgtatggattttactaccagattttcccaggtgtcagtaagctttcaccctcagcgcaaactatggccagtggatttcttgctgtcatatcggtcaatctggtgatcggcttttacatatacatggcgatgaaggagactccccatcaagaaccacaacctgatccagcttttctggcaaatgctaaagcaagcatcaaccagccaacatcttctcaagtgagtgacgactcccatgggaagggaaaggtggagtaggcactagtccattatacacaaattatccagaatcatctgtgttatgtacttatgtaatgtcacgtccttttagcttgatgtagtcactgaaattttgagaactatggtatcttatgaagatgaatcttttgtactgtatcgaacttgttatttttggtatgatgtcaagaaatactattcttgatcataattcaggcacctgctttcactaattctgaaacatcttctttagcctgtactttaag

SEQ ID NO: 2006 - DNA, 723 bp, Avena sativa
cttttcccctgcctcgctgcatccccagatcgccttctcccctaaaccttcctaccctagcgcgaaggcaggccgtgcttgcgtcgtcctctccaaatcctccccgcagtcaccattacccttaggcgaagcgatgtcgacagtgattacaaagttcgctgttacatctatggtcatgtggatggtcccggttgcagttatctatgggtttaaccaccagatttttccaggtgttagccagctttcaccctcaacgcaaaccttggccagtggattccttgctgtcatatcagtcaacctggttatcggcttctacatatacatggcgatgaaggagactccccatcaggagccgcagcctgatccaaccttcctggcaaacgctaaagcgagcattaaccagccaacatcttctcaagtgagtgacgattcccatgggaagggaaaggtggagtaggcagtccgcaatttgacttcggttttatctcaatgatacaatgatcacatgctatcgagaatcagttgtgttatgtgcttatgtaatgttaagcatgtccttttagtttgatggatgtagtcactggaatttttgagaactacggagctatatgaaggtgaatcttgtgtaccagttatcagtagatattgtgttcagtttggtaaaaaagttatgatgttgcgaaagaccaactgttgtgatcataattgagaatatatttttac

SEQ ID NO: 2007 - DNA, 3447 bp, Zea mays
ttatcacctaggcatgccaagggatcttggaatggacaaggaccggacctccggagccgaacttggaaacatcacgttgagcctgtgcatcaagacgtcggccttggatggtatctcgttcaggaggaactgctggacaatcggcttcttaaaccactccagtaccgagtcgccgggtgcccgcaagacgactttgctcacctcaaacggcgactccagcgacgccagcacctgtgccaccaccatcttcagtgtcggcccagtcaccagcttgatgcgccgtggcacaaccccgtagtagagcatccgcttcctgaaccgatgcagtgtgtgcacggtagccacgagagctgcgcccacggataagctcctgacatccagggaccaggcgatgtgctggtcaaaaacgattgccttggcgaacagcttattctcgtaggcgaccttccaaacacagcgggcacggttcatctgccccatgagcaccaggtagttgagcaggacgttcacaaagtacctggctgcactctcctcgttgtcgtagtcgatgccctggaagaactcgcgcacgaaagagagcacgggctgcttccgctgctccggaccagtgaacagcccgcacatgaagtcatgtgctttgtgcttgctggtgcccaggatgtccatgattgtacgctcgctgctctcgtcctggcaccggaccaagtgcgcgaggatggatgtgtagagaatcaagtccaccttggctgccccagcgacataagcctcaagcaacgaccgcgctgagtcatacagccccgtcttcatgcaagactcaaacagctgcctaatgatgaagttgttggtccttatgccagccgaacccatgaaccgtagccaccggagtgcaaggtcagttgacccatccttgatgtagatcatcagcaggtcacttgcggtcacctctatcgggaaacctgacgccttcatctccaacagcacctttgcagccaaatccagcagactcttattcgccagcattgtgagcaacgctgtaaacgtgctaagccctggccttgtccctgaattcgccatggagtgatacaaccgcattgctgcatccacctgccctgcggaggcatgcatttccaccagacaggcatatgtggccggcgtagggaaaaagccagacttctccatgtcaccgaacaacttggcggccatgtccaaccttccagaccgtgcattggcctcgaccaccatcgtgtacaagccaaagcttggtcggagccctcccctcctcatctcctcccaaagctccatcccagcatccagcttcccagatctcaccagtgcctccaccatggcggtgctcactgctgtgcttacccgatgcccgaccaccaccatctctctgtacattcccatggccgcatcaagcctccctgccttggccagcacgtccaccatcaccgaatacacgcccaccggcgcccgcccaattccctccctttgcttcatttcatcgaacatcttgcgggcggcgtcgatcctcccggcgcgcgccagcgcaggcaccgcgagctggtatgtgccctcgtcgagggcgcagcccgaggtcgccatttcgtcgagcacttcgaaggccttgaatgcaagccccctggtgagcaacagagagaggagggcgttgtaggcgggcgtctcgaggcccctgaagctgacgtcgcggaggcgcttgaagcagtagaaggccggctcgagaaggccgtgggtggcgagcgcggagacgacggcgttgaaggtcttggggaaggtggcgaggtcggagagcccgagggtgtcgtcgaagagcgcgaggagttcggaggagtgagttgccggcgggagacgcgcggcgaggagcgaggagaggtcgtcggaggggacgaaccacggctggaggcgcgcccatgcgacaagggagatgagcgggacggggtcggaagccgggagcgaggcggccgcgaggaggagcagcgcggggtctggcggggagggcagtgcggagagcgcggcggagagagtcgcgcccgatcggtgccggagcgcgagcgccgcgaggcgggccgccgctgcggggcgcgggagcgggtgcgcggaggcgccggataggatggtggggtcggcgcccggcacggccggccgcgccccgcgcgccgaggagagcagcgcgcccgactcgtccaggtagtccaccgtgtccgtccactcggggtcgggccgggacgggggcactggtggcggcgactcgaaggagagatgccgcgctatggctaaggagagggagacgccgccaccgccgccgcgaaggcgggcgctgcgcgcgaggccaacgcggagcagcatctcttctccctgtctcactcggtggtttggtcgccgctgccatcaggtggaggtggacattcggcaacggcaagcgcgattcaacggtccagattgcaaaggatcctcccatcccatgaatgacagaatgagcgaggtagcccaaacagaaattttggcccattcgagacggcctactgttgtggtccagtgatccagtctgcgtctctttccccgtcgtggtgggttccgatccaatcgacgtcgacgactccgcagccaccgctcctctcctctcgtcgcttcttctatctctcggcgtcgaatctcatccggccagtgaccacactctactagccgcccggaaggagttcttccgggattcgagccgttgctgccctcacctctgcaggcccagcgtcgagcggagatccaatcggaaattgaactgacttcatcttttgtcgcatcccagtcaggagaagcaatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcagttaatctagtgatcggcttttacatattcatggcgatgaaggagactccacaccaagagccacagccagatcccaccttcctggagaaagccaaagcgagtatcaaccagccaacatcctctcgagtgagtgatgattccaaggggaagggaaaggtcgagtaagctgtagcatgttggcttaggtctcgtgtatgttaagtgcatgttatttaggaggaatagttatgccacaccatcacaaggaccgcaacctttcacaatttatgattttgctgtaaatcttgacagttatggctatggagcaatatgaagttgaaccttttgtacctatttgatttggaaactctgttcaatgttgttttagtcaggatactcatcagaactactgctggttgtattttggtcctttttggttttttggtactccctcctttcttttttatttgtcacgg

SEQ ID NO: 2008 - DNA, 875 bp, Zea mays
gaaattttggcccattcgagacggcctactgttgtggtccagtgatccagtctgcgtctctttccccgtcgtggtgggttccgatccaatcgacgtcgacgactccgcagccaccgctcctctcctctcgtcgcttcttctatctctcggcgtcgaatctcatccggccagtgaccacactctactagccgcccggaaggagttcttccgggattcgagccgttgctgccctcacctctgcaggcccagcgtcgagcggagatccaatcggaaattgaactgacttcatcttttgtcgcatcccagtcaggagaagcaatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcagttaatctagtgatcggcttttacatattcatggcgatgaaggagactccacaccaagagccacagccagatcccaccttcctggagaaagccaaagcgagtatcaaccagccaacatcctctcgagtgagtgatgattccaaggggaagggaaaggtcgagtaagctgtagcatgttggcttaggtctcgtgtatgttaagtgcatgttatttaggaggaatagttatgccacaccatcacaaggaccgcaacctttcacaatttatgattttgctgtaaatcttgacagttatggctatggagcaatatgaagttgaaccttttgtacctatttgatttggaaactctgttcaatgttgttttagtcaggatactcatcagaactactgctggttg

SEQ ID NO: 2009 - DNA, 797 bp, Zea mays
cttttccgtcgtgtcgtggtaggctgtaggcaggcacctccgctcctgtcctcttctctcgtggtaggctgtaggcaggcacctccgctcctgtcctcttctctcgtcgcttcctccgtctctcggcgtcgaatctcctccaaccaccgcgcacactctactcgacgcccggtggaaggagttctccgggatttgagctgtttctgccctcacctccgctaggccggcgtcgagtggagatccaatcggaaatcgaactgacttcatcttctgttgcatccccatcaggataagccatgccaggagtgatcacaaagttcgcggttacatccatggtgatgtggatggccccggttgcgatcgtttatgggttctactaccaggcgtttccaggtgtgagtcggatgtcatcctcgacgcagacactcgccagcgggttcctggctgtcatatcagttaatctggtgatcggcttgtacatattcatggcgatgaaggagactcgacaccaggagccacagccagacccgaccttcctggcaaacgccaaagcgagtatcaaccagccaacatcctctcaaccgagtgatgattccaaggggaagggaaaggttgagtaagccgtagcatgtcatgttgatttttggtcttgtgtatgttaagtgcgtgctgtttaggaggaatagttgtgcgtgcacgccataacacaacatcgcaatctttaaagttcatgattttgctgtaattcttgacagttatggtcatggagcaatgtgaagttgaaacttttgtacgta

SEQ ID NO: 2010 - DNA, 715 bp, Zea mays
  misc_feature (60)..(60): n is a, c, g, or t
ggctgctactcctgcctcccttcgtcttcctctgcctccagaaccagatcgcccccttcngccgacccgcctccagatcggagcaaagcggccccctgtttgcttcgcggcaccagatcagcattcccattaggagaagcaatgtcggcagtaatcacaaagttcgccgtcacatctatggtgatgtggatggccccagttgcaatcatgtatgggtttatctaccagatatttccaggtgtcggtcagctttccccctcggcgcaaaccatggccagtggattccttgctgtcatctcggtcaatctagtgatcggcttttacatatacatggccatgaaggagactccccatcaagagccccagcctgatccaacctttctggcaaacgccaaagcaagcattaaccagccaacttcttctcaagtgagtgatgattcccatgggaaggggaaggtcgagtaggctgtagcgtaacttgagttgggttttatgtccatgatacacatgctatccagagtcagttgggttatgtgcttttgtaatattacgtccttctagtttgatgtagttactgaaaactttcagagttatggaacctatatgaagatgaatctttgtacccattatcagtagatactgtgttaaacctatttaattttgttatgatgttgagaaagactcctgataaggaattcatgtcctataccttcac

SEQ ID NO: 2011 - DNA, 746 bp, Triticum aestivum
  misc_feature (715)..(715): n is a, c, g, or t
attcggcacgaggctcctctctcccctggcttcttcgctgccactcctatccgcctccgcagatcgccccctccgccgacccgcctccagaaccagtcgcctccagatcggtgcgtcggaacgtcctgtttgcttcggggcaccagatcaacattcccatcaggagaagcaatgtcggcagtaatcacaaagttcgccgtcacatctatggtgatgtggatggccccagttgcaatcatgtatgggtttatctaccagatttttccaggtgtcggtcagctttccccctcggcgcaaactatggccagtggattccttgctgtcatctcggtcaatctggtgatcggcttttacatatacatggccatgaaggagactccccatcaagagccacagcctgatccaacctttctggcaaacgccaaagcaagcatcaaccagccaacttcttcgcaagtgagtgatgattcccatgggaaggggaaggtggagtaggccgtagcgtaacttgagttgggttttatgtccatgatacacatgctatccagagtcagttgggttatgtgcttttgtaatattacgtccttctagtttgatgtagttgctggaaactttcagggtgttggaagctatatgaagatgaatctatgtacccattatcagtagatactgtgttcaacctatttaattttgttatgatgttgagaaagactcntgatcataattcaggtcctatacctttacta

SEQ ID NO: 2012 - DNA, 626 bp, Triticum aestivum
acctcccttcgtcttcctctgcctcggaaccagatcgccccctccgccaacccccctccagatcggtgggaaggagcgccctgtttgcttcgctgcaccagatcaagagaagcaatgtcggcagtaatcacaaagttcgccgtcacatctatggtgatgtggatggccccagttgcaatcatgtatgggtttatctaccagatatttccaggtgtcggtcagctttccccctcggcgcaaaccatggccagtggattccttgctgtcatctcggtcaatctggtgatcggcttttacatatacatggccatgaaggagactccccatcaagagccccagcctgatccaacctttctggcaaacgccaaagcaagcattaaccagccaacttcttctcaagtgagtgatgattcccatgggaaggggaaggtggagtaggccgtagcgtaacttgagtggggttttatgtccatgatacacatgctatccagagtcagttgggttatgtagtcactgaaaactttcagagttatggaacctatatgaagatgaatcttttgtacccattatcagtagatactgtgttcaacctatttaattttgttatgatgttgagaaaaaaaaaa

SEQ ID NO: 2013 - DNA, 721 bp, Triticum aestivum
attcggcacgaggctcctctctcccctggcttcttcgctgccactcctatccgcctccgcagatcgccccctccgccgacccgcctccagaaccagtcgcctccagatcggtgcgtcggaacgtcctgtttgcttcggggcaccagatcaacattcccatcaggagaagcaatgtcggcagtaatcacaaagttcgccgtcacatctatggtgatgtggatggccccagttgcaatcatgtatgggtttatctaccagatatttccaggtgtcggtcagctttccccctcggcgcaaaccatggccagtggattccttgctgtcatctcggtcaatctggtgatcggcttttacatatacatggccatgaaggagactccccatcaagagccccagcctgatccaacctttctggcaaacgccaaagcaagcattaaccagccaacttcttctcaagtgagtgatgattcccatgggaaggggaaggtggagtaggccgtagcgtaacttgagtggggttttatgtccatgatacacatgctatccagagtcagttgggttatgtgcttttgtaatattacgtccttctagtttgatgtagttgctggaaactttcagagttttggaagctatatgaagatgtatctttgtacccattatcagtagatactgtgttcaacctatttaattttgttatgatgttgagaaagactcttgatca

SEQ ID NO: 2014 - DNA, 865 bp, Zea mays
cttttccgtcgtgtcgtggtaggctgtaggcaggcacctccgctcctgtcctcttctctcgtggtaggctgtaggcaggcacctccgctcctgtcctcttctctcgtcgcttcctccgtctctcggcgtcgaatctcctccaaccaccgcgcacactctactcgacgcccggtggaaggagttctccgggatttgagctgtttctgccctcacctccgctaggccggcgtcgagtggagatccaatcggaaatcgaactgacttcatcttctgttgcatccccgtcaggataagccatgccaggagtgatcacaaagttcgcggttacatccatggtgatgtggatggccccggttgcgatcgtttatgggttctactaccaggcgtttccaggtgtgagtcggatgtcatcctcggcgcagacactcgccagcgggttcctggctgtcatatcggttaatctggtgatcggcttgtacatattcatggcgatgaaggagactcgacaccaggagccacagccagacccgaccttcctggcaaacgccaaagcgagtatcaaccagccaacatcctctcaaccgagtgatgattccaaggggaagggaaaggttgagtaagccgtagcatgtcatgttgatttttggtcttgtgtatgttaagtgcgtgctgtttaggaggaatagttgtgcgtgcacgccataacacaacatcgcaatctttaaagttcatgattttgctgtaattcttgacagttatggtcatggagcaatgtgaagttgaaacttttgtccgtattcgatttggaaactctgttcattgttattttagttaggatgctcatcggaagcacgtctggttgtat

SEQ ID NO: 2015 - DNA, 684 bp, Hordeum vulgare
cttcgctgctactcctacctccccccttcgtcttcctctgcctccataaccagatcgccacctccgctgacccgcctgcagatcggtggaagggaacgccgtgcttgctccgcggcaccagaccacattcccactaggagaagcaatgtctgcagtaatcacaaagtttgccgtcacatctatggtgatgtggatggcccctgttgcaatcatgtatgggtttatctaccagatttttccaggtgtcggtcagctttccccctcagcgcaaactatggcgagtggattccttgctgtcatctcggtcaatctggtgatcggcttttacatatacatggccatgaaggaggctccccatcaagagccacagcctgatccaacctttctagcaaacgccaaagcaagcattaaccagccaacttcttctcaagtgagtgatgattcccatgggaagggaaaggtggagtaggcagtagcgtaacttgagttgagttttatgtccatgatacacatgctatccagagtcagttgggttatgtgcttttgtaatattacgtccttctagtttgatgtagtcgctgaaaaatttcaggattatggaagctatatgaggatgaatcgttgtacctgttattggtagatactgtgttcagctgttaattttgttatcatgttgacagagac

SEQ ID NO: 2016 - DNA, 678 bp, Hordeum vulgare
tgctactcctacctccccccttcgtcttcctctgcctccataaccagatcgccacctccgctgacccgcctgcagatcggtggaagggaacgccgtgcttgctccgcggcaccagatcacattcccactaggagaagcaatgtctgcagtaatcacaaagtttgccgtcacatctatggtgatgtggatggcccctgttgcaatcatgtatgggtttatctaccagatttttccaggtgtcggtcagctttccccctcagcgcaaactatggcgagtggattccttgctgtcatctcggtcaatctggtgatcggcttttacatatacatggccatgaaggaggctccccatcaagagccacagcctgatccaacctttctagcaaacgccaaagcaagcattaaccagccaacttcttctcaagtgagtgatgattcccatgggaagggaaaggtggagtaggcagtagcgtaacttgagttgagttttatgtccatgatacacatgctatccagagtcagttgggttatgtgcttttgtaatattacgtccttctagtttgatgtagtcgctgaaaaatttcaggattatggaagctatatgaggatgaatcgttgtacctgttattggtagatactgtgttcagctgttaattttgttatcatgttgacagagac

SEQ ID NO: 2017 - DNA, 541 bp, Lolium multiflorum
aagaaagcattcccatcaggagaagcaatgtcgacagtgatcacaaagttcgctgttacgtctatgctgatgtggatggtcccggtggcgatcgtgtatgggtttaaccaccagatctttccgggtgttggtcagctttcgccctcagcgcaaaccttggccagtggattccttgctgtcatctcggtcaacctggtgatcggcttttacatatacatggcgatgaaggagactccccatcaagagccgcagcctgatccgacctttctggcgaacgccaaagcgagcatcaaccagccaacatcttcgcaagtgagtgacgattcccacggaaagggaaaggtggagtaggcagtagggcagcttcacttggttttttgtccccttgatgcacatgctatcaggaatcagttgtgttatgtgcttatgtactattaagcgcgtgcctttagtttggtggatgtagttgctgaattttatgagaactagaggtatattatgatgaatcttgtgtaccagttattactgtgttcaacttgtt

SEQ ID NO: 2018 - DNA, 1303 bp, Hordeum vulgare
caacgtgttccagaacgctctgaatgagaccccgcgaatggcaacaaccataccatttatgagcaagttttgtcagtccccccacccggccggcccgtgacatcgatgtagcagcttcccttcctatttaaccagcgtaccatttgcactacattgcatcacagcaagcacacacagtcacacacacacactctctggagaaatggcgatggctaggacgacggcgctcctcctcgtcgccgcggctctcctggcggcctcatccagcgcatgggaggtgaacatccagatgccggcgtcggcggccgtggacgatgctgtggcaccgctcatccacgcgctgcggccgctcctgggctccggcaagcaagccggcgtggcgtgcgatagctggcggctgggcgtggaggcgtacaacgtgcgggactggaagacggtgccggccaactgcgagggctacgtggggcactacatgctcggcaaccacttccggcgcgactgcaaggtcgtcatcgaccaggccatcgcctacgtcgacggcctcaagctcgccggcaacggcaaggacgtgtgggtcttcgacatcgacgagaccaccctctccaacctcccttactacgccacgcacggctttggggctaggccatacaacgcgacgagcttcgacgcgtacgtgatggaggggagtgcaccggtgctgccggagacgaagcggctctactacaagctactcaaggtgggcatcaagccggtattcatcacaggccggacggaggataagagggccgtcaccgtcgggaacctccgcagccagggcttctccgggtggatgagcctgacgctcaagcaacatgggttcaagggctccgccatatcctacaagtccgccgagaggaagaagctggaggatgccgggtacgtcatcgtcggcaacatcggcgaccagtggagcgacatcctcggcgcgcccgagggcgctcgcaccttcaagctgcctgaccccatgtactacatcgcctaggtcggttgcggctatttgattgccccgtgctcgtggtccacgaataataagaatatagtagactttgttggtttctttgaaaccaagaaggagaacattaatagtaccactttgaacaatattgctggtaataagaattttggcatcaactatctgcccaaaaaacagttggtggtgtccttgtgggcattaatagtgatatctatgagattattggctttgtcaatagaaaattctgtgtgactgctacagttaaaaataatactcacaagattgtctcgc

SEQ ID NO: 2019 - DNA, 913 bp, Triticum aestivum
gcaccaaagagtagctagaaatggcgatggctaggacaccgacgctcctcctcatcgtcgccgcggctctcctcgcggcctcatgcagcgcatgggaggccaacatccggatgccgacgtccgtggacgaggcggtggtggcgccgctgatccacgcgctccggccgctgctgggctccggcaagcacgccggagtggagtgcgacagctgggtgctgggcgtggaggcgcacaacgtgcgggactggaagacggtgcccgccagctgtgagggctacgtcggccactacatgctcggtaagcacttccgccgtgactccaagatcgtcatcgaccaggccgtcgcctacgtcgacagcctcaagctcgccggcaacggcaaggaggtgtgggtcttcgacatcgacgagaccaccctctccaacctcccctactacgccaagcacggcttcggggctacacctttcaacgcgacgagcttcaacgcatatgtgctggaggggagcgcaccagcactaccggagacaaagaggctgtacaacaagctgcgctcggtcggcattaagccggttttcctcaccggacggaccgaggaccagagggccatcaccgtcaccaacctccgccgccaggggatctccgggtggatgaacttgctgctgaagcagcccggcttcaagggctctgctgtgacctacaagtccggcgagaggcaaaaattgcaggacgccgggtacatcatcgtcggcaacatcggcgatcagtggagcgacatcctcggcgcgcccgagggcgcccgtaccttcaagctccccgaccccatgtactacatcggctaggccgggccggttgctgccacctttgattgctcctcggtcctgatccacgattgaataaactccatgctcttaat

SEQ ID NO: 2020 - DNA, 1002 bp, Leymus cinereus x Leymus triticoides
  misc_feature (430)..(430): n is a, c, g, or t
caaagagtagctagaaatggcgatggctaggacgacgacgctcctcctcctcgttgccgcggctctcctcgcggcctcatgcagcgcatgggaggtcgacatccagatgccaacgtcggtcgacgaggccgtggtggcaccgctgatccacgcgctccggccgctgctgggctccggcaagcacgccggagtggagtgcgacagctgggtgctgggcgtggaggcgcacaacgtgcgggactggaagacggtgcccgccagctgcgagggctatgtcggccactacatgctcggcaagcatttccgccgcgactccaaggtcgtcatcgaacaggccctcgcctacgtcgacaccctcaagctctccggcaacggcaaggaggtgtgggtcttcgacatcgacgagaccaccctctccaacctcccctantacgccaagcacggcttcggggctacaccgttcaatgcgacgagcttcaacgcgtacgtgctggaggggagcgcaccggcgctgccggagacgaagcggttgtacaacaagctactctcggtcggtgtcaagccggtgttcctcaccggccgtaccgaagaccagagggccatcaccgtcaccaacctccgccaccagggcatctccgggtggatgaacctcctgctgaagcagcccgggttcaagggttccgcggtgacctacaagtctggtgagaggcagaagctgcaggacgccgggtacatcatcgtgggaaacatcggtgaccagtggagcgacatcctcggcgctccagagggcgcccgcaccttcaagctgcccgaccccatgtactacatcggctagtccacctccagctctggcctggccgccattgattgctcgaataagctctatgctcttaattatatgcaagtttagttggtaattcctccctagttgttgctttgcttggttaatttccattgtcgagaacatgagatcagttgctagtattaataagatgtgttcca

SEQ ID NO: 2021 - DNA, 1227 bp, Triticum aestivum
ttggaattggcgatggctaggacaccgacgctcctcctcatcgtcgccgcggctctcctcgcggcctcatgcagcgcatgggaggccaacatccggatgccgacgtccgtggacgaggcggtggtggcgccgctgatccacgcgctccggccgctgctgggctccggcaagcacgccggagtggagtgcgacagctgggtgctgggcgtggaggcgcacaacgtgcgggactggaagacggtgcccgccagctgtgagggctacgtcggccactacatgctcggtaagcacttccgccgtgactccaagatcgtcatcgaccaggccgtcgcctacgtcgacagcctcaagctcgccggcaacggcaaggaggtgtgggtcttcgacatcgacgagaccaccctctccaacctcccctactacgccaagcacggcttcggggctacacctttcaacgcgacgagcttcaacgcatatgtgctggaggggagcgcaccagcactaccggagacaaagaggctgtacaacaagctgcgctcggtcggcattaagccggttttcctcaccggacggaccgaggaccagagggccatcaccatcaccaacctccgccgccaggggatctccgggtggatgaacttgctgctgaagcagcccggcttcaagggctctgctgtgacctacaagtccggcgagaggcaaaaattgcaggacgccgggtacatcatcgtcggcaacatcggcgatcagtggagcgacatcctcggcgcgcccgagggcgcccgtaccttcaagctccccgaccccatgtactacattggctaggccgggccggttgctgccacctttgattgctcctcggtcctgatccacgattgaataaactccatgctcttaatcatatgcatgcttcgtcaataatcgccccccccccccctcccctccctgttgttgtttggttaatttccattgttgagaacttgagatcaattattatgtacccctccactaatgggccaattttgacccgttggaggaagggatcgtaattggcggaccaccaaacaacggtcgggagagtcaaccaagtgcccacatagaggaacgagaagttgtgcccactgatagtgtacaagtgacgattacgaaattgttcttgtggcttgcatgttgtgtgcatatgtattgtatgtaactttccaataaagttcaaagctggattagaga

SEQ ID NO: 2022 - DNA, 1852 bp, Zea mays
agtagtaccattccactgctgactgctgaaacacaataatagaggcagaagcagaggcagaggcagaggcagagccaagacggttccgttcagtggctggcggcgcatagatagatagccatggcgaagaagccagtggaggaagcgctcctcgcagcggcagacgagcaggagagcctgagcgtgcgcgaggagctgaagaagcagctatggctggctgggcccatgatcgccggcgcgctcctgcagaacgtgatccagatgatctccgtcatgtacgtgggacaccttggagagctgcccctcgctggcgcatccatggccaactccttcgccaccgtcaccggcctcagcctgctgctaggcatggcaagcgctctagacacactgtgcggccaagcgttcggcgcgaggcagtactatctcctgggcatctacaagcagcgcgccatgttcctcctgaccctggtgagcgtccctctgtcagtggtgtggttctacaccggcgagatcctcctcctgttcggccaggacccggacatcgccgcagaggccggcacctacgcccggtggatgatcccgctgctgttcgcgtacggcctgctgcagtgccacgtccggttcctccagacgcagaacatcgtggtgcccgtgatggcgagcgccggcgccgccgcggcctgccacgtcgtcgtctgctgggcgctggtgtacgcgctcgggatgggcagcaagggcgcggcgctcagcaactccatctcctactgggtcaacgtggccgtgctggccgtgtacgtgagggtgtccagcgcctgcaaggagacgtggacgggcttctccacggaggccttccgcgacgcgctcggcttcttcaggcttgcggtcccgtccgctctcatggtctgcttggagatgtggtcgtttgaactcattgtgctcctctcgggccttcttcccaacccaaaactggagacctccgtgctgtcgatcagccttaacactgctgcgttcgtgtggatgatcccctttgggcttagctcagctatcagcactcgcgtgtcgaatgagctgggtgccgggcgtcctcgagccgcccgccttgcggtgcgtgtcgttgtgttgctgtctgtcgccgaagggctaggcgtgggcctcatcctggtgtgcgtgcgctacgtctggggccatgcctacagcaacgtcgaggaggtggtgacgtacgtggccaacatgatgctggtcattgcagtgtccaacttcttcgatggtatccagtgcgtgctttcaggtgtggctagaggctgtggatggcagaagatcggtgcctgcatcaaccttggcgcctactacatcgtcggcatcccctctgcttacctcatagcgttcgtcctgcgtgtcggtgggacgggactctggttgggcatcatatgtgggctcatcgtacagctccttctgctcgcgatcatcactctctgcaccaactgggatagcgaggcaacgaaggcaaagaacagagtgttcaattcttcctctccagcatccggaacgtgaacggattggcggtgaagtaaacggcgagcaaacacggaaactataggagttatgcctgtagttttggaaacttcagcacctctgatcctctccgattttctggctcccacattaactctaatggttagcattgacacttgcagtctggattttgaaacataaatgcgttccttgaacagagtaggaagggaccaatggaaaacttatacaatagtgttagatcgcatgcaacattgtcctccaaagtgacctcatcacacaacaaaacgtgggtaattccaagaccactttttcggtacaa

SEQ ID NO: 2023 - DNA, 1744 bp, Brachypodium distachyon
atggggaacgaaagcgtggaagaagctctcctgcacacggatggcagcggcggccgcctggggctgggagtgggcgaggaagtgaagaagcagctatggctggcggggccgctcatcgccggcgcgctgctgcagaacctgatccagatgatctccgtcatgtacgtcggccacctcggcgagctcgccctcgccggcgcctccatggccagctccttcgcctccgtcaccggcttcagcctcctgcttggaatggcaagtgcactggacactctgtgcgggcaagcattcggagccaggcagtaccatctcctgggcatctacaagcaacgagcaatggtgatcctgaccctggtcagcatcccgctggccgtggtctggttctacacgggcgagatcctgctcctgttcgggcaggaccccgacatcgccgccgaggccggcaccttcgcccggtggatgctcccgatgctcttcgcctacgggctgttgcagtgccacgtccgcttcctgcagacgcagaacatcgtgctcccggtcatggccagcgccggcgcaaccgcggcgttccacctcctcctgtgctggctgctcgtctacgccgccgggatgggcagcaagggcgccgccctcagcaacgccatctcctactggatcaatgtggtcatactggccgtgtacgtcagggtgtcgggttcttgcagcaagacgtggacggggttctccacggaggcatttcatgatgtgctcagcttcttcaggctcgctgttccgtctgcgctcatggtctgcttggaaatgtggtccttcgagctcatagtgctcctttcaggcctccttcccaatccaaagctggagacttccgtgctatctatcagcctcaacactgccgccttcgtgtggatgatcccctttggcctcggctctgccataagcacccgtgtctcaaacgagctcggtgcagggcgccccaacgcggcgcgccttgcggtgcgcatcgtcgtcttcttggccatcgctgaaggactcatcatggggttggtgctcgtctgcgtgcgctacgtgtgggggcatgcctacagcaacgtggaggaagttgtgacttacgttgctaagatgctgctgatcatctcggtgtccaacttcttcgacggtattcagtgtgtcctttcaggagtggctagaggctgtggatggcaaaagattggtgcttggatcaaccttggagcctactacatcgctggcgtcccttcggcttacctcatagcctttgtcttgcatgttggcgggatgggcctttggtttggcatcatctgtggcctgatggtgcaagtcctgctgctcatggccatcaccatatgcacagactgggataaagaggcggcaaaagcgaagaatagagtcttcagttcttctctcccgatagatttcgctacgtgaacaggatgcaattttggcctgtgaagtgaaccaactgggaaacgaaggtcatgccattaatctgggtagtcaaataaacattaaaccagagagcagaatgggctacatgtacgtactggagccttcttatcatggggtaggggttggtgggtatcacctattgttttccaccgcaattgtgaaccctggtccccttgtggatagcaattttgtaaaccggaaacttgggaatggcatgaatggggcagaggagacaagaattgaaaagacaaagacattttagtggatctttcgtaaaactagc

SEQ ID NO: 2024 - DNA, 1487 bp, Sorghum bicolor
atagctagatagccatggcgaagaggccagtagaggaagcgctcctcgcagcggccggtgagcccgaggaggaagagatcctgagcgtgcgtgaggagctgaagaagcagctatggctggctgggcccatgatcggcggcgcgctgttgcagaacgtgatccagatgatctccgtcatgtacgtgggacaccttggggagctgcccctcgccggcgcctccatggctaactccttcgccaccgtcaccggcctcagcctgctgctaggcatggcaagcgctctcgacacactgtgcggccaagctttcggcgccaggcagtactatctcctaggcatctacaagcagcgcgccatgttccttctcaccctcgtcagcctccctcttgctgtcgtctggttctacaccggcgagatcctcctcctgttcggccaggacgcggacatcgccgcggaggccggcacctacgcccggtggatgatcccgctgctcttcgcctacggcctgctgcagtgccacgtccggttcctgcagacgcagaacatcgtggtgcccgtgatggcgagcgccggcgcgacggccgcgtgccacctggtggtgtgctgggtgctggtgtacccgctcggcatgggcagcaagggcgcggcgcttagcaacgccgtctcgtactgggtcaatgtggccattctggccgtgtacgtgagggtttccagcgcgtgcaaggagacgtggaccggcttctccacggaggccttccatgacgcgctcagcttcttcaggctcgcgatcccgtcggctctcatggtctgcttggaaatgtggtcgtttgaactcatcgtgctcctttcgggccttcttcccaacccacaattggagacatccgtgctatcgatcagcctcaacactgctaccatcgtgtggatgatcccctttgggcttggctctgctatcagcactcgcgtgtccaatgagctgggtgcagggcggccacaagccgctcgccttgcggtacgtgtcgtggtcttactggctgtctccgaagggctggccgtgggtctcatcctggtctgcgtgcgctacatctgggggcatgcttacagcaacgtcgaggaggtcgtcacctacgtggcaaagatgatgctggtcattgcagtctccaactttttcgatgggatccagtgcgttctttcaggcgtggctagaggctgtggatggcagaagattggtgcctgcattaaccttggcgcctactatatcgttggcatcccgtctgcatacctctttgctttcgtcatgcgtgttggtgggacgggtctttggttgggcatcatatgtggcctcatggtacaggtccttctgctcatgatcatcacagtctgtaccaactgggataacgagacctctggtgcggccggtgtgctcggcgtttcccaagccaaggctcagctcatccttctctctagaaggggtgaatgtgcccttctctga

SEQ ID NO: 2025 - DNA, 1732 bp, Oryza sativa
gaggaagccaacatggagaaggccagctgcctggaggaagccttgctgctcccggagagttgcaaggaggaggagatcacagcgagcgatgaggtgaagcggcagctgcggctggccgggccgctcatcgccggcagcctgctgcagaacctgatccagatgatctccgtgatgttcgtcggccacctcggcgagctccccctcgccggcgcctccatggccagctccttcgccgccgtcaccggcttcagcctcctgctgggcttggcgagcgcgttggacaccctgtgcggccaggcgttcggcgcgcggcagtaccatctcctgggcgtctacaagcagcgcgccatgctgctgctcaccgccgtcagcgtcccgctcgccgtggcctggtactacaccggcgacatcctcctcctgttcgggcaggacgccgacatcgcggcggaggccggcgcgtacgcccggtggatgatcccggcgctgttcgcctacggcccgctgcagtgccacgtccggttcctgcagacgcagaacatggtggtcccggtcatggcggccgccggcgcggcggcgctgtgccacctgggcgtgtgctgggcgctggtccacgccgccgggatgggcagccgtggcgccgccctcggcaacgccgtgtcgtactggatcaacgtgggcgtactggcggtgtacgtgagggtgtcgaggtcgtgcaagaagacgtggacggggttctccatggaggccttccgtgacccgctaagcttcttcaggctcgccatcccttccgctctcatggtctgcttggaatggtggtcatttgagctcctcgtgctcctgtccggccttcttccgaaccccaagctggaaacatccgtcctatccatcaccctcaacactgcaaactgcctgttcatgatccccttcggcctcggcgctgccataagcacgcgtgtgtcgaacgagctcggcgcgggccgtccacgggccgcccgactcgcggtgcgcgtggtgacgttgttggcgacgctggaagggttgggcatggcgctggtgctggcgtgcgtgcgctacgtgtggggccacgcctacagcaacgaggaggaggtggtcgcgtacgttgccaagatgatgctggttcttgccgtctccaacttcctggacgggattcagtgtgttctctcaggtgtggcgagaggctgcgggtggcagaagatcggcgcatgcatcaacctcggcgcgttctacgtcgtcggcgtcccggcagcctacctcgcggccttcgtcctgcgcgccggcgggttgggcctctggatgggaatcatctgcggcgtcgcggtgcaaaccctgctgttcctggccatcacatcacgcacagactggcaaaaggaggcgaaaatggccaaggatagggttttcagctcatctcttccgaccgatctcgcgacgtgagaggttgcacttcagtcaggagtgttgtctgaaagcaagcaaactgagtgtggtttcagagttagcgtggcgcagtgtgtgaaccatttggaagcgagaagaagcggaagccggaaaaaggtttgtgggaggaggtgattttggctcggatgagagtagcggtggacatagatcgctatattggacatttcaaaaggagtttatactaacaaaaaatatatggctcttgagtcttgattaggtggattttatcatcataatcatagtttaaagagaaaaa

SEQ ID NO: 2026 - DNA, 1023 bp, Arabidopsis lyrata
atggctccgactttgcaaggcgagtggatcaagatggagcagaaaggtggaaaaggaccaggaccaagatgttcacatggcatagccatggtcggagacaagctctacagtttcggtggcgagttaataccaaacatgcacatcgacaaagacctttacgtctttgacttcaacactcacacttggtcaattgctccggctaatggagacccccctcgcatcagctgcttaggtgtccgcatggtggccgtaggaactaagctctatatctttggaggccgtgatgcgaagcgcgctttcaacgacttttactcgtatgacactgtgcaaaaagagtggacgttcttgacaaagcttgatgaggagggaggaccggaggctcgtactttccattcgatgacttcagatgaaaaccacgtatatgtttttggtggggtaagcaaaggcgggttgcagacaaccccgaagcggttcagaacgatagaggcctataatatcgctgatgggggatgggttcagctaccggatcctggagaaaacttcgagaaaagaggaggagcaggatttgctgtggtgcaagggaagatttgggtggtttacgggttcgcaacttcgattattcccggaggaaaaaatgactacgagtctaatgctatacaatactttgatccggcttccggaaaatggacccaagtaaagacaacaggagcaaaaccttctgcgaggagcgtgtttgcgcatgcggtagtcggaaaatatataataatatttggaggtgaggtttggccagacctaaagggacatttagctccagggacgttgtctaatgagggttacgtgttggacactgaaacactggtgtgggataagttggcagaaggaggtgaaccagcgatgccactaggttggacgtcctacaccactgcaaccgtctatggaaagaaaggcctcctcatgcatggaaagctgccgaccaacgagcgaactggtgatctctacttctacgcggtcaattcagcttaa

SEQ ID NO: 2027 - DNA, 1411 bp, Glycine max
ggcatgccagaaaaacagaaaggacatttcacacatggaaaatcccaggaagagaaactgccccttgtcttttgttaccttcaaattcaatccttcgctgtctctctctctctctctcacacacacacacacagacggtgctagctaattctttctattccttccatcatatgcaagcacaagcgtaaccagcgaccttactttcttttcttctttcattacaaaattgtcttgatccttttcattttttcatgtcggtttatttttgaaccccaaaggtagaacctttctttactttttaataattataatgagaagcatagcatcttgttacaacgaacatgcaattagagtgtctgattcatattgctcaaggccttcaacccaggcctatctcggtccaaaacttcacccttccaccagagattctgtaacctgcatgtacaaactcaccctcatcgaaacgcaaaaacaactctttattacgcttacttggtccaagaaactcttgggccaaggcttcaccataaccatcgccaattccgaacactctctttctccctctaaatccaacgcaagacaattgagaaaaatcaaaggcaacgaaacactccaatcccaaaatttcaaagtccaagtcctgtgggatctctccgatgcaaagtacgaggaaggaccagaacccgttggtgcgttttacgtagtcgttttggtggactccgaactgggcctacgccttggcgacaaaaattctttaattgaagaattgttatcaaacctggacgcaaaagaagcgaatttctcgttggtttcacggagcgagacgttttccggcaccgcggtttacgcgacgaaggcgaaattctcggagacgggaatatctcacgagatattgataaagtgcggcgcggaggtggtcgaggggggagaggcgaagaagggtcacgtgttgtccgtgtgcgtggacaagaagacaattttccaggttaagaggctgaggtggaactttcgtgggaaccaaactatttttgtcgatggtttggtcgtggatatgatgtgggacgtgcacgattggcttttcaattcgaattctgcttcatctgcagtgttcatgttcaggacaaggagtggcctcgatagtagattatggttggaggagaagagtttgcacgcgcacaaggaacaggacaaaattggtttctctttgttgatttgtgcctgtaagaacaatgactgattcaatctttttttcacttttaattcatctggattttataggattgaaaaaactgacacctgtttatatttttcttcttcttcttaatcttagtatctgtcgatgatatttggttagtggtcatgtaatcgtgaccctttgaaccagaatagatgaaagtttatagattatatt

SEQ ID NO: 2028 - DNA, 1475 bp, Glycine max
gccccttgtcttttgttaccttcaaattcaatccttcgctgtctctctctctctctctcacacacacacacacagacggtgctagctaattctttctattccttccatcatatgcaagcacaagcgtaaccagcgaccttactttcttttcttctttcattacaaaattgtcttgatccttttcattttttcatgtcggtttatttttgaaccccaaaggtagaacctttctttactttttaataattataatgagaagcatagcatcttgttacaacgaacatgcaattagagtgtctgattcatattgctcaaggccttcaacccaggcctatctcggtccaaaacttcacccttccaccagagattctgtaacctgcatgtacaaactcaccctcatcgaaacgcaaaaacaactctttattacgcttacttggtccaagaaactcttgggccaaggcttcaccataaccatcgccaattccgaacactctctttctccctctaaatccaacgcaagacaattgagaaaaatcaaaggcaacgaaacactccaatcccaaaatttcaaagtccaagtcctgtgggatctctccgatgcaaagtacgaggaaggaccagaacccgttggtgcgttttacgtagtcgttttggtggactccgaactgggcctacgccttggcgacaaaaattctttaattgaagaattgttatcaaacctggacgcaaaagaagcgaatttctcgttggtttcacggagcgagacgttttccggcaccgcggtttacgcgacgaaggcgaaattctcggagacgggaatatctcacgagatattgataaagtgcggcgcggaggtggtcgaggggggagaggcgaagaagggtcacgtgttgtccgtgtgcgtggacaagaagacaattttccaggttaagaggctgaggtggaactttcgtgggaaccaaactatttttgtcgatggtttggtcgtggatatgatgtgggacgtgcacgattggcttttcaattcgaattctgcttcatctgcagtgttcatgttcaggacaaggagtggcctcgatagtagattatggttggaggagaagagtttgcacgcgcacaaggaacaggacaaaattggtttctctttgttgatttgtgcctgtaagaacaatgactgattcaatctttttttcacttttaattcatctggattttataggattgaaaaaactgacacctgtttatatttttcttcttcttcttaatcttagtatctgtcgatgatatttggttagtggtcatgtaatcgtgaccctttgaaccagaatagatgaaagtttatagattatattaattatttgtatcgttgaagtatttttatttttcttgcacgaaacattgttcggctgagatatgtattaaaattgtcagaaacatattctcaccttttatccaaatatgacagtaaatatcta

SEQ ID NO: 2029 - DNA, 2166 bp, Panicum virgatum
ggcgatgctccgccgggccgcggcggcactcgcgctcgcgctcgggctcctcgccgccgcaccggccgccgccttctacctccccggcgtcgcgcccaacgacttccagaagaaagatcaacttttggtgaaggtgaacaagctgacatccacaaagacacaacttccctactcctattactctcttcctttctgcaagccggacacgatagttgacagcgcagagaatcttggagaagttctgcgcggtgatcgcattgagaactccccttatgtgtttgagatgagggagcccaagatgtgccagattgtctgcagagcatcaattgatgataaacaagcaaaggagctcaaggaaaagatagaggatgagtatcgggtgaacatgattcttgacaacctcccgctagttgttcctatcgcaaggcaggacagggatgctattgtttatcagggtggatatcatgttggtgtcaagggccaatatgctggtagcaaggacgagaagttctttatccacaaccacttgacatttttagttaaataccacaaggatgaaactacagaactctctagaattgttggatttgaggtcaaaccattcagtattaaccatcagtttgaaggccaatggaatgataaaaacactcgtttgatcacgtgtgatcctcatgccagcaagcttgtgacaaactcagatactcctcaagaggttgaatctggaaaggaaatcatatttacctatgatgtaggctttgaggagagtgatgtcaagtgggcttctcgctgggacacctacctgttaatgacagatgatcaaattcactggttttccattgtgaactctctcatgatcgtactcttcttatctgggatggtggccatgattatgctccgcactctgtatagagatatctccaggtacaaccagcttgaaactgaagaagaagcccaggaggagacaggatggaagcttgttcatggagatgtgttccgccctcctgtaaactccgacttactctgtgtctgcgttgggactggtgttcagttctttggtatgctgctagtaaccatgattttcgctgttctgggattcctttcgccatcaaaccgaggagggctgatgactgccatgctgctcacttgggtcctgatgggattgtttgctgggtatgcttcttcacgcttctataagatgtttaaaggatcagagtggaagagtatcaccctaaggactgctttcctgttccccggtattgctttcggtattttcttcatcctgaatgctcttatatggggggagaagtcgtctggtgctgttcctttcaccacgatgtttgccttggttctcctttggtttggtatctctgttcctcttgtatttgttggtagctatctgggcttcaagcaacctgccattgaggctccagtgaagactaacaagatcccaagacaggtccctgagcaggcttggtacatgaaccctgccttcaccattcttattggtggcattcttccatttggggcagtcttcattgagctcttcttcatcctcacgtcaatttggcttcaccagttctactacatctttggcttccttttcctggtgttcattatcctcatcatcacctgtgctgagattacgatcgtgctgtgctatttccaactgtgcagtgaggactataactggtggtggaggtcctatctcacctcgggatcatctgcaatctacctcttcctgtatgccgggttctacttcttcacaaagctgcagatcaccaaactggtgtcaggcatactgtactttggctacatgcttctggcctcgtttgcgttctgtgtgctcaccggtacaatcgggttctgcgcctgcttctggttcacgagattgatctactcatctgtgaagatcgactaggtttgctgacatgagactgcagagagtttgctgtgcggttatcatgaaaactgtattttaggtgttaacagcataaacaatttatgtccactgtggttcagagatgaagatgacatacatcgtcactatggagttatgtaaggacgggagtataggacactactgtcagcttcatatggagcatttttttcccttgtattattacaaactactgtataaatttatactcattcataagcatctgtaat

SEQ ID NO: 2030 - DNA, 2413 bp, Setaria italica
gggcccgcgacagtgaggttgtggtgggactcgtcttcttccagtagcgagcggtggactgcgagagggagcgcctccgcctcagatccaccgagtctccgagcccagtctcccccacccacccatgcggacgccggcgatgctccgctgggccacggtggcgctcgtggcgctcctcgccgccgcgccggccgccgccttctatctccccggcgtcgcgcccaacgacttccagaagaaagatccacttttggtgaaggtgaataagctgacatccacaaagacacagcttccctactcctattactctcttcctttctgcaagccaaacacgatagttgacagtgcggagaatcttggagaagttctgcgcggtgatcgcattgagaactccccttatgtgtttgagatgagggagcccaagatgtgccagattgtctgcaaagcatcgattgatgataaacaagcaaaggagctcaaggaaaagatagaggatgagtaccgggtgaacatgatccttgacaacctcccgctagttgttcctataccaaggcaggatagggatgctgttgtttatcagggtggatatcatgttggtgtcaagggccagtacgctggtagcaaggacgagaaggtctttatccacaaccacttgacatttttagttaaataccacaaggatgaaactacagaactctctagaattgttggatttgaggtcaaaccgttcagtattaaccatcagtttgaaggccaatggaatgataaaaacactcgtttgatcacatgcgatcctcatgcgagcaagcttgtgagaagctcagatactcctcaggaggttgaagctggaaaggaaatcatatttacctatgatgttggctttgaggagagcgatgtcaagtgggcttctcgctgggacacgtatctgttaatgacagatgatcaaattcactggttttctattgtgaactctctcatgatcgtactcttcttatctgggatggtggccatgattatgctccgcactctgtatagagatatctccaggtacaaccagcttgaaactgaagaagaagcccaagaagagacaggatggaagcttgttcacggagatgtgttccgacctcctgaaaactctgacttactctgtgtctgcgttgggactggtgttcagttctttggtatgctgctagtaaccatgattttcgctgttttgggattcctttcaccatcgaaccgaggagggctgatgactgccatgctgctcacttgggtcttgatgggattgtttgctggatatgcttcttcacgcttctataagatgtttaaaggatcagaatggaagagtatcaccctaaagactgccttcctgtttcctgggattgctttcagtattttcttcatcctgaatgctcttatatggggggagaagtcgtctggtgctgttcctttcaccacaatgtttgccttggtcctcctatggtttggtatctcagttcctcttgtatttgttgggagctacctgggcttcaagcaacctgccattgaggctccggtgaagactaacaagatcccaagacagatccctgagcagtcttggtacatgaaccctgccttcaccgttcttattggtggcattcttccatttggggctgtctttattgagctcttcttcatcctcacatcgatttggcttcaccagttctactacatctttggcttccttttcctggtgttcattatcctcatcatcacctgtgcggagattacgatcgtgctgtgctatttccaactgtgcagtgaggactataattggtggtggaggtcctatctcacctcaggatcatctgcaatctacctcttcctgtatgccgggttctacttcttcactaagctgcagatcaccaaactggtgtcaggcatactgtactttggctacatgcttctcgcctcgtttgcgttctgtgtgcttaccggtgcaatcggcttctgcgcctgcttctggttcacgagattgatctactcatctgtgaagatcgactaggcttgatcgcatgagactgtacggttttggtgaagcggcctccattttccaccctgtgttttcctggattttcaggaaaactgtattttaggtgttaacagcataaaccatttatgcccactggttaagagctgagatgatacatctgtcagactgtcactatggatttgtggtaaggataggataccactgtcagcttcatatggggcaatttttccttgtattgttatgacttatgaactgctgtataaattcaattcatagctctcactcgtaattgggtgtcatcttgttccacctctgcaatgatgatgtcgataatgtgcttggcttcctctagaaattcttgtgttcagttctaagttgtag

SEQ ID NO: 2031 - DNA, 2387 bp, Sorghum bicolor
gttcagacttcagagttgagacatcatcagaaggacggaccacagcacagagtctctccgtcggtgccagactgccagtggactgcgagtgcgagggagcgcctccgcctcagatccgaacccccccaccgatgcgagctccggcgatgctccgctgggccgcggcggcgctcgtgctcgcggcgctcctcgccgcctcgccggccgccgccttctacctccccggcgtggcgcccaacgacttccacaagaaagatccacttttggtgaaggtgaataagctgacatccacaaagacgcaacttccctactcgtattactctcttccattctgcaagccaaacacgatagttgatagtgcagagaatcttggagaggttctgcgtggtgatcgcattgagaactctccttatgtgtttgagatgggggagcccaagatgtgccagattatctgcagagcaaaaattgacgataaacaagcaaaggagctcaaggaaaagatagaggatgagtatcgggtgaacatgattcttgacaacctcccactagttgttgctattgcaaggcaggataggggtgctcctgtttaccaggctggatatcatgttggtgtcaagggccaatatgctggtaacaaggatgagaagtcctttatccacaaccacttgacatttttagtaaaatatcacaaggatgaaactgcagatctctctagaattgttggatttgaggtcaaaccattcagtatcaatcaccagtttgaagggccgtggaatgataaaaacactcgtttaatcacatgtgatcctcatgccagcaagcttgtggtaaactcagatactcctcaggaggttgaagctggaaaggaaatcatatttacctatgatgtggccttcgaggagagtgatgtcaagtgggcttctcgctgggacacctacctgttaatgacagacgatcaaattcactggttttctattgtgaactctctcatgatcgtactctttttatctgggatggtggccatgattatgctccgcaccttgtatagagatatctctagatacaatcagcttgaaactgaagaagaagcccaagaggagacagggtggaagcttgttcatggagacgtattccgccctcctgcaaactctgacttactctgtgtctgtgttgggactggtgttcagttctttggtatgctgctagtaaccatgatttttgctgttttgggtttcctttcgccgtcaaaccggggaggactcatgactgccatgctgctcacttgggtcttgatgggtttgtttgctggctatgcttcttcacgcctatataagatgttcaaaggatcagaatggaagagcatcaccctaaggactgctttcctgtttcccgggattgcttttggtattttcttcatcctgaatgctcttatatggggggagaagtcgtctggtgccgttcctttcaccacaatgtttgcgttggtcctcctttggtttggtatctcggttcctcttgtatttgttgggagctatctgggcttcaagcaacctgccattgaggctccggtgaagacaaacaagattccaagacaggtccctgagcaggcttggtacatgaaccctgccttcaccattcttattggtggtattcttccgtttggagcagttttcattgagctcttcttcatcctgacatcaatctggcttcaccagttctactacatctttggctttctcttcctggtgttcattatcctcatcatcacctgtgcggagatcacgatcgtgctgtgctatttccagctgtgcagtgaggactacatgtggtggtggaggtcctatctgacctcaggatcatctgcaatctacctcttcctgtatgccgggttctacttcttcactaaactgcagatcaccaaggtggtgtcgggcatactgtactttggctacatgcttcttgcctcgtgtgctttctgtgtgctcactggtgcgatcggcttctgtgcctgcttctggttcacaagattgatttattcatctgtgaagatcgactaggcatgttgcatgagcctgcagagagtatgctgatctgaagcggcctccattttccactgagtttctttttttcctgaattttcaggaaagctgtactttaggtgttagcttataaaccatttatgcccactgtggttcagagttgtataaggatataggacactactgccagcttcatatggggcaatttttcgttcttgagaactgctgtatacgttcaatccatggctcattatcgtctgccacccctttgctacttgtgctacatgatgatgttgatacgtgcttggctagttggcttcatcaagaaatgcttgcattcacttgtac

SEQ ID NO: 2032 - DNA, 2347 bp, Zea mays
ggccggcccgttcaccatttctcatcgttcaattcagaatctgatacatcagagaagggccacagcacagagagagactgtctgccagtggacgcgagggagcgcctccgcctcagatccaacccccaccgatgcgagctccggcgatgctccgctgggccgcggcggcgctcgcggcgctcctcgccgcctcaccggccgccgcgttttacctacccggcgtggcgcccaacgacttccataagaaagatccacttttggtgaaggtgaataagctgacatccacgaagacgcaacttccctactcatattactctcttcctttctgtaaaccaaacacgatagttgacagtgcagagaatcttggagaagttctgcgtggtgatcgcattgagaactctccttatgtgtttgagatgggggaacccaagatgtgccagattatctgcaaagcaaaaattgatgataaacaggcaaaggagcttaaggaaaaaatagaggatgagtatcgggtgaacatgattcttgacaatctcccactagttgttcctattgcaaggcaggataggggtgctactgtttaccaggctggatatcatgttggtgtcaagggccaatacactggtaacaatgatgagaagtcctttatccacaaccacttggcatttttagtaaaataccataaggatgaaactacagatctctctagaattgttggatttgaggtcaaaccattcagtatcaatcaccagtttgaagggccgtggaatgataaaaacactcgtttaatcacatgtgatcctcatgccagcaagcttgtggtaaactcagatactcctcaggaggttgaagccgggaaggaaatcatatttacctatgatgtaggcttcgaggagagtgatatcaagtgggcttctcgctgggacacctacttgttaatgatagatgatcaaattcactggttttctattgtgaactctctcatgatcgtactcttcttatctgggatggtggcaatgattatgctccgcaccctttatagagatatctctaggtacaatcagcttgaaactgaagaagaagcccaagaggagacaggatggaagcttgttcatggagacgtattccgccctcctgcaaactccgacttactctgtgtctgtgttgggactggtgttcagttcttcggtatgctactagtaaccatgatctttgctgttctgggtttcctttcgccatcaaaccggggaggactgatgactgccatgctgctcacttgggtcttgatggggttgttcgccggatatgcttcttcacgcctgtataagatgttgaaaggatcggaatggcggagcatcaccctgaggaccgccttcctgtttcctgggattgctttcggtattttcttcatccttaatgctctaatatggggggagaagtcgtctggcgctgttcctttcaccacaatgtttgctttggtcctcctctggtttggtatctcggttcctcttgtatttgtcgggagctatctgggcttcaagcaacctgccattgaggctccggtgaagacgaacaagatcccaagacaggtccctgagcaggcttggtacatgaaccctgccttcaccattctgattggtggcatacttccgttcggagcagtcttcatcgagctcttcttcatcctgacgtcgatctggcttcaccagttctactacatctttggcttcctgttcctggtgttcattatcctcatcatcacctgtgcggagatcacgatcgtgctgtgctatttccaactgtgcagtgaggactacctgtggtggtggaggtcctttctgacctcaggatcatcagcaatctacctcttcctgtacgccgggttctacttcttcactaagctacagatcactaaggttgtgtcaggcatgctgtactttggctacatgcttcttgcctcgtttgctttctgtgtgctcaccggtacgatcggcttctacgcctgcttctgcttcacaagattgatttattcatctgtgaagatcgactaggcatgttccatgggcctgcagcgagtatgcccattgtgtgttttttttcatgaattttcagtgcagctgtacttttggtgttagcttataaacaatttatgctcactgtggttcagagttgtacaaggataggacactactgctagctttatatggggtaattttaacttgtgctgttgagaactgctgcatacgttcaatccatagtctcgttatcgtctgccacccctttcctgcttcagctgcatgatgatgtccatacgtgcttggcttcatcaagaaaatgttagcttcat

SEQ ID NO: 2033 - DNA, 2290 bp, Zea mays
ggcccgttcaccatttctcatcgttcaattcagagtctgacatatcagagaagggccacagcacagagagtgactgtctgccagcgccagactgccagtggactgcgagggagcgcctccgcctcagatccaaccccaccgatgcgagctccggcgatgctccgctgggccgcggcggcgctcgcggcgctcctcgccgcctcaccggccgccgcgttctatctacccggcgtggcgcccaacgacttccataagaaagatccacttttggtgaaggtgaataagctgacatccacgaagacgcaacttccctactcatattactctcttcctttctgtaaaccaaacatgatagttgacagtgcagagaatcttggagaagttctgcgtggtgatcgcattgagaactctccttatgtgtttgagatgggggaacccaagatgtgccagattatctgcaaagcaaaaattgatgataaacaggcaaaggagctcaaggaaaaaatagaggatgagtatcgggtgaacatgattcttgacaatctcccactagttgttcctcttgcaaggcaggataggggtgctactgtttaccaggctggatatcatgttggtgtcaagggccaatacgctggtaacaatgataagaagtcctttatccacaatcacttggcatttttagtaaaataccacaaggatgaaactacagatctctctagaattgttggatttgaggtcaaaccattcagtatcaatcaccagtttgaagggccgtggaatgataaaaacactcgtttaatcacatgtgatcctcatgccagcaagcttctggtaaactcagatactcctcaggaggttgaagccgggaaggaaatcatatttacctatgatgtaggcttcgaggagagtgatatcaagtgggcttctcgctgggacacctacttgttaatgatagatgatcaaattcactggttttctattgtgaactctctcatgatcgtactcttcttatctgggatggtggcaatgattatgctccgcaccctgtatagagatatctctaggtacaatcagcttgaaactgaagaagaaacccaagaggagacaggatggaagcttgttcatggagacgtattccgccctcctgcaaactctgacttactctgtgtctgtgttgggactggtgttcagttcttcggtatgctgctagtaaccatgatctttgctgttctgggtttcctttcaccatcaaaccggggaggactgatgactgccatgctgctcacttgggtcttgatggggttgtttgctggatatgcttcttcacgcctgtataagatgttgaaaggatcagaatggaagagcatcaccctgaggaccgccttcctgtttcctgggattgctttcggtattttcttcgtccttaatgctctaatatggggggagaagtcgtctggcgctgttcctttcaccacaatgtttgccttggtcctcctctggtttggtatctcggttcctcttgtatttgtcgggagctatctgggcttcaagcaacctgccattgaggctccggtgaagacgaacaagatcccgagacaggtccccgagcaagcttggtacatgaaccctgccttcaccattctgattggtggcatacttccgttcggagcagtcttcatcgagctcttcttcatcctgacgtcgatctggcttcatcagttctactacatctttggcttcctgttcctggtgttcattatcctcatcgtcacctgtgcggagatcacaatcgtgctgtgctatttccaactgtgcagtgaggactacctgtggtggtggaggtcctttctgacttcaggatcatcagcaatctacctcttcctgtatgccgggttctacttcttcactaagctgcagatcactaaggtggtgtcgggcatgctgtactttggctacatgcttcttgcctcgttcgctttctgtgtgctcaccggtacgatcggcttctacgcctgcttctgcttcacaagattgatttattcttctgtgaagatcgactaggcatgttccatgggcctgcagcgagtatgcccattgcgtttttttcatgaattttcagtgcagctgtacttttggtgttagcttataaaccatttatgctcactgtggttcagagttgtacaaggataggacactactgctagctttatatggggtaattttaacttgtgctgttgagaactgctgcatacgttcaatccatagtctcgttatcgtctgccaccccttt

SEQ ID NO: 2034 - DNA, 2266 bp, Zea mays
tcatcgttcaattcagagtctgacatatcagagaagggccacagcacagagagtgactgtctgccagcgccagactgccagtggactgcgagggagcgcctccgcctcagatccaaccccaccgatgcgagctccggcgatgctccgctgggccgcggcggcgctcgcggcgctcctcgccgcctcaccggccgccgcgttctatctacccggcgtggcgcccaacgacttccataagaaagatccacttttggtgaaggtgaataagctgacatccacgaagacgcaacttccctactcatattactctcttcctttctgtaaaccaaacatgatagttgacagtgcagagaatcttggagaagttctgcgtggtgatcgcattgagaactctccttatgtgtttgagatgggggaacccaagatgtgccagattatctgcaaagcaaaaattgatgataaacaggcaaaggagctcaaggaaaaaatagaggatgagtatcgggtgaacatgattcttgacaatctcccactagttgttcctcttgcaaggcaggataggggtgctactgtttaccaggctggatatcatgttggtgtcaagggccaatacgctggtaacaatgataagaagtcctttatccacaatcacttggcatttttagtaaaataccacaaggatgaaactacagatctctctagaattgttggatttgaggtcaaaccattcagtatcaatcaccagtttgaagggccgtggaatgataaaaacactcgtttaatcacatgtgatcctcatgccagcaagcttctggtaaactcagatactcctcaggaggttgaagccgggaaggaaatcatatttacctatgatgtaggcttcgaggagagtgatatcaagtgggcttctcgctgggacacctacttgttaatgatagatgatcaaattcactggttttctattgtgaactctctcatgatcgtactcttcttatctgggatggtggcaatgattatgctccgcaccctgtatagagatatctctaggtacaatcagcttgaaactgaagaagaaacccaagaggagacaggatggaagcttgttcatggagacgtattccgccctcctgcaaactctgacttactctgtgtctgtgttgggactggtgttcagttcttcggtatgctgctagtaaccatgatctttgctgttctgggtttcctttcaccatcaaaccggggaggactgatgactgccatgctgctcacttgggtcttgatggggttgtttgctggatatgcttcttcacgcctgtataagatgttgaaaggatcagaatggaagagcatcaccctgaggaccgccttcctgtttcctgggattgctttcggtattttcttcgtccttaatgctctaatatggggggagaagtcgtctggcgctgttcctttcaccacaatgtttgccttggtcctcctctggtttggtatctcggttcctcttgtatttgtcgggagctatctgggcttcaagcaacctgccattgaggctccggtgaagacgaacaagatcccgagacaggtccccgagcaagcttggtacatgaaccctgccttcaccattctgattggtggcatacttccgttcggagcagtcttcatcgagctcttcttcatcctgacgtcgatctggcttcatcagttctactacatctttggcttcctgttcctggtgttcattatcctcatcgtcacctgtgcggagatcacaatcgtgctgtgctatttccaactgtgcagtgaggactacctgtggtggtggaggtcctttctgacttcaggatcatcagcaatctacctcttcctgtatgccgggttctacttcttcactaagctgcagatcactaaggtggtgtcgggcatgctgtactttggctacatgcttcttgcctcgttcgctttctgtgtgctcaccggtacgatcggcttctacgcctgcttctgcttcacaagattgatttattcttctgtgaagatcgactaggcatgttccatgggcctgcagcgagtatgcccattgcgtttttttcatgaattttcagtgcagctgtacttttggtgttagcttataaaccatttatgctcactgtggttcagagttgtacaaggataggacactactgctagctttatatggggtaattttaacttgtgctgttgagaactgctgcatacgttcaatccatagtctcgttatcgtctgcca

SEQ ID NO: 2035 - DNA, 2143 bp, Zea mays
atgcaccgctgggccgcggcggcgctcgcagcgttcctcgttgccttgccggctgccgccttctacctccctggcgtggcgcccaatgacttccacaaaaaagatccacttttggtgaaggtgaataagctgacatcaacaaagacacaacttccctactcgtattactctcttcctttttgcaagccaaacatgatagttgacagtgcagagaatcttggagaagttctgcgtggtgatcgcattgagaactctccttatgtgtttgagatgggggagcccaagatgtgccagattatttgcaaaacaaaaattgatgataaacaaacaaaggagctcaaggaaaagatagaggatgagtatcgggtgaacatgattcttgacaacctcccactagttgtttctattgcaaggcaggataggggtgctactgtttaccaggctgggtgtcaagggccaatatgctggtaacaaggatgagaaatcctttatccacaaccacttgacatttttagtgaaataccacaaggatgaaactacagatctctctagaattgttggatttgaggtcaagccattcagtatcaaccaccagtttgaagggccgtggaatgataaaaccactcgtttaatcacatgtgaccctcatgccagcaagcttgtggtaaactcagatactcctcaggaggttgaagctggaaaggaaatcatatttacctatgatgtgggcttcgaggagagtgatgtcaagtgggcttctcgctgggacacatacctgttaatgacagatgatcaaattcactggttttctattgtgaactctctcatgatcgtactcttcttatctgggatggtggccatgattatgctccgcaccctgtatagagatatctctagatacaatcagcttgaaactgaagaagaagcccaagaggagacagggtggaagcttgttcatggagatgtattccgacctcctgcaaactctgatttactctgtgtctgtgttgggactggtgttcagttctttggtatgctgctagtaaccatgatttttgctgttttgggttttctttcgccatcaaaccggggaggactgatgactgccatgctgctcacttgggtcttgatggggttgttcgctggctatgcttcttcacgcctatataagatgttcaaaggatcagaatggaagagcatcaccctaaggaccgctttcctgtttcccgggattgctttcggtattttcttcattctgaatgctcttatatggggggagaagtcgtctggtgctgttcctttcaccacaatgtttgccttggtcctcctttggtttggtatctcggttcctcttgtatttgttgggagctatctgggtttcaagcaacctgccatcgaggctccggtgaagacaaacaagatccccagacaggtccccgagcaggcttggtacatgaaccctgccttcaccattcttattggtggtattcttccgttcggagcagttttcattgagctcttcttcatcctgacatcaatctggcttcaccagttctactacatctttggctttctcttcctggtgttcattatcctcatcatcacctgtgcggagatcacgatcgtgctgtgctatttccaactgtgcagcgaggactacatgtggtggtggaggtcctatctcacatcaggatcatctgcaatctacctcttcctgtatgcggggttctacttcttcactaagctgcagatcaccaaggtggtgtcggggatactatactttggttacatgcttcttgcctcgtttgccttctgtgtgctcaccggtacgatcggcttttgcgcttgcttctggttcacaagattgatttattcgtctgtgaagatcgactaggcaagttgcacgaccttgcagagtatgctgatctgaagcggcctccattttccactgttttttttcctgatttttcaggaagctgtactttagcttgtgaaccatttatgcccactatggttcagacttgagttgtataaggataggacactactgtcagcttcatatggggttaattttccttgtctttgagaactgctgtatacgttcaatccatggctcattaccgtctgccacccaatttctacc

SEQ ID NO: 2036 - DNA, 2376 bp, Avena sativa
gtcccttcccagcgagcgcgcgggtcgtcgcctcagcggatccaccagccagcctcccgtcccagatcccgcgcccagatgcgggcgacggcgatgctccggtgggctctggccgcggcggcgctcgcggcgctgctctgcgccccgccggccgccgccttctacctccccggcgtcgccccgaccgacttcggcaagggagatgacctcatggtgaaggtgaataagctgacatcaatcaaaacacagctcccctacacgtattactcccttcctttctgtaagccgaacaccatagttgacagcgctgaaaatcttggcgaggttcttcgtggtgatcgaattgagaactccccttacgccttccaaatgagggagcccaagatgtgccaaattgtttgcaaattaactgtcactgagaaagaagcaaaggagctcaaggaaaagattgaggacgagtatcgcgtgaacatggttcttgacaatctgccactagttgttccagttacaaggcaagataagaacactatcgcttatcaaggtggctatcatgttggtgtcaagggccagtatgctggaagcaaggaggagaagcacttcatccacaaccatttgtcatttttagttaagttccacaaggatgatgaatcagaactttctaggatagtgggatttgaggtcaaaccatacagcatcaagcatcagttcgagggcaaatggaacgaagcaaacactcgtttgagcacatgcgatcctcatgataacaagattgtgacgaattctgaaactcctcaggaggttgaagttggcaaagatatcatattcacctatgatgttcgctttgaggagagtgatatcaagtgggcatcccggtgggacacctatctgttgatgtctgatgatcagattcactggttttctattgttaactctctcatgatcgtgcttttcctatctggtatggtggccatgatcatgatgcgcactctgtatagagatatatcaaggtacaaccagcttgaaactcaggaagaggcacaggaggaaactggctggaagcttgttcatggagatgttttccgccctccagtcaactctgatttgctctgcgtttatgtcggcaccggagtccagttctttggcatgctgctagttacgatgatctttgctgtcctgggtttcctgtctccatcgaaccggggaggactgatgaccgcaatgcttcttgtctgggtcctgatggggctgcttgctggttattcttcttcacgactgtacaagatgttcaagggttcagagtggaagcagataaccctgcgcacggctttcctattcccggggatcgcttttgtcattttcttcatcttgaatgccctgatctggggggagaagtcatctggtgctgttcctttcaccaccatgttcgcattggtcctcctgtggtttggcatctcggtgcccctcgtgtttgtcgggagctatctcgggttcaagaaacccgccatggaacctccagtgaaaaccaacaagatcccacgacaggtccctgagcaggcctggtacatgaacccgctcttcacgatcctgatcggcggcatcctgccattcggcgcggtcttcatcgagctcttcttcatcctgacctccatctggctgcaccagttctactacatcttcggcttcctcttcctggtgttcgtcatcctcatcatcacctgcgctgagatcacggtggtgctctgctacttccagctgtgcagcgaggactacaactggtggtggaggtcctacctgacctcgggatcctccgcgctgtacctcttcctgtacgctgggttctacttcttcacgaagctgcagatcagcaagctggtgtcgggcatcctgtacttcgggtacatgctgcttgcctccttctccttcttcgtgctcaccgggacgatcggcttctgcgcctgcttctggttcacaaggctgatctactcgtccgtgaagattgactagtcgccggagccgcaagacaggaggagcatagcatcatatgttttgaggttttgggtcgagataactgtatgattaaggtgaaagcaagcggggatcaccccccagaatttttttatatatccagtctcttatcaggaaaagatacattttgggatttagtttatgcatgattcaagttaattgtggtcaggtgatacatgtgagttacaagggtagatgagtgagtacactgggatgtagccgtctcttttcacagaattttatgagccagtgtattataagattcaattgattacgaccggtatatttcttgttttgtgttcaccctgatggtgacaatttgatcaatgtattttagaatcataataattt

SEQ ID NO: 2037 - DNA, 2394 bp, Avena sativa
gtcccttcccagcgagcgcgcgggtcgtcgcctcagcggatccaccagccagcctcccgtcccagatcccgcgcccagatgcgggcgacggcgatgctccggtgggctctggccgcggcggcgctcgcggcgctgctctgcgccccgccggccgccgccttctacctccccggcgtcgccccgaccgacttcggcaagggagatgacctcatggtgaaggtgaataagctgacatcaatcaaaacacagctcccctacacgtattactcccttcctttctgtaagccgaacaccatagttgacagcgctgaaaatcttggcgaggttcttcgtggtgatcgaattgagaactccccttacgccttccaaatgagggagcccaagatgtgccaaattgtttgcaaattaactgtcactgagaaagaagcaaaggagctcaaggaaaagattgaggacgagtatcgcgtgaacatggttcttgacaatctgccactagttgttccagttacaaggcaagataagaacactatcgcttatcaaggtggctatcatgttggtgtcaagggccagtatgctggaagcaaggaggagaagcacttcatccacaaccatttgtcatttttagttaagttccacaaggatgatgaatcagaactttctaggatagtgggatttgaggtcaaaccatacagcatcaagcatcagttcgagggcaaatggaacgaagcaaacactcgtttgagcacatgcgatcctcatgataacaagattgtgacgaattctgaaactcctcaggaggttgaagttggcaaagatatcatattcacctatgatgttcgctttgaggagagtgatatcaagtgggcatcccggtgggacacctatctgttgatgtctgatgatcagattcactggttttctattgttaactctctcatgatcgtgcttttcctatctggtatggtggccatgatcatgatgcgcactctgtatagagatatatcaaggtacaaccagcttgaaactcaggaagaggcacaggaggaaactggctggaagcttgttcatggagatgttttccgccctccagtcaactctgatttgctctgcgtttatgtcggcaccggagtccagttctttggcatgctgctagttacgatgatctttgctgtcctgggtttcctgtctccatcgaaccggggaggactgatgaccgcaatgcttcttgtctgggtcctgatggggctgcttgctggttattcttcttcacgactgtacaagatgttcaagggttcagagtggaagcagataaccctgcgcacggctttcctattcccggggatcgcttttgtcattttcttcatcttgaatgccctgatctggggggagaagtcatctggtgctgttcctttcaccaccatgttcgcattggtcctcctgtggtttggcatctcggtgcccctcgtgtttgtcgggagctatctcgggttcaagaaacccgccatggaacctccagtgaaaaccaacaagatcccacgacaggtccctgagcaggcctggtacatgaacccgctcttcacgatcctgatcggcggcatcctgccattcggcgcggtcttcatcgagctcttcttcatcctgacctccatctggctgcaccagttctactacatcttcggcttcctcttcctggtgttcgtcatcctcatcatcacctgcgctgagatcacggtggtgctctgctacttccagctgtgcagcgaggactacaactggtggtggaggtcctacctgacctcgggatcctccgcgctgtacctcttcctgtacgctgggttctacttcttcacgaagctgcagatcagcaagctggtgtcgggcatcctgtacttcgggtacatgctgcttgcctccttctccttctttgtgctcaccgggacgatcggcttctgcgcctgcttctggttcacaaggctgatctactcgtccgtgaagattgactagtcgccggagccgcaagacaggaggagcatagcatcatatgttttgaggttttgggtcgagataactgtatgattaaggtgaaagcaagcggggatcaccccccagaatttttttatatatccagtctcttatcaggaaaagatacattttgggatttagtttatgcatgattcaagttaattgtggtcaggtgatacatgtgagttacaagggtagatgagtgagtacactgggatgtagccgtctcttttcacagaaattttatgagccagtgtattataagattcaattgattacgaccggtatatttcttgttttgtgttcaccctgatggtgacaatttgatcaatgtattttagaatcataataatttatgaatagtgtggcctc

SEQ ID NO: 2038 - DNA, 2442 bp, Oryza sativa
caagctttcttcctcctccgcgcgcgggtcgtcgccgtcgccgccgcccccgccgcatcgccgccgccgcgctcagatccagacccctgagacatggtctctcgccgagcgatgcgagcgccggagatgctccggtggctcgccgcggcggcggcgctcgtggctctgctcgccgccgcgccggccgccgggttctacctgcccggcgtcgcccccaccgacttcgggaagggtgattcacttcccgtgaaggtgaataagctgacatcagtaaaaactcaactaccctatgcatattactcccttcctttctgcaagccagaaactatcgttgacagtgctgaaaatctcggtgaggttcttcgtggtgatcgcattgagaactctccatatgtgtttcaaatgagagagcccaagatgtgccagattgtctgcaaattaactgttggtgagaaagaagcaaaggagctcaaggaaaagatagaggatgaatatcgtgtgaacatgattcttgacaatctcccgctagttgtttctgtgttaaggcaagataagaacattgcttaccaaggtggctatcatgttggtgtcaagggccagtacaccggaagcaaggaagagaagtacttcattcacaaccatttgtcatttttagtgaagtaccacaaggacgatgattcagaactttctagaatagtgggatttgaggtcaagccatacagcattaagcatcagcttgatgataaatgggatggcgtgaacactcgcctgagcacatgtgaccctcatgctaacaagcttgtaacaagttctgactctcctcaggaggtcgaagctggcaaagaaatcatattcacctatgatgttcactttgaggagagtgacatcaagtgggcttcccgttgggacacctatctgttgatgactgatgatcagattcactggttttctattgtcaactctctcatgatcgtgcttttcctgtctggtatggtcgcaatgataatgcttcgcactctatatagagatatctctagatacaaccaacttgaaactcaagaagaagcgcaagaggaaactggctggaagcttgttcatggagatgtgttccgccccccaaccaactctgatttactctgcgtttatgttggtactggtgtccaattcttcggcatgctgctggttacgatgatttttgcagttctgggtttcctttctccatcaaatcggggaggattgatgaccgcgatgcttcttgtctgggtcttgatggggttgcttgctggttatgcttcttcacgcctctacaagatgttcaagggttcagagtggaagagaataactatgcgcacagccttcttatttccagggattgcttttgttatcttcttcatattgaatgctcttatttggggggagaagtcatctggtgccgtccctttcaccactatgttcgccttggtcctcctttggtttggtatctcagtgcctcttgtgttcgttgggagctatcttggattcaaaaaacctgccctggaacctccagttaaaaccaacaagattccaaggcagatccccgagcaagcttggtacatgaatccaatcttcactattctaattggtggcattctaccatttggtgctgttttcattgagctattcttcatcctcacctctatctggcttcaccaattctactatatctttggcttcctcttcctcgtctttgttatcctcatcatcacctgtgccgagattacggtcgtgctctgctatttccaactgtgcagtgaggactacatgtggtggtggagatcttacctcacttcgggatcctcagcactttatctcttcttatatgctgctttctacttcttcacgaagctgcagattactaagctggtgtctggcatcttgtactttgggtacatgttgcttgcttcattagcgttctttgtgcttactggtactatcggtttctgcgcttgtttctggttcacgaggttgatttactcatctgtgaagattgattagttgcaacactacagagcacagcatatgtttttaagccttctgagtcatgggaattgtatgttcgaagtggggatcaatcccctgggtttttttaaagaaattttcagtgaagttacattttaggttttagtttatgaacaatttatgtttgttatggctaaacgatacatcttactgtagtaatttggagtacaagactacaaggatagaacacattgtgatggagttgttttttggtgaaatttttttaatggactggtataagaattcaattgattatgaactgcttgtactctaatcaatggtattattgactctggcaccagtatgaaatcaatatgatgtaccagtaacaatttaatcactgttatattattagaatgaaatgtcccttttgctttcaagtac

SEQ ID NO: 2039 - DNA, 2231 bp, Triticum aestivum
ctccggtgggccgccgccgggctcgccctcgtcgcgctcctcgccgccgcgccccccgccgccgccttctacctccccggcgtcgcccccaccgacttcggcaagggagatgaactgttggtgaaggtgaacaagctgacatcaataaagactcagctaccctacacatattattcccttcctttctgcaagccgaataccatagttgacagcgctgaaaaccttggtgaggttctccgtggtgatcgaattgagaactctccttacgtgtttcaaatgagagagcccaagatgtgccagattatctgcaaaataactgttactgagaaagaagcaaaggagctcaaggagaagattgaggatgaatatcgtgtcaacatggttcttgacaatctgccactggttgttccagttcaaaggccagataggaacactgtcgcctaccaaggtggatatcatgttggtgtcaagggccagtatgctggaagcaaggatgagaagcacttcatccacaaccatttgtcattttcggttaagtttcacaaggatgatgattcagaactttctaggatagtgggatttgaggtcaaaccattcagcatcaagcatcagtttgatgggaattggaatgacgcaaacactcgtttgaccacatgtgatcctcataacagcaagtttgtagtaaattctgaaactcctcaggaggttgaggtcggcaaagatatcatattcacctatgatgttcgctttgaggagagtgaaattaagtgggcatctcgatgggacacctatctgttgatgtctgatgatcagattcactggttctctatcgttaactctctcatgatcgtgcttttcctatctggtatggtggccatgatcatgatgcgcaccctgtacagagatatatctaggtacaaccagcttgaaactcaagaggaggcacaggaggaaactggctggaagcttgtccacggagatgttttccgccctccagtcaactctgatttgctttgcgtctttgttggcactggagtccaattctttggcatgctgctggttacgatgatctttgctgttctgggtttcctctctccatcgaaccgtggaggattgatgactgcaatgcttctcgtctgggtcctgatggggttgattgctggctattcttcttcacgactctacaagatgttcaagggtgcagagtggaagcagataaccctgcgcacggctttcctgtttccagggattgcctttgttatcttcttcatcttgaatgcccttatatggggggagaagtcatccggtgctgtcccattcaccaccatgtttgccctggtcctcctctggttcggcatctcagtgcccctcgtgtttgttgggagctacctcgggttcaagaagcccgccatggagcctccagtgaagaccaacaagatcccgcgtcagatccccgagcaagcctggtacatgaacccgctcttcaccatcctgatcggcggcatcctgccgtttggcgcggtcttcatcgagctcttcttcatcctcacctcgatctggctgcaccagttctactacatctttgggttcctcttcctggtgtttgtgatcctcatcatcacgtgcgcggagatcaccatcgtgctctgctacttccagctgtgcagtgaggactacaactggtggtggaggtcgtacctcacctcgggatcatcggcgctctacctcttcctgtacgctgggttctacttctggaccaagctgcagatcagcaagctggtgtcgggcatcctctacttcgggtacatgctgctcgcctccttctccttctttgtgctcaccggaaccatcggcttctgcgcctgcttctggttcacgaggatgatctactcgtccgtgaagatcgattagtcgctggaagcacagcaggcagagacagagacagaagcatagcatatgttttcagctttcgcggtcagaggtgataattgtatgattaaggtgaaggtggggatcatccccgtgtttgttactcttttgagggaaaagttacattttgggattagtttatgaactgatgatttatgtttattgttgtggtcacaagtgatgatacttgttagtgataaatgttggagttacaagggtagaatacaatacactgtgatggagttgtctgttttggcagaatttaatggatcagcgtataaaattcaatttatatttcatga

SEQ ID NO: 2040 - DNA, 2442 bp, Triticum aestivum
ggaagcttctctacttccctccgccccacccgcctgccttcccagccagcgcgcggtttggtcgtcgcctcctcctcctcctcgccgatccatcccagatccacgccaccgcgcggatccccgatgcgggcgccggcgatgctccggctggccgccgccgggatcgccctcgtcgcgctgctcgccgccgcgccccccgccgccgccttctacctccccggcgtcgcccccaccgacttcgccaagggagatgaactgttggtgaaggtgaacaagctgacatcaataaagactcagctaccctacacgtattactcccttcctttctgcaagccgaataccatagttgacagctctgaaaaccttggcgaggttctccgtggtgatcgaattgagaactccccttacgtgtttcaaatgagagagcccaagatgtgccagattatctgcaaaataactgttactgagaaagaagcaaaggagctcaaggagaagattgaggatgaatatcgtgtgaacatggttcttgacaatctgccactggttgttccagttcaaaggccagataggaacactgtggcctaccaaggtggatatcatgttggtgtcaagggccagtatgctggaagcaaggatgagaagcacttcatccacaaccatttgtcattttcggttaagtttcacaaggatgaggattcggaactttctaggatagtgggatttgaggtcaaaccattcagcatcaagcatcagtttgatgggaattggaatgacgcaaacactcgtttgaccacatgtgatcctcataacagcaagtttgtagtaaattctgaaactcctcaggaggttgaggtcggcaaagatatcatattcacctatgatgttcgctttgaggagagtgaaattaagtgggcatctcgatgggacacctatctgttgatgtctgatgatcagattcactggttctctatcgttaactctctcatgatcgtgcttttcctatctggtatggtggccatgatcatgatgcgcaccctgtacagagatatatctaggtacaaccagcttgaaactcaagaggaggcacaggaggaaactggctggaagcttgtccacggagatgttttccgccctccagtcaactctgatttgctctgcgtctttgttggcactggagtccaattctttggcatgctgctggttacgatgatctttgctgttctgggtttcctctctccatcgaaccgtggaggattgatgactgcaatgcttctcgtctgggtcctgatggggttgattgctggctattcttcttcacgactctacaagatgttcaagggtgcagagtggaagcagataaccctgcgcacggctttcctgtttccagggattgcctttgttatcttcttcatcttgaatgcccttatatggggggagaagtcatccggtgctgtcccattcaccaccatgtttgccctggtcctcctctggttcggcatctcagtgcccctcgtgtttgttgggagctacctcgggttcaagaagcccgccatggagcctccagtgaagaccaacaagatcccgcgtcagatccccgagcaagcctggtacatgaacccgctcttcaccatcctgatcggcggcatcctgccgtttggcgcggtcttcatcgagctcttcttcatcctcacctcgatctggctgcaccagttctactacatcttcgggttcctcttcctggtgtttgtgatcctcatcatcacgtgcgcggagatcaccatcgtgctctgctacttccagctgtgcagcgaggactacaactggtggtggaggtcgtacctcacctcggggtcgtcggcgctgtacctcttcctgtacgctgggttctacttctggaccaagctgcagatcagcaagctggtgtcgggcatcctctacttcgggtacatgctgctcgcctccttctccttctttgtgctcaccggaaccatcggcttctgcgcctgcttctggttcacaaggatgatctactcgtccgtgaagatcgattagtcgctggaagcacagcaggcagagacagagacaaagcatagcatatgttttcagctttcgcggtcagaggtgataattgtatgattaaggtgaaggtggggatcatccccgtgtttgttactcttttgagggaaaagttacattttgggattagtttatgaactgatgatttatgtttattgttgtggtcacaagtgatgatacttgttagtgataaatgttggagttacaagggtagaatacaatacactgtgatggagttgtctgttttggcagaatttaatggatcagcgtataaaattcaatttatatttcatgaaaaaaaaaaaaaaacctgcccgggcggccgctcgaaatcactagtgaattcgcggccgcctgcaggtcgac

SEQ ID NO: 2041 - DNA, 2387 bp, Hordeum vulgare
acgcgtccgccacccacccgcccttcccagccagcgcgcggtttggtcgtcgcctcctcctcctcgccgatccacccgcccgtcccagatccacgccaccgcgcggatccccgatgcgggcgccggcgatgctccggtgggccgccgccggcctcgccctcctcgcgctgctcgcccccacgcccgccgccgccttctacctccccggcgtcgcccccaccgacttcgcaaaggaagatgaactgttggtgaaggtgaacaagctgacatcaataaagactcagctcccctacacgtattactcccttcctttctgcaagccgaataccatagttgacagtgctgaaaaccttggtgaggttctccgtggtgatcgaattgagaactccccttatgtgttccaaatgagagagcccaagatgtgccagattatctgcaaaataactgtcacggagaaagaagcaaaggagctcaaggagaagatcgaggatgaataccgcgtgaacatggttcttgacaatctgccactggttgttccagttcaaaggccagataggaatactgtcgcctaccaaggtggatatcatgttggtgtcaagggccagtacgctggaagcaaggatgagaagcactttatccacaaccatttgtcattttcggttaagtttcacaaggatgaggattcagaactttctaggatagtgggatttgaggtcaaaccatacagcatcaagcatcagtacgatgggaattggaatgacgcaaacactcgtttgagcacatgtgatcctcataacagcaagtttgtaataaattctgaaactcctcaggaggttgaggtcggcaaagatatcgtattcacctatgatgttcgctttgaggagagtgaaattaagtgggcatctcgatgggacacctatttgctgatgtctgatgatcagattcactggttctctattgttaactctctcatgatcgtgcttttcctatctggtatggtagccatgatcatgatgcgcaccctgtacagagatatatctaggtacaaccagcttgaaactcaagaggaggcacaggaggaaactggctggaagcttgtccatggagacgttttccgccctccagttaactctgatttgctctgcgtctttgttggcactggagtccaattctttggcatgctgctggttacgatgatctttgctgttctgggtttcctctctccatcgaaccgtggaggattgatgactgcaatgcttctcgtctgggtcctaatggggttgattgctggctattcttcttcacgactctacaagatgttcaagggtgcagagtggaagcagataaccctgcgcacggctttcctgtttccagggattgctttcgtcatcttcttcatcttgaatgcccttatatggggggagaagtcatctggtgccgtcccattcaccaccatgtttgccctggtcctcctctggttcggcatctcagtgccccttgtgtttgtcgggagctacctcgggttcaagaagcctgccatggagcctccggtgaagaccaacaagatcccgcgacagatccctgagcaagcctggtacatgaacccgctcttcaccatcctgatcggtggcatcctgccgttcggcgcggtcttcatcgagctcttcttcatcctcacctcgatctggctgcaccagttctactacatcttcggcttcctcttcctggtgtttgtgatcctcatcatcacctgcgctgagatcaccatcgtgctctgctacttccagctgtgcagcgaggactacaactggtggtggaggtcgtacctgacctcagggtcgtcggcgctgtacctcttcctgtacgcagggttctacttctggaccaagctgcagatcagcaagctggtgtcgggcatcctctactttgggtacatgctgctcgcctccttctccttcttcgtgctcaccggaaccatcggcttctgcgcctgcttctggttcacgaggatgatctactcatccgtgaagatcgattagagtctacgccggaggcacagcaggcaagaagagacagagacagagcatagcatatgttttgagctttccgcggtcgaggtgatgataattgtatgattaaggtgaaagaaagtggggatcagcccctgttgttactgttttcagttttttcaggagaagttacattttggaattagtttatgacgaaccgatgatttatgtttattgttgtggtggcaagtgatgatacatgttagtgataaatcttgggagtatcgagggtagaatacaatacactgtgattgagttgtctgttttggcagaatttgatgaatcagcatataaaattcagttgatttcatgaccgga

SEQ ID NO: 2042 - DNA, 2391 bp, Hordeum vulgare
acgcgtccgccacccacccgcccttcccagccagcgcgcggtttggtcgtcgcctcctcctcctcgccgatccacccgcccgtcccagatccacgccaccgcgcggatccccgatgcgggcgccggcgatgctccggtgggccgccgccggcctcgccctcctcgcgctgctcgcccccacgcccgccgccgccttctacctccccggcgtcgcccccaccgacttcgcaaaggaagatgaactgttggtgaaggtgaacaagctgacatcaataaagactcagctcccctacacgtattactcccttcctttctgcaagccgaataccatagttgacagtgctgaaaaccttggtgaggttctccgtggtgatcgaattgagaactccccttatgtgttccaaatgagagagcccaagatgtgccagattatctgcaaaataactgtcacggagaaagaagcaaaggagctcaaggagaagatcgaggatgaataccgcgtgaacatggttcttgacaatctgccactggttgttccagttcaaaggccagataggaatactgtcgcctaccaaggtggatatcatgttggtgtcaagggccagtacgctggaagcaaggatgagaagcactttatccacaaccatttgtcattttcggttaagtttcacaaggatgaggattcagaactttctaggatagtgggatttgaggtcaaaccatacagcatcaagcatcagtacgatgggaattggaatgacgcaaacactcgtttgagcacatgtgatcctcataacagcaagtttgtaataaattctgaaactcctcaggaggttgaggtcggcaaagatatcgtattcacctatgatgttcgctttgaggagagtgaaattaagtgggcatctcgatgggacacctatttgctgatgtctgatgatcagattcactggttctctattgttaactctctcatgatcgtgcttttcctatctggtatggtagccatgatcatgatgcgcaccctgtacagagatatatctaggtacaaccagcttgaaactcaagaggaggcacaggaggaaactggctggaagcttgtccatggagacgttttccgccctccagttaactctgatttgctctgcgtctttgttggcactggagtccaattctttggcatgctgctggttacgatgatctttgctgttctgggtttcctctctccatcgaaccgtggaggattgatgactgcaatgcttctcgtctgggtcctaatggggttgattgctggctattcttcttcacgactctacaagatgttcaagggtgcagagtggaagcagataaccctgcgcacggctttcctgtttccagggattgctttcgtcatcttcttcatcttgaatgcccttatatggggggagaagtcatctggtgccgtcccattcaccaccatgtttgccctggtcctcctctggttcggcatctcagtgccccttgtgtttgtcgggagctacctcgggttcaagaagcctgccatggagcctccggtgaagaccaacaagatcccgcgacagatccctgagcaagcctggtacatgaacccgctcttcaccatcctgatcggtggcatcctgccgttcggcgcggtcttcatcgagctcttcttcatcctcacctcgatctggctgcaccagttctactacatcttcggcttcctcttcctggtgtttgtgatcctcatcatcacctgcgctgagatcaccatcgtgctctgctacttccagctgtgcagcgaggactacaactggtggtggaggtcgtacctgacctcagggtcgtcggcgctgtacctcttcctgtacgcagggttctacttctggaccaagctgcagatcagcaagctggtgtcgggcatcctctactttgggtacatgctgctcgcctccttctccttcttcgtgctcaccggaaccatcggcttctgcgcctgcttctggttcacgaggatgatctactcatccgtgaagatcgattagagtctacgccggaggcacagcaggcaagaagagacagagacagagcatagcatatgttttgagctttccgcggtcgaggtgatgataattgtatgattaaggtgaaagaaagtggggatcagcccctgttgttactgttttcagttttttcaggagaagttacattttggaattagtttatgacgaaccgatgatttatgtttattgttgtggtggcaagtgatgatacatgttagtgataaatcttgggagtatcgagggtagaatacaatacactgtgattgagttgtctgttttggcagaatttgatgaatcagcatataaaattcagttgatattcatgaccggaatt

SEQ ID NO: 2043 - DNA, 2317 bp, Brachypodium distachyon
gatgcgggcgccggcgatgctccgatgggccgcggccgccgtggcgctcgcggttctgctcgccgccgcgccggccgccgggttctacctccccggcgtcgccccgactgactttatgaagggagatgagcttttggtgaaggtgaataagctgacgtcaataaagactcagctcccctacacgtattactcccttcctttctgtaagccgaataccatagttgacagcgctgaaaatcttggtgaggttcttcgtggtgatcgcattgagaactccccttatgtgtttcaaatgagagagcccaagatgtgccaaattgcctgcaaattagctgttactgagaaagaagcaaaggagctcaaggaaaagattgaggatgaatatcgtgtgaacatggttcttgacaatctgccactagttgttcctgttacaagacaagataagaacacgattgcttatcaaggtggatatcatgttggtgtcaagggccagtatactggaagcaaggatgagaagcacttcatccataaccacttgtcatttttagttaagtatcacagggatgatgattcagaactttctaggatagtgggatttgaggtcaaatcatacagcatcaagcatcagttcgatgggaaatggaatgatgcgaatactcgtttgagcacatgtgatccccatgataacaagtttgtaacaactaatgaatctcctcaggaggtcgaagttggcaaagatatcatattcacctacgatgttcactttgaggagagtgaaatcaagtgggcatcccgatgggacacatatctgttgatgtctgatgatcagattcactggttttctattgttaactctctcatgatcgtgcttttcctatctggtatggtggcgatgataatgatgcgcaccctgtatagagatatatctaggtacaaccagcttgaaactcaagaagaggcacaggaggaaactggctggaagcttgttcatggagatgttttccgtcctccaaccaactctgatttactctgtgtttatgttggcaccggagtccaattctttggcatgctgctcgttacgatgatctttgctgttctgggattcctttctccgtcgaaccggggaggattgatgactgcaatgcttcttgtctgggtcctgatggggttgcttgctggttattcttcttcccgtctctacaagatgttcaagggttcagagtggaagcagataaccctgcgcacagctttcctgtttccggggattgcttttgttattttcttcatcttgaatgctcttatatggggggagaaatcatctggtgccgttcctttcaccactatgtttgccctggtcctcctttggtttggcatctcagtgccccttgtgtttgttgggagttatcttgggttcaagaaacctgccatggagcctccagtgaaaaccaacaagattccacgacagatccctgagcaagcttggtacatgaatcctctcttcaccattctaattggtggcattctgccatttggtgctgttttcattgagctattcttcatcctcacctcgatctggctgcaccaattctactacatcttcggcttcctcttcctggtgtttgttatcctcatcataacctgtgcagaaatcacgattgtgctctgctacttccagctgtgcagcgaggactacatgtggtggtggaggtcttacctcacctctggatcctccgcgctttatctcttcttgtatgctgcattctacttcttcacgaagctgcagatctctaagctggtgtctggcatcttgtactttgggtacatgctacttgcctcgttctcgttctttgtgctcaccggaacaattggtttctgcgcgtgcttctggttcactaggatgatttactcttctgtcaagattgattagttgccagagcacagacagagcatagcatatgttttcagcttttgggtcaagagaactgtaccattaaagtgatgtggggtaataccccccgaaatttttctctccagttttcgcaggaaagctacattttgggattagttaatgaatgatttatgtttggtgaagtgatacatcttagtgatttggggttacaaggttagaagaatacactgttgtgatggagctccatattttgcaaatttgatgtaccagtgtataaatttaattgattatgaccggtattcctgcactggatcatccactcgtgaggtccaagaaccatagggaataacacgatggcaggaatttaatcactgttctagaatgtgaaagtattttctcttttattct

SEQ ID NO: 2044 - DNA, 2403 bp, Zea mays
atcaataaaaaccctagcagatccacccgtcacccgaagcttcctcctcgcagcgcgccgcgcgtcgtcgcctctacccacctgacttcgcgcgccacgccgagcctgcgagccatcagcccatcacccacccaacccctcgccacgcagatctagggagcttgccctcccaccgggcggtgattcttccgtcccatcaccgatgcggacgccggcgatgctccggtgggccgcggcgctcgcggtcctgctcgccgtcgccgcgccggccgccgggttctacctccccggcgttgccccgagcgatttcgcgaagggtgatccgcttccagtgaaggtgaataagttgacatctatcaagactcaactcccgtatacatattattcccttccgttctgcaagccagataccatagtcgacagtgccgaaaatcttggggaggtacttcgtggcgatcgcattgagaactctccttatgtgttcaaaatgggagagcccaagatgtgtcagattgtctgcagagcaccgatcactgagaaagaagccaaggagctcaaggaaaagatagaggacgaataccgagtgaacatgatccttgacaacctcccgctagttgttcctgttacaaggcaagataagaacagtattgcttatcaaggtggatatcatgttggtgccaaaggcctgtattctggaacaaaggatgagaaatacttcatacacaaccatttgtcatttacggtgaagtatcacaaggacgataatttggaacattctagaatagtgggatttgaggtcaacccacacagtgtcaagcaccaggttgacgataaatggaatggtgtagacacccgcttgagcacttgtgatcctcatgcgagcaaatttgtaataaactctgattctcctcaggaagttgaagttggcaaggaaatcatattcacatatgatgttcgctttgaggagagtgagatcaagtgggcgtcacgctgggacacctacctgttgatgaccgatgatcagattcactggttttctattgtgaactctctcatgatcgtgcttttcctatcaggcatggttgccatgataatgcttcgcactctctacagagacatttctagatacaatcagcttgaaactcaagaagaagcacaagaggaaacaggctggaagcttgttcatggggatgtgttccgtcctccaacctactctgacttgctctgtgtttatgttggcactggcgtccaattctttggcatgctcgtagttacaatgatctttgctgtgttgggtttcctttctccatcaaaccggggaggactcatgactgcaatgcttctagtctgggttttgatgggtctgcttgctggctactcttcttcccgcctttacaagatgttcaaaggttcagagtggaagaagataaccctgcaaacggctttcctatttccaggggttgcatttgttattttcttcatcttgaatgctcttatatggggggagaagtcatctggtgctgttcctttcaccacaatgtttgccttggtcctcctttggtttggcatctcagtaccccttgtcttcgttgggagttatcttgggttcaagaaacctgccatggaacctccagtcaagacaaacaagattccacgtcagatccctgagcaggcttggtacatgaatccgcttttcaccattctgattggcggtgtccttccatttggagcagttttcattgaactcttcttcatcctcacctccatctggctgcaccagttctactacatatttggcttcctcttccttgtgtttgtgatcctgatcatcacctgcgccgagatcacaatcgtgctctgctatttccagctctgcagtgaggactacatgtggtggtggaggtcttaccttacctcaggatcctccgccctgtatctcttcctgtacgctggtttctacttcttcacgaaactgcagatcactaagctggtgtctggcatcttgtacttcggctacatgcttctcgcctcatatgccttcttcgtgctgactggcacaattggtttctgcgcctgcttctggttcactaggttgatttactcttcagtgaagatcgattaggtgccaagatgacagaacagcacatgtttcaatggagtcaagataattgtatgattaatgtggattggggaattaccccccctcctttttttgaaggttttcaggaaaattttactgtttaggatttagtttacagatggtttatgttttgttattgtcaggttatacactttagtgatttggaactgaaaaatataagggtaaacacattatgatgaggctgtaccttgtgacaaatttttttgtggggctctatataaattaaattcattgtgacaggt

SEQ ID NO: 2045 - DNA, 2403 bp, Zea mays
atcaataaaaaccctagcagatccacccgtcacccgaagcttcctcctcgcagcgcgccgcgcgtcgtcgcctctacccaccggacttcgcgcgccacgacgagcctgcgagccatcagcccatcacccacccacccccccgccacgcagatctagggagcttaccctcccaccgggcggtcattcttccgtcccatcaccgatgcggacgccggcgatgctccggtgggccgcggcgctcgcggtcctgctcgccgtcgccgcgccggccgccgggttctacctccccggcgttgccccgagcgatttcgcgaagggtgatccgcttccagtgaaggtgaataagttgacatctatcaagactcaactcccgtatacatattattcccttccgttctgcaagccagataccatagtcgacagtgccgaaaatcttggggaggtacttcgtggcgatcgcattgagaactctccttatgtgttcaaaatgggagagcccaagatgtgtcagattgtctgcagagcaccgatcactgagaaagaagccaaggagctcaaggaaaagatagaggacgaataccgagtgaacatgatccttgacaacctcccgctagttgttcctgttacaaggcaagataagaacagtattgcttatcaaggtggatatcatgttggtgccaaaggcctgtattctggaacaaaggatgagaaatacttcatacacaaccatttgtcatttacggtgaagtatcacaaggacgataatttggaacattctagaatagtgggatttgaggtcaacccacacagtgtcaagcaccaggttgacgataaatggaatggtgtagacacccgcttgagcacttgtgatcctcatgcgagcaaatttgtaataaactctgattctcctcaggaagttgaagttggcaaggaaatcatattcacatatgatgttcgctttgaggagagtgagatcaagtgggcgtcacgctgggacacctacctgttgatgaccgatgatcagattcactggttttctattgtgaactctctcatgatcgtgcttttcctatcaggcatggttgccatgataatgcttcgcactctctacagagacatttctagatacaatcagcttgaaactcaagaagaagcacaagaggaaacaggctggaagcttgttcatggggatgtgttccgtcctccaacctactctgacttgctctgtgtttatgttggcactggcgtccaattctttggcatgctcgtagttacaatgatctttgctgtgttgggtttcctttctccatcaaaccggggaggactcatgactgcaatgcttctagtctgggttttgatgggtctgcttgctggctactcttcttcccgcctttacaagatgttcaaaggttcagagtggaagaagataaccctgcaaacggctttcctatttccaggggttgcatttgttattttcttcatcttgaatgctcttatatggggggagaagtcatctggtgctgttcctttcaccacaatgtttgccttggtcctcctttggtttggcatctcagtaccccttgtcttcgttgggagttatcttgggttcaagaaacctgccatggaacctccagtcaagacaaacaagattccacgtcagatccctgagcaggcttggtacatgaatccgcttttcaccattctgattggcggtgtccttccatttggagcagttttcattgaactcttcttcatcctcacctccatctggctgcaccagttctactacatatttggcttcctcttccttgtgtttgtgatcctgatcatcacctgcgccgagatcacaatcgtgctctgctatttccagctctgcagtgaggactacatgtggtggtggaggtcttaccttacctcaggatcctccgccctgtatctcttcctgtacgctggtttctacttcttcacgaaactgcagatcactaagctggtgtctggcatcttgtacttcggctacatgcttctcgcctcatatgccttcttcgtgctgactggcacaattggtttctgcgcctgcttctggttcactaggttgatttactcttcagtgaagatcgattaggtgccaagatgacagaacagcacatgtttcaatggagtcaagataattgtatgattaatgtggattggggaattaccccccctcctttttttgaaggttttcaggaaaattttactgtttaggatttagtttacagatggtttatgttttgttattgtcaggttatacactttagtgatttggaactgaaaaatataagggtaaacacattatgatgaggctgtaccttgtgacaaatttttttgtggggctctatataaattaaattcattgtgacaggt

SEQ ID NO: 2046 - DNA, 2620 bp, Sorghum bicolor
atcaataaaaacccccggaagatccacccgtcacccgaagcttcctcctcgcagcgcgccgcgcgtcgtcgtctccacccaccccgagacccgacctcgcgcgccacgccgagcctgcgagccatcacccccacccaccgcctcgccgcgcagatctcgggagcttaccctcccaccggcaccgggcggtgattctcccgccccatcaccgatgcggacgccggcgatgctccggtgggccgcggcgctcgcggtcctgctcgccgtcgccgcgccggccgccgggttctacctccctggcgtcgccccgagcgatttcgccaagggtgatctgcttccagtgaaggtgaataagttgacatctatcaagactcaactcccgtacacatattactcccttccattctgcaagccagataccataatcgacagtgccgaaaatcttggtgaggttcttcgtggtgatcgcattgagaactctccttatgtgttcaaaatgggagagcccaagatgtgtcagattgtctgcaaagcgaagatcggtgagaaagaagccaaagagctcaaggaaaagatagaggatgaatatcgagtgaacatgattctagacaacctcccgcttgttgttcctgttaaaaggcaagataagaacagtattgcttatcaaggtggatatcatgttggtcttaaaggcctgtattctggaactaaggatgagaaatacttcatccacaaccatttgtcatttgcggtgaagtatcacagggatgaaaattcaggactttctagaatagtgggatttgaggtcaacccacacagtgtcaagcatcaggttgatgataaatggaatggtgtagacactcgcttgagcacttgtgatcctcatgcgagcaaatttgtaacaaactctgataatcctcaggaagttgaaactgacaaggaaatcatattcacatatgatgttcattttgaggagagtgagatcaagtgggcatctcgatgggacacctacctgttgatgactgatgatcagattcactggttttctatcgtgaactctctcatgatcgtgcttttcctatctggcatggttgccatgataatgcttcgcaccctctacagagatatctctagatacaatcagcttgaaactcaagaagaagcacaagaggaaacaggctggaagcttgttcatggggatgtgttccgtcctccaacctactctgacttactctgtgtttatgttggcactggcgtccaattctttggcatgctcctagttacaatgatcttcgctgtgttgggtttcctttctccatcaaaccggggaggactgatgactgcaatgcttcttgtctgggttttgatggggctgcttgctggctattcttcttcacgcctctacaagatgttcaaaggttcagagtggaagaagattacactgcaaacggctttcctgtttcctggggttgcatttgttattttcttcatcttgaatgctcttatatggggggagaagtcatctggtgctgttcctttcaccacaatgtttgccttggtcctcctctggtttggcatctcagtaccccttgtctttgttgggagctatcttgggttcaagaaacctgccatggaagctccagtcaagacaaacaagattccacggcagatccctgagcaggcttggtacatgaatccgcttttcactattctgatcggtggggtccttccatttggagcagttttcattgaactcttcttcatcctcacctccatctggctgcaccagttctattacatctttggcttcctcttccttgtgtttgtgatccttatcatcacctgtgccgagatcacaattgtgctctgctatttccagctctgcagtgaggactacatgtggtggtggaggtcttaccttacctcaggatcctctgccctgtatctcttcctgtatgctgctttctacttcttcacgaaactgcagattactaagctggtgtctggcatcttgtacttcggctacatgcttctcgcctcctatgccttctttgtgctcactggcacaattggtttctgtgcctgcttctggttcactaggttgatttactcgtcagtgaagatcgattaggtgccaatatgacagaatagcacatgtcacatgttcagtgatggagacaagagaattgtatgattaatgtggattggggaattaccccccttttaagattcaggaaaaaaaagggttactttttagggtttagtttatgaatggtttatgttttgttgttgtcagattatacactttagtgatttgaaactgagaaaaagtataagggtaaacacattgtgatgaggctgtaccttttgacattttttgtggggctctatataaattcaattcattatgaccggtatgcttgtactggtgaattactgtaaggctccaggaccagtatgaaataccctgatggcaattggcaagaatgtaacctcagttggcttagaaaccagagctggcgcttgaacttgcaaaaatctttgttccagcaatgctcatttgttgtgcaccaaagggaaacgaaattaagggcttgtttggcacaaacatggtttctcc

SEQ ID NO: 2047 - DNA, 2261 bp, Setaria italica
ggcctggcgggccggcgcggggccgggcgccgggttctacctccccggcgtcgccccgagcgatttcgggaagggtgatccgcttcaagtgaaggtgaataagttgacgtcgatcaagactcaactcccgtatacatattactcccttccattctgtaagccagctaccatagtcgacagtgctgagaatcttggtgaggttcttcgtggtgatcgcattgagaactctccttatgtgttccaaatgagagagcccaagatgtgtcagattgtctgcaaagcaaccatcaatgagaaagaagccaaggagctcaaggaaaagatagaggatgaataccgtgtgaacatgattctggacaacctcccactagttgttcctgttataaggcaagataggaacggtattgcttatcaaggtggatatcatgttggtgccaaaggccagtatgctggcagtaaggatgagaaatacttcatccacaaccatttgtcatttacagtgaagtatcacaaggatgatgattcagaactttccagaatagtgggatttgaggttcacccatacagtgtcaagcatcagtttgacgataaatggaacggtgtagacactcgcttgagcacttgtgatcctcatgcgagcaaattggtaactagctcggagtctcctcaggaggttgaagctgacaaggaaatcatattcacatatgatgttaagtttgaggatagtgagatcaagtgggcttctcgttgggacacctacctgttgatgactgatgatcagattcactggttttctattgtgaactcactcatgattgtgcttttcctatctggtatggtagcgatgataatgcttcgcactctctacagagatatatctagatacaatcagcttgaaactcaagaagaagcacaagaggaaactggctggaagcttgttcatggagatgtgttccgtcctccaaccaactctgacttactttgcgtttatgttggcactggtgtccaattctttggcatgctgctagttacgatggtctttgctgtgttgggtttcctttctccatcaaacaggggagggctgatgactgcaatgcttctagtctgggttttgatggggctgcttgctggctattcttcttcgcgcctctacaagatgttcaagggttcagagtggaaaaagattaccctgcaaaccgctttcctgttcccaggggttgcattcgttattttcttcatcttgaatgctcttatatggggggagaagtcatccggtgctgttcctttcaccacaatgtttgccttggtcctcctctggtttggcatctcagtacctcttgtctttgttgggagctatcttgggttcaaaaaacctgcgatggaacctccagtgaagacaaacaagattccacgacagattcctgagcaagcttggtacatgaatccaatcttcaccattctgatcggtggcattctcccatttggagcagttttcattgaactctttttcatcctcacctccatctggctgcaccagttctactacatctttggcttcctcttccttgtatttgttatcctcatcatcacctgcgccgagatcacaatcgtgctctgctatttccagctctgcagtgaggactacatgtggtggtggaggtcttacctcacctcaggatcctccgctttatatctcttcctgtacgcggctttctatttctccacaaagctgcagattacaaagctggtgtctggcatcttgtacttcgggtacatgcttctcgcctcctatgccttctttgtgctgaccggcacaattggtttctgtgcctgcttctggttcacaaggttgatttactcgtcagtgaagatcgattaggtgcaagcacgacagagaatagaacatgtttcagtgatttgagtcaagagaactgtatgattaatgtggagtggggaatcattcccctttttgttcaggttttcaggaaaaagttgctttttaggatttagtttatgaatggttatgttttgttgtcagattatacaccttagtgatttgagactgagaaaagatatataaggctaaacacattgtggtggagttgtaccttttgacatttttgtgggtcacaatataaattcaattcattatgtccggtatgcttgtactgattgaattactggtgaggctccagcaccagtatgaaataccctgatatcaggagtgtaacccctgttttcataaagattacagttggctc

SEQ ID NO: 2048 - DNA, 2549 bp, Zea mays
cccgacctcccgcgcgacgccgaacctgcgagccataacgccacccaccgcctcgccgcgcagatctctggggcttatccctacccccgggctgtgattctcccgcctcctcaccgatgcggacgccggcgatgctccggtgggccgcggcgctcgcggtcctgctcgccgtcgccgcgccggccgccgggttctacctccccggcgtcgccccgaccgacttcgccaagggtggtccgcttccagtgaaggtgaataagttgacatctatcaagactcaactcccgtatacatattactcccttccattctgcaagccagatgccatagttgacagtgccgaaaatctcggggaggttcttcgtggcgatcgcattgagaactctccttatgtgttcaaaatgcgagagcccaagatgtgtcagattgtctgcaaagcaaagatcactgagaaagaagccaaggagctgaaggaaaagatagaggaagaataccgagtgaacatgatcctggacaacctcccgctagttgttcctgttaataggcaagataagaacagtattgcttatcaaggtggatatcatgttggtctcaaaggcgtgtattctggaactaagaatgagaaatacttcatccacaaccatttgtcatttacggtgaagtatcacagggatgataattcagaactttccagaatagtgggatttgaggtcaacccactcagtgtcaagcatcagattgatgataaatggaatggtgtagacactcgcttgagcacttgtgatcctcatgcaagcaaatttgtcataaactctgattctcctcaggaagttgaagctgacaaggaaatcatattcacatatgatgttcattttgaggagagtgagatcaagtgggcatcacgttgggacacctacctgttgatgactgatgatcagattcattggttttctattgtgaactctctcatgatcgtgctttttctatctggcatggttgccatgataatgcttcgcactctctacagagacatctctagatacaatcagcttgaaactcaagaagaagcgcaagaggaaacaggctggaagcttgttcatggggacgtattccgtcctccaacccactctgacttgctctgtgtttgtgttggcactggcgtccaattctttggcatgctcctagttacaatgatcttcgctgtgttgggtttcctttctccatcaaaccggggaggactgatgactgcaatgcttcttgtctgggtcttgatggggctgcttgctggctattcttcttcacgcctctacaagatgttgaaaggttcagagtggaagaagatcaccctgcaaacggctttcctgtttccaggggttgcatttgttattttcttcatcttgaatgctcttatatggggggagaagtcatctggtgctgtccctttcaccacaatgtttgcactggtcctcctctggtttggcatctcggtacccctcgtctttgttgggagttatcttgggttcaagaaacctgccatggaacctccagtcaagacaagcaagattccacggcagatccccgagcaggcttggtacatgaatccgcttttcactattctgattggtggcgtccttccatttggagcagttttcattgagcttttcttcatcctcacctccatctggctgcaccagttctactacatcttcggcttcctcttcctcgtgtttgtgatccttgtcatcacctgcgccgagatcgcagtcgtgctctgctatttccagctctgcagcgaggactacatgtggtggtggaggtcctaccttacctcaggatcctccgcgctgtacctcttcctgtacgctgctttctacttcttcacgaaactgcagatcactaagctggtgtctggcatcttgtacttcggctacatgtttctcgcctcctatgccttctttgtgctgactggcacaattggcttctgcgcctgcttctggttcactaggttgatttactcgtcagtgaagatcgattaggtgccaatatatgacagaatagcacgtgtttcagtgatggagacaagagaactgtaccattgatgtggattgggaattaccccccttcttttagggttttcagggaaaaaagtttcttcttaggatttagtttatgaattattatggtttgttgtcagattatacactttagggcttgttcgttttggtgataatccacatgtattgggtgggattgagctggtttaaatccataacaagtcaaaatccaccccaatcccactcaatacactccaatacacatgtaatatcaataaccgaacaagcccttagtggtttggaactgagaaaaaatataagggtaaacacattgcgaagaggctgtacctttttgacatttttttgtgcggctctatataaattcaattcattatgaccggtatgcttgtactggtgaattactgtaaggctccagggccagcatgaaataccctcatggcagctggctagaatgtaacctcagtttcttagaaa

SEQ ID NO: 2049 - DNA, 2243 bp, Pennisetum glaucum
cgcagggttctacctccccggcgtcgccccgagcgattttgggaagggtgatccgcttcaagtgaaggtgaataagttgacatcaatcaagactcaactcccatatacatattactcccttccattctgtaagccagctaccatagtcgacagtgctgagaatcttggtgaggttcttcgtggtgatcgcattgagaactctccttatgtgttccaaatgagagagcccaagatgtgtcagattgtctgcaaagcaaccatcagtgagaaagaagccaaggagctcaaggaaaagatagaggatgaataccgcgtgaacatgattctggacaacctcccagtagttgttcctgttgtaaggcaagataggaacggtattgcttatcaaggtggatatcatgttggtgccaaaggccaatatgctggtagtaaggatgagaaatacttcatccacaaccatttgtcatttacagtgaagtatcacaaggatgatgattcagaactttccagaatagtgggatttgaggttcacccatacagtgtcaagcatcagtttgatggtaaatggaacggtgtagacactcgcttgagcacttgtgatcctcatgcgagcaaatttgtaacaagctcggagtcacctcaggaggttgaagctgacaaggaaatcatattcacatatgatgttaagtttgaggatagtgagatcaaatgggcttcccgttgggacacctacctgttgatgactgatgatcagattcactggttttctattgtgaactctctcatgatcgtgcttttcctatctggtatggtagccatgataatgcttcggactctttacagagatatatctagatataatcagcttgaaactcaagaagaagcacaagaggaaactggctggaagcttgttcatggagacgtgttccgtcctccaaccaactctgacttactttgtgtttatgttggcactggtgtccaattcttcggcatgctgctagttacgatggtctttgctgtgttgggtttcctttctccatcaaacagaggaggactgatgactgcaatgcttctagtctgggttttgatggggctgcttgctggctattcttcttcacgtctctacaagatgttcaagggttcagagtggaaaaagattaccctgcaaacagctttcctgttcccagggattgcatttgttattttcttcatcttgaatgctcttatatggggggagaagtcatcaggtgctgttcctttcaccacaatgtttgccttggtcctcctctggtttggcatctcagtacctcttgtctttgttgggagctatcttgggttcaaaaaacctgcgatggaacctccagtgaagacaaacaagattccacgacagattcctgagcaagcttggtacatgaatccaatcttcaccattctgatcggtggcattctcccatttggagcagttttcattgaactctttttcatcctcacctccatctggctgcaccagttctactacatctttggtttcctcttccttgtatttgttatcctcatcatcacctgcgcggagatcacaatcgtgctctgctatttccagctatgcagtgaggactacatgtggtggtggaggtcttacctcacctcaggatcctccgctttatatctcttcctttacgccgctttctacttctccacaaagctgcagattactaagctggtgtctggccttttgtacttcgggtacatgcttctcgcctcctatgccttctttgtgctgaccggcacaattggtttctgtgcctgcttctggttcacaaggttgatttactcatcagtgaagatcgattaagtgcaaacacaacagaaaatagaacatgtttcagtgatttgagtcaagagaactgtatgattaatgtggagtggggaatcatccccctttttgttcaggttttcaagaaaagttgctttttaggatttagtttatgaatggtcatgttttgttgtcagattaaacaccttagtgacttgagacaggaaacaaattataaggataaacactaaacacattgtgatggaactgtaccttttgaattttttgttgctcgcaatataaattcaattcattatgtccggtatgcttgtactgattgaattactggtgaggctccagcaccagtatgaaataccctgatatcaggaatttgtaacccctgtttcatagagattacagttggctcttt

SEQ ID NO: 2050 - DNA, 2529 bp, Sorghum bicolor
ctcttggcgcaacgcagcggaaaagcgccatctcattcttcttcctccgtttcgtctccactctccccccgcggccggggagcctcgagcgttcctgccacgagatctctcctgccactcccctcgcctgctcgcaacaccggcatggcgccgtcggcgtgggccgtagccctcgccgcactctgcatcgtcgcgctcgcgccaccggcagcagggttctacctacccggcgtcgcgcccaatgacttcgagaagaaagatccacttcctgtgaaagtcaacaagctgacctcaatcaagacacaacttccatactcttactattctctcccattctgcaagccggataccatagttgacagtgcggaaaatctcggtgaagttcttcgtggagatcgcattgaaaactctccctatacgtttgaaatgagggagcctcagatgtgtcaaatagtctgcaagatatctgttggggagaaagaagcaaagcttctcaaggagaagattgaagatgagtaccgtgttaacatgattcttgacaacctacctttagttgttcctattcaaagagtggatcaagaaggtgcttatttctatcaacatggattccatgttggggccaaaggaaaatattcagggagcaaggatgaaaaatacttcatccacaaccatctatcttttacggtgaaatatcacagggatgagcaaagagatatttccaggattgtggcctttgaagtgaaaccatacagcgttaagcatgaatatgaagggcaatggaatgataagaagacccgcctgacaacgtgtgatcctcatgctcaacgtattattacctcatctgagtctcctcaggaggttgaagttggcaaggatatcatatttacttatgatgtggatttcaaggagagtgacatcaagtgggcatctcggtgggacagctatctattgatgacagatgatcagatccactggttctcaattgtgaattctctcatgattgtcctcttcctttctggaatggttgcgatgatcatgctccgtaccctttaccgggatatctccaagtataaccaacttgagactcaggaagaggcccaggaggagacaggatggaagcttgttcacggtgatgttttcaggcctccatcaaactcagactggctctgtgtttatgtcggcaccggtgtccaattctttggcatgctgcttgtcactatggtatttgcggttcttggcttcctttctccatcgaacaggggtggactgatgacagccatgctcctgctctgggtgttcatggggttgcttgctggctactcttcttcacgtctttacaagttgttcaagggctcagaatggaagaacattgccttgaggacagccttcactttccctggcagtgtgtttgctattttcttcttcttgaatgctcttatctgggggcaaaagtcttcaggtgctgttccattcaccacaatgtttgcccttgtcctcctttggttcggtatctcagtacctttggtttttgttggaagcttccttggcttcaagaaacctaccattgaagatccagtgaagacaaacaagataccaaggcagatccctgagcaggcctggtacatgaacccaatcttctcgattctaattggagggatccttccatttggtgctgtgttcatcgaactcttctttatccttacctccatctggctgcaccagttctactacatctttgggttcctcttccttgtgttcctgattctcatcgtgacatgtgctgagatctcgattgtgctatgttacttccagctctgcagcgaggattacctgtggtggtggaggtcatacctgacatctggttcctctgcactctacctcttcttgtatgcaaccttctatttcttcacaaagcttgagatcaccaagtttgtctcagcagttctgtactttggttacatgctcattgcctcatatgccttctttgccttgaccggcacaatcggattctatgcgtgcttcctgttcacaaggctgatttactcatcggtcaagatcgagtaaggtgaagtgcactcttgcctaattctttgttgccacgaagaaagaaatttctgtggataatgaattctacaggaccgctgagtttagctgcaagtggcctcgttttgagttttccaagctggtagttatgatgaagttgcgattcattaccgtatgattcaggtattatagctagtgcagtattttttttttgttttctcttttgttttgttttttttgggctgtgcctttggaccgtcaggatatatgcttatcaagcgctcgacgctgagcgaattgtatacggatgctgagtaatctatctcttgttcctgtcagaatttatgtacttgttgacgtgcactctgacttactccatgatacggagtatacaattgtagctacaaagtccggctcctgtttcttttgcatcggagtacagacaaatggattatattttttctaacgttctgaccttggagacca

SEQ ID NO: 2051 - DNA, 2418 bp, Saccharum officinarum
aagtcacgggtccacccacgcgtacgagcgccatctcattcttcttcctccgtctcgtctctactctgcgcccgcgccgcgcccgggggagccgcgagcgtcgtgccactcccctcgccccgcctgcccacaacgccgacatggcgccgtcggcgtgggccgtcgccctcgccgcactctgcatcgtcgcgctcgcgccgccggccgcagggttctacctccccggcgtcgcgcccaatgacttcgagaagaaagatccacttcctgtgaaagtcaacaagctgacctcaatcaagacacaacttccctactcctactattctctcccattctgcaagccagataccatagttgacagtgcggaaaatctcggtgaagttcttcgtggagatcgcattgaaaactctccctatacgtttgaaatgagggagcctcagatgtgtcaaatagtctgcaagatatctgttggagagaaagaagcaaagcttctcaaggagaagattgaagatgagtaccgtgttaacatgattcttgataacctacctttagtcgttcctatccaaagagtggatcaagaaggtgcttatttctatcaacatggattccatgttggggccaaaggaaaatattcagggagcaaggatgaaaaatacttcatccacaaccatctatcttttacggtgaaatatcacagggatgagcaaagagatgtttccaggattgtggcctttgaagtgaaaccatacagcgttaagcatgaatatgaagggcaatggaatgataagaagacccacctgacaacgtgtgatcctcatgctcaacgtataattacctcatctgagtctcctcaggaggttgaagttggcaaggatatcatatttacttatgatgtggatttcaaggagagtgacatcaagtgggcatctcggtgggacagctatctattgatgacagatgatcagatccactggttctcaattgtgaattctctcatgattgttctcttcctttctggaatggttgcaatgatcatgctccgtaccctttaccgggatatctccaagtataaccaacttgagactcaggaagaggctcaggaggagactggatggaagcttgttcacggcgatgttttcaggcctccatcaaactcagactggctctgtgtttatgtcggcaccggtgtccaattctttggcatgctgcttgtcactatggtatttgcggttcttggcttcctttctccatcgaacaggggtggactgatgacagccatgctcctgctctgggtgttcatggggttgcttgctggctactcttcttcacgtctttacaagttgttcaagggctcagaatggaagaacattgccttgaggacagccttcactttccctggcagtgtgtttgctattttcttcttcttgaatgctcttatctgggggcaaaagtcctcaggtgctgttccattcaccaccatgtttgcccttgtcctcctttggttcggtatctcagtacctttggttttcgttggaagtttccttggcttcaagaaacctaccattgaagatccagtgaagacaaacaagataccaaggcagatccccgagcaggcctggtacatgaacccaatcttctcgattctaatcggagggatccttccatttggtgctgtgttcatcgaactcttctttatccttacctccatctggctacaccagttctactacatcttcgggttcctcttccttgtgttcctgattctcatcgtgacatgtgctgagatctcgattgtgctatgttacttccagctctgcagcgaggattacctgtggtggtggaggtcgtacttgacatctggttcctctgcactctacctcttcttgtatgcaaccttctacttcttcacaaagcttgagattaccaagtttgtctcagctgttctgtacttcggttacatgctcattgcctcgtatgccttcttcgccttgaccggcacaatcggattctacgcgtgcttcctgttcacaaggctgatttactcatcggtcaagatcgagtaaggtgaagtgcactcttgcctaattctttgttgccacgaagaaagaagtattatgtggataaagaattctacagtaccgctgagtttagctgcaagtggcctcattgagttttccaagctggtagttatgatgaaattgcaattcattaccgtatgattcaggtattatagctagctcagtaatttttttttgttttttctcttgttttctgttttgggctgtgcctttggaccgtgaggatattatatgcttatcacaagcgctcgacgccgagcgaattgtatacggatgctgagtaatctatctcttgttcctgtcagaaattaatgtacttgttgatgtgcagtgtgactttaca

SEQ ID NO: 2052 - DNA, 2331 bp, Brachypodium distachyon
ccgtgcgcgcgcgcccgccacctccgtgccccccatggcgatctcgccggcggaggcgtcggctctggccgtcgccctcgtcgtgctctgcctcgcggccccggccgccgggttctacctccccggtgtcgcgcccaacgacttcgaccagaaagatcttctccccgtgaaagtcaacaaactgacttcaattaagacacaacttccctactccttctattctctcccattctgcaagccagatactatagttgacagtgctgaaaatctgggtgaagttcttcgtggtgatcgcattgagaactccccatatgtgttcgaaatgagggagcctcagatgtgtcagatagtctgcaagatttcagttggggagaaagaagctaaggttctcaaggaaaagattgaagatgagtaccgtgtgaacatgattcttgacaacctacctctagtcgttcctattcaaagagtggatcaagaaggcgcttacttctatcagcatgggttccatgttggagctaaagggcaatactcggggagtaaggatgaaaagtatttcatccacaatcatttgtcctttacggtgaaatatcacagagatgcacaaagggatgtttctaggatagtggcttttgaagtaaaaccatacagcgttaagcacgagtatgaaggacaatggaatgacaagaagacccgcctgaccacttgtgatcctcatgcaaaacgaataattacatcgtctgattctcctcaggaggttgaagctggcaaagacattgtatttacgtacgacgtggatttcaaggagagtgatatcaagtgggcatctcgctgggatagctatctgctgatgacggacgaccaaatccactggttctccattgtgaattctctcatgattgttctcttcctttccggaatggttgcaatgatcatgcttcgaaccctttaccgggatatctccaagtataaccagcttgagactcaagaggaagcccaagaagaaacaggatggaagcttgttcatggtgatgttttcaggcctcctgcaaactccgactggctgtgcgtttatgttggtacaggtgtccagttttttggcatgatgcttgtcaccatggtctttgctgtccttggcttcctttctccatccaacagaggtggactgatgacagctatgctcttgctttgggtattcatgggtttgcttgctggctactcttcttctcggctctacaagttgttcaagggatcagagtggaagaacattgcattgaggacagccttcactttccctggcagtgtcttcgccattttctttttcctgaatattctcatttgggggcagaagtcctctggtgcagttccattcaccacaatgtttgcccttgtcctcctttggtttggtatctcagtgccgttagtttttgttgggagtttccttggtttcaagaaacctgccattgaagaccctgtgaagacaaacaagatacctaggcaggtacctgagcaggcctggtacatgaacccaatcttctcaattctgattggagggatccttccatttggagctgtgttcattgagctcttttttatcctgacctccatctggctgcatcaattttattacatctttgggttcctcttcctagtcttcctgattctgattgtcacatgtgccgagatctcgattgtgctctgctacttccagctttgcagcgaggactacctgtggtggtggaggtcgtacttgacatcagggtcttcagccctgtacctcttcctgtatgcgaccttctacttcttcactaagctggaaattacaaagtttgtgtcagctgtcctgtacttcggatacatgcttatcgcgtcatatgcattctttgccttgacgggtacaattggattctatgcatgcttcatgttcaccaggctgatttattcgtctgtgaagattgagtaaacggagtgcccttctgcctaattctttgttgccacggtgaagttggatgctgtggacagtgaatgctataggtcctctaaatttagctatttggggcatcagttctgagtttgaaagctggttgttaagatgaactggtgatattgtaatccatgactgaagtatcatagctagctcagtgatttttgctctcttttcctcattttggctttggccttttgatcacgaagatgcttatcaggtgctggttgcagagtgagttatatacggatgctgataaatctcatttatattcttgtcagaatttcatgtacttgttcacatatattaagacttccattaaagataccgcttaagcaaaatattctcac

SEQ ID NO: 2053 - DNA, 2484 bp, Zea mays
atctcttcgcgcaacgcagcggaaaagcgccatctcattcttcttcctccatcttgtctctacttgccccgcgccggggagccgcgagcgtcgcgccactcccatcgcctgcccacaactccggcatggagccgtcggcgtgggccgtcgccttcgccgcactctgcatcgtcgcgctcgcgccgccggcctcagggttctacctccccggcgtcgcgcccaatgacttcgagaagaaagatccacttcctgtgaaagtcaacaagctgacctcaatcaagacacaacttccctactcctactattctctcccattctgcaagccggataccatagttgacagtgcagaaaatctcggtgaagttcttcgtggagatcgcattgaaaactctccctatacgtttgaaatgagggagcctcagatgtgtcaagtagtctgcaagatatctgttggggagaaagaagcaaagcttctcaaggagaagattgaagatgaataccgtgttaacatgattcttgacaacctacctttagtcgttcctattcaaagagtggatcaagaaggtgcatatttctatcaacatggattccatgttggggccaaaggaaaatattcagggagcaaagatgaaaaatacttcatccacaaccatctatcttttacggtgaaatatcacagggatgagcaaagggatgtttccaggattgtggcctttgaagtgaaaccatacagcgttaagcatgaatatgaagggcaatggaatgataagaagacccgcctgacaacgtgtgaccctcatgctcaacgtatcattacttcgtccgagtctcctcaggaggtcgaagttggcaaggatatcatatttacttacgatgtggatttcaaggagagcgacatcaagtgggcatctcggtgggacagctatctattgatgacagatgatcagatccactggttctctattgtgaattctctcatgattgttctcttcctttctggaatggttgcaatgatcatgcttcgtaccctttaccgggatatctctaagtataaccaacttgagactcaggaagaggcccaggaggagactggatggaagcttgttcacggcgatgttttcaggcctccgtcaaactcagactggctctgtgtttatgttggcaccggtgtgcaattctttggcatgctgcttgtcactatggtatttgcggttcttggcttcctttctccatcgaacaggggtggactgatgacagccatgctcctgctctgggtgttcatggggttgcttgctggctactcttcttcacgtctttacaaactgttcaagggctcagaatggaagaacatcgccttgaggacagccttcactttccctggcagtgtgtttgctatttttttcttcttgaatgctcttatctgggggcaaaagtcctcaggtgctgttccattcaccaccatgtttgctcttgtcctcctttggttcggtatttcagtacctttggtttttgttggaagcttccttggcttcaagaaacctaccattgaagatccagtgaagacaaacaagataccaaggcagatccctgagcaggcctggtacatgaacccaatcttctcgattctaatcggagggatccttccatttggtgctgtcttcatcgaactcttctttatccttacttccatctggctgcaccagttctactacatctttgggttcctcttccttgtgttcctgattctcatcgtgacatgtgctgagatctcgattgtcctatgttacttccagctctgcagcgaagattacctgtggtggtggaggtcgtacttgacttctggttcctctgcactctacctcttcttgtatgcaaccttctacttcttcacaaagcttgagatcaccaagtttgtctcagctgttatgtacttcggttacatgctcattgcctcgtacgccttcttcgccttgaccggcacaatcggattctatgcttgcttcctgttcacaaggctgatttactcatcggtcaagatcgagtaaggtgaagtgcactcttgcctatttctttgttgccacgaagaaagaagtattctatggatagtgaattctacaggactgctgagtttagctgcaagtgggctcgttttgagttttcaaagctggtagttatgatgaagatgcgattcattaccgtatgattccggtattatagctagctcagtatgtttctgtttttcttttgtttttttttgttttcgggctgtgcccgaccgtgaggatatatgcttatcaagagcttgacgctgaaagaattgtatacgggtgctgagtaatctatctcttgttcctctcagaatttatgtacttgttgatgtgcactgtgacgtacatgatatacatttatagctaccggctcggcggctcctgtttcttttgtacctgagtccagataaatggattcttatacatgtttttctaa

SEQ ID NO: 2054 - DNA, 2250 bp, Pennisetum glaucum
cccgccccgcccggccgccatggctacgccggcgtgggccgtcgccctcaccgcgctctgcctcgtcgcgctcgcgcctcccgccgccgggttctacctccccggcgtcgcgcccaacgacttcgagaagaaagatccacttcccgtgaaagtcaacaagctgacttcaatcaagacacaattgccctactcctactattctctcccattctgcaagcctgacacaattgttgacagtgccgaaaaccttggtgaagttcttcgcggtgaccgcatcgagaactctccatatacattcgagatgagggagcctcagatgtgccaaatagtgtgcaagatttctgttggagagaaagaagcaaagcttcttaaggaaaagattgaagacgaataccgcgtcaacatgattcttgacaacctacccctagttgttcctattcaaagagtggatcaagaaggtgcttatttctatcaacatggattccatgttggagccaagggaaaatatactgggagcaaggacgaaaagtacttcatccacaaccatttgtcctttacggtgaaatatcacagggatgaacaaagggatgtttctaggattgtggcctttgaagtgaaaccatacagtgttaagcatgaatatgaagggcagtggaatgataagaagacccgcctgacgacatgcgatcctcatgctcaacgtgtgattacatcatccgaatctcctcaggaggttgaagttggcaaggagatcatatttacttacgatgtggatttcaaggagagtgatatcaagtgggcatctcggtgggacagctatctgctgatgacagatgatcagatccactggttctctattgttaattctctcatgatcgttctcttcctttcgggaatggttgcaatgatcatgctccgtactctttaccgggatatctccaagtataaccagcttgagactcaggaagaggcccaagaagagactggatggaagcttgtccatggtgatgttttcagacctccatcgaactctgactggctctgtgtctatgttggcaccggtgttcagttctttggcatgctgcttgtcaccatgctatttgcggttctgggcttcctttctccatcaaacaggggtggactgatgacagctatgctcctgctctgggtattcatggggctgcttgctggctactcttcttcacgcctgtacaagttgttcaagggctcagaatggaagagcattgctttgaggacagcattcacttttcctggcagtgtgtttgctattttcttcttcttgaatgctcttatctgggggcagaagtcctcaggtgctgttccattcaccaccatgtttgcccttgtcctcctttggttcggcatctctgtgcctttggtttttgttggaagcttccttggcttcaagaaacctaccattgaagatcctgtgaagacaaacaagataccaaggcagatccctgagcaggcctggtacatgaacccaatcttctctattctgatcggagggatacttccatttggagctgtgttcattgagctcttcttcatccttacctccatttggctgcaccagttctactacatctttgggttcctcttccttgtcttcttgatccttatagtcacatgtgctgagatctcgattgtgctctgctacttccagctctgcagtgaggattacttgtggtggtggaggtcgtacttgacatcgggttcctctgctctctacctgttcttgtatgcgaccttctacttcttcacaaagctagagatcaccaaatttgtctctgctgttctttactttggttacatgctcattgcttcatatgccttctttgccttgactggcacaatcggattctatgcttgctttctgttcacaaggttgatctactcttccgtcaagattgagtaaaggtgaagtgctttattgcctaattctttgttgccacaaaggagatggattctgcagacaatgaaatctacagaacccccaaaattagctgagtgggcctcggttttgagttctcaaagctggtagttatgttgaagtggcaatttgttatcatataattcaggtattatagttagctcagtgatttttctgttctctcttttgtttttatatttttgggctgtgcctttggaccacgaggatatggttatcaagcgctccttgccgagcgactgtatacggatgctgagtaatctatttcttgttcatgt

SEQ ID NO: 2055 - DNA, 2346 bp, Hordeum vulgare
gaccatctcgtcgcaagttgcaacggaaaagcccattctcctcttgtcactctcaccggcccgagcgctcgagcgaaccgtgagcgaaccaccgcctccgtgccacatgacgatatcgctgccggcaacggcggtggctctgttcgttgtcctcgccgcactctgcctcctcgttgtcccgtccgccggattctacctccccggcgtcgcgcccaacgacttcgaaaagaaagaccatctccctgtgaaagtcaataaactgacttcaattaagacacagcttccctactccttctactctctcccattctgtaagccagatacgattgttgacagtgctgaaaatctgggtgaagttctccgtggggatcgcattgagaactctccatatgtgtttgaaatgagggtacctcagatgtgtcaaatagtctgcaagatttcagttggggaaaaagaaggaaagggtctcaaggaaaagattgaagatgagtaccgtgtgaacatgattcttgacaatctacctctagttgttcctattcaaagagtggatcaagaaggtgcttatttctatcaacatgggttccatgttggagccaaaggacaatactcagggagtaaggatgaaaagtacttcatccacaatcattgtcctttacggtgaaatatcacagggatgcacagagggatgtttctaggatagtggcctttgaagtaaaaccctacagtgtgaagcacgaatatggacagtggaatgacaagaagactcatctgaccacttgcgatccgcatgcgaaacgtataattacatcctctgattctcctcaggaggttgaagttggcaaagacattgtcttcacatacgatgtggatttcaaggagagtgatatcaagtgggcatctcgctgggatagttatctgctgatgacagatgatcaaatccattggttctccattgtaaattctctcatgatcgttctcttcctttccggaatggttgcaatgatcatgctccggaccctttatcgggatatctccaagtataaccagcttgagactcaggaggaagcccaagaagaaactggatggaagcttgttcatggtgatgttttcaggccgcctgccaactctgattggctctgtgtttatgttggtacaggtgtccagtttttcggcatgatgcttgtcacgatggtctttgcagtccttggcttcctttctccatccaacagaggtgggctgatgacagctatgctcttgctttgggttttcatgggtttgcttgctggttactcttcttcacgtctctacaagttgttcaagggttcagaatggaagaacattgccttgaggacagcattcaccttccctggcagcgtgttcactgttttcttcttcttgaatattcttatctgggggcagaagtcctctggtgcagttccattcaccacaatgtttgcccttgtcctcctttggttcggtatctcggtgcctctagtgtttgttgggagttaccttggtttcaagaaacctgccattgaagaccctgtgaaaacaaacaagatacccaggcaggtacctgagcaagcctggtacatgaactcaatcttttcgattctaattggaggaatccttccatttggagctgtgttcattgagctcttctttatcctgacctccatctggctgcaccaattctactacatctttgggttcctcttcctcgtcttcctgattctgatcgtcacatgtgccgagatatcgattgtgctctgctacttccagctatgcagtgaggattacctatggtggtggcgatcatacctgacatcaggatcttctgccctgtacctcttcctttatgcgactttctacttcttcacaaagctggagatcacaaagtttgtgtcagccatcctttacttcggctacatgctcatcgcctcatatgcattctttgccttgacgggtacaattggattctatgcctgtttaatgttcaccaggctgatttactcgtctgtgaagattgagtaacacagcgtgcttctccctgattctgttgacacgctgaaggtcgatgttgttgccagtgaatgccgtcctccgaacgtcagttctgagttctgaaagctggttgttaagatgaagtggtgatgtgttatccatggttaaactattatagctagcccggtcagttttgttctcctttttttttggctttagcatctggtcacgaggatgcctgtcaaatgcctgttgcagcgtgaattgtatatggatgctgataaatctcaattccttcttcatgtcgtaatgtaatgtactctctccttaaattaatataag

SEQ ID NO: 2056 - DNA, 2357 bp, Panicum virgatum
aaagcgccatctcgtccttggtcgcccccgccgcttgcctgcccctctctctccctcgcccccaccgcgcgcccgggggggaaggggaaagcagcgagcgccgcgccactccgcccgcccgccatggcgccgccggggtgggccgtcgccctcgccgcactctgcctcgccgcgctagcgccgctcgccgcggggttctacctccccggcgtcgtgccccacgacttcgagatgaaagatcctctcccggtgaaagtcaacaagctgacttcaatcaagacccaactgccctactcctactattctctcccattctgcaagccggatacaatagttgacagtgctgaaaaccttggtgaagttcttcgtggtgaccgcattgagaactctccatatacgtttgaaatgaaggagcctcagatgtgtcaaattgtttgcaagatttctgtcggggagaaagaagcaaaacttctcaaggaaaagattgaagacgagtaccgcgtcaacatgattcttgacaacctacctctagttgttcctattcaaagaatggatcaagaagatgcttatttctatcagcatggattccatgttggagctaaaggaaaattcttggggagcaaggatgaaaagtacttcatccacaaccatttgtcctttacggtgaaatatcacagggatgaacaaagggatgtttccaggattgtggcctttgaagtgaaaccatacagtgttaagcatgaatatgaagggcagtggaatgataagaagacccgcctgacaacatgtgatcctcatgctcagcgtgtaattacatcatccgaatctcctcaggaggttgaagttggcaaggacatcatatttacttatgatgtggatttcaaggagagtgatatcaaatgggcatctcggtgggacagctatttgctaatgacagatgatcagatccactggttctccattgtgaattctctcatgatcgttctcttcctttctggaatggttgcaatgatcatgctccgtaccctttaccgggatatctccaaatataaccagcttgagactcaggaggaggcccaagaagagactggatggaagcttgtccatggtgatgttttcaggcctccatcaaactctgacttgctctgtgtctatgttggcactggtgtccagttctttggcatgctgcttgtcaccatggtatttgcagttcttggcttcctttctccatcaaataggggtggactaatgacagctatgctcctgctgtgggtattcatggggcttcttgctggctactcttcttcacgtctctacaagttgttcaagggctcagaatggaagaacattgccttgaggacagccttcactttccctggcagcgtgtttgctattttcttcttcttgaatgctcttatctgggggcagaagtcctcaggagctgtaccattcactaccatgtttgctcttgtcctcctttggttcggtatctcagtgccattggtttttgttggaagcttccttggcttcaagaaacctaccattgaagatcctgtgaagacaaacaagataccgaggcagatccctgagcaggcctggtacatgaacccgatattttcaattttgatcggagggatccttccctttggagctgtgttcattgagctcttcttcattcttacgtccatctggctgcaacagttctactacatctttgggtttctcttcctcgtcttcctgatccttattgtcacatgtgctgagatctcaattgtgctctgctacttccagctctgcagtgaggattacttgtggtggtggaggtcatacttgacatcaggttcctctgctctttacctgttcttgtatgcaaccttctatttcttcacaaagctagagatcaccaagtttgtctctgccgttctgtactttggctacatgctcattgcctcctatgccttctttgccttgactggcacaatcgggttctatgcttgcttcctgttcacaaggctgatttactcttctgtcaagattgaataaggtgaagtgatctcttgcctacttttttgccatgaaggaagacagattctgtggataaaaaattctacagaacccctgaaattagctgagcagccttttgttttcagttctcaaagctgatagttatcatgaagtggcaattcgttattatcatgtaattcagctattatagctagcatagagatttttctgcttctctattttgtcttctattttgggttgtgcctttggactaccaggatgtatgcttattaagcgctccttgcagagcaacctgtatacgaatgctgagtaatctatttcttgttcatgtc

SEQ ID NO: 2057 - DNA, 2361 bp, Hordeum vulgare
gaccatctcgtcgcaagttgcaacggaaaagcccattctcctcttgtcactctcaccggcccgagcgctcgagcgaaccgtgagcgaaccaccgcctccgtgccacatgacgatatcgctgccggcaacggcggtggctctgttcgttgtcctcgccgcactctgcctcctcgttgtcccgtccgccggattctacctccccggcgtcgcgcccaacgacttcgaaaagaaagaccatctccctgtgaaagtcaataaactgacttcaattaagacacagcttccctactccttctactctctcccattctgtaagccagatacgattgttgacagtgctgaaaatctgggtgaagttctccgtggggatcgcattgagaactctccatatgtgtttgaaatgagggtacctcagatgtgtcaaatagtctgcaagatttcagttggggaaaaagaaggaaagggtctcaaggaaaagattgaagatgagtaccgtgtgaacatgattcttgacaatctacctctagttgttcctattcaaagagtggatcaagaaggtgcttatttctatcaacatgggttccatgttggagccaaaggacaatactcagggagtaaggatgaaaagtacttcatccacaatcatttgtcctttacggtgaaatatcacagggatgcacagagggatgtttctaggatagtggcctttgaagtaaaaccctacagtgtgaagcacgaatatggacagtggaatgacaagaagactcatctgaccacttgcgatccgcatgcgaaacgtataattacatcctctgattctcctcaggaggttgaagttggcaaagacattgtcttcacatacgatgtggatttcaaggagagtgatatcaagtgggcatctcgctgggatagttatctgctgatgacagatgatcaaatccattggttctccattgtaaattctctcatgatcgttctcttcctttccggaatggttgcaatgatcatgctccggaccctttatcgggatatctccaagtataaccagcttgagactcaggaggaagcccaagaagaaactggatggaagcttgttcatggtgatgttttcaggccgcctgccaactctgattggctctgtgtttatgttggtacaggtgtccagtttttcggcatgatgcttgtcacgatggtctttgcagtccttggcttcctttctccatccaacagaggtgggctgatgacagctatgctcttgctttgggttttcatgggtttgcttgctggttactcttcttcacgtctctacaagttgttcaagggttcagaatggaagaacattgccttgaggacagcattcaccttccctggcagcgtgttcactgttttcttcttcttgaatattcttatctgggggcagaagtcctctggtgcagttccattcaccacaatgtttgcccttgtcctcctttggttcggtatctcggtgcctctagtgtttgttgggagttaccttggtttcaagaaacctgccattgaagaccctgtgaaaacaaacaagatacccaggcaggtacctgagcaagcctggtacatgaactcaatcttttcgattctaattggaggaatccttccatttggagctgtgttcattgagctcttctttatcctgacctccatctggctgcaccaattctactacatctttgggttcctcttcctcgtcttcctgattctgatcgtcacatgtgccgagatatcgattgtgctctgctacttccagctatgcagtgaggattacctatggtggtggcgatcatacctgacatcaggatcttctgccctgtacctcttcctttatgcgactttctacttcttcacaaagctggagatcacaaagtttgtgtcagccatcctttacttcggctacatgctcatcgcctcatatgcattctttgccttgacgggtacaattggattctatgcctgtttaatgttcaccaggctgatttactcgtctgtgaagattgagtaacacagcgtgcttctccctgattctgttgacacgctgaaggtcgatgttgttgccagtgaatgccgtcctccgaacgtcagttctgagttctgaaagctggttgttaagatgaagtggtgatgtgttatccatggttaaactattatagctagcccggtcagttttgttctcctttttttttggctttagcatctggtcacgaggatgcctgtcaaatgcctgttgcagcgtgaattgtatatggatgctgataaatctcaattccttcttcatgtcgtaatgtaatgtactctctccttaaattaatataagagcgtttacaacac

SEQ ID NO: 2058 - DNA, 2337 bp, Triticum aestivum
ctcaccggcccgagcgctcgagcgaaccgtgagcgaccctcgcccaccgcctcggttccccatgacgatatcgctgccggcgacggcggcggctctgtccgtcgtcctcgccgcgctctgcctcctcgtggtcccggccgccgggttctacctcccgggcgtcgcgcccaacgacttcgaaaagaaagaccatctccctgtgaaagtcaataaactgacttcaattaagacacaacttccctactccttctactctctcccattctgtaagccagatacgatcgttgacagtgctgaaaatctgggtgaagttctccgtggggatcgcattgagaactctccatatgtgtttgaaatgagggtacctcagatgtgtcaaatagtctgcaagatttcagttggggaaaaagaaggaaaggttctcaaggaaaagattgaagatgagtaccgcgtgaacatgattcttgacaacctacctctagttgttcctattcaaagagtggatcaagaaggtgcttatttctatcaacatgggttccatgttggagccaaaggacaatactcagggagtaaggatgaaaagtacttcatccacaatcatttgtcctttacggtgaaatatcacagggatgcacaaagggatgtttctaggatagtggcctttgaagtaaaaccctacagtgtgaagcacgaatatggacagtggaatgacaggaagactcatctgaccacttgcgatccgaatgcgaaacgtataattacatcatctgattctcctctggaggttgaagctggcaaagacattgtcttcacatacgatgtggatttcaaggagagtgatatcaagtgggcatctcgctgggatagttatctgctgatgacagatgatcaaatccattggttctccattgtaaattctctcatgatcgttctcttcctttccggaatggttgcaatgatcatgcttcgaaccctttatcgggatatctccaagtataaccagcttgagactcaggaggaagcccaagaagaaactggatggaagcttgttcatggtgatgttttcaggccgcctgccaactctgattggctctgtgtttatgttggtacaggtgtccagttttttggcatgatgcttgtcacgatggtctttgcagtccttggcttcctttctccatccaacagaggtggactgatgacagctatgctcttgctttgggttttcatgggtttgcttgctggctactcttcttcacgtctttacaagttgttcaagggctcagagtggaagaacattgccttgaggacagcattcaccttccctggcagtgtgttcactgttttcttcttcttgaatattcttatctgggggcagaagtcctctggtgcagttccattcaccacaatgtttgcccttgtcctcctttggtttggtatctcggtgcctttagtgtttgttgggagttaccttggtttcaagaaaccagccattgaagacccagtgaaaacaaacaagatacccaggcaggtacctgagcaagcctggtacatgaactcaatcttttcgattctaattggagggatccttccatttggagctgtgttcattgagctcttctttatcctgacctccatctggctgcaccaattctactacatctttgggttcctcttccttgtcttcctgattctaatcgtcacatgtgccgagatctcgattgtgctctgctacttccagctatgcagtgaggattacctgtggtggtggagatcatacttgacatcaggatcttctgccctgtacctcttcctgtatgcgactttctacttctacacaaagctggagatcacaaagtttgtgtcagccatcctttacttcggctacatgctcatcgcctcatatgcgttctttgccttgacgggtacaattggattctacgcctgtttaatgttcactaggctgatttactcgtctgtgaagattgagtaacagtgctcttctccctaattttctgttgacatggtgaaggtcgatgctgtggccagtgaatgccgccctctaaatttagctatctgtggcatcagttctgagttctgaaagctggctgttaagatgaagtggtgatgtgttatccatggttaaactatcatagctagctccgtgagttttattctcttgtcccttttttggctttagcatctggatcacgaggatgcctgtgaagtaccagttgtgaattgtatgtggatgctgataaagtacctgttgtgaattgtatatggatgctgataaatctcaattacttcatgccagaatgtaatgtaattgttgatgta

SEQ ID NO: 2059 - DNA, 2369 bp, Triticum aestivum
attctcctctcgccactctcaccggcccgagcgctcgagcgaaccgtgagcgaccctcgcccaccgcctccgttccccatgacgatatcgctgccggcgacggcggcggctctgtccgtcgtcctcgccgcgctctgcctccttgtggtcccggccgccggattctacctcccgggcgtcgcgcccaacgacttcgaaaagaaagaccatctccctgtgaaagtcaataaactgacttcaattaagacacaacttccctactccttctactctctcccattctgtaagccagatacgatcgttgacagtgctgaaaatctgggtgaagttctccgtggggatcgcattgagaactctccatatgtgtttgaaatgagggtacctcagatgtgtcaaatagtctgcaagatttcagttggggaaaaagaaggaaaggttctcaaggaaaagattgaagatgagtaccgcgtgaacatgattcttgacaacctacctctagttgttcctattcaaagagtggatcaagaaggtgcttatttctatcaacatgggttccatgttggagccaaaggacaatactcagggagtaaggatgaaaagtacttcatccacaatcatttgtcctttacggtgaaatatcacagggatgcacaaagggatgtttctaggatagtggcctttgaagtaaaaccctacagtgtgaagcacgaatatggacagtggaatgacaggaagactcatctgaccacttgcgatccgaatgcgaaacgtataattacatcatctgattctcctctggaggttgaagctggcaaagacattgtcttcacatacgatgtggatttcaaggagagtgatatcaagtgggcatctcgctgggatagttatctgctgatgacagatgatcaaatccattggttctccattgtaaattctctcatgatcgttctcttcctttccggaatggttgcaatgatcatgcttcgaaccctttatcgggatatctccaagtataaccagcttgagactcaggaggaagcccaagaagaaactggatggaagcttgttcatggtgatgttttcaggccgcctgccaactctgattggctctgtgtttatgttggtacaggtgtccagttttttggcatgatgcttgtcacgatggtctttgcagtccttggcttcctttctccatccaacagaggtggactgatgacagctatgctcttgctttgggttttcatgggtttgcttgctggctactcttcttcacgtctttacaagttgttcaagggctcagagtggaagaacattgccttgaggacagcattcaccttccctggcagtgtgttcactgttttcttcttcttgaatattcttatctgggggcagaagtcttctggtgcagttccattcaccacaatgtttgcccttgtcctcctttggtttggtatctcggtgcctttagtgtttgttgggagttaccttggtttcaagaaaccagccattgaagacccagtgaaaacaaacaagatacccaggcaggtacctgagcaagcctggtacatgaactcaatcttttcgattctaattggagggatccttccatttggagctgtgttcattgagctcttctttatcctgacctccatctggctgcaccaattctactacatctttgggttcctcttccttgtcttcctgattctaatcgtcacatgtgccgagatctcgattgtgctctgctacttccagctatgcagtgaggattacttgtggtggtggagatcatacttgacatcaggatcttctgccctgtacctcttcctgtatgcgactttctacttctacacaaagctggagatcacaaagtttgtgtcagccatcctttacttcggctacatgctcatcgcctcatatgcgttctttgccttgacgggtacaattggattctatgcctgtttaatgttcactaggctgatttactcgtctgtgaagattgagtaatagtgttcttctccctaattttctgttgacatggtgaaggtcgatgatgtggccagtgaatgccaccctctaaatttagctatctatggcatcaattctgagttctgaaagctggctgttaaagatgaagtggtgatgtgttatccatggttaaactatcatagctagctccgtgagttttattctcttgttccttttttggctttagcatctggatcacgaggatgcctgtgaagtacctgttgtgaattgtatgtggatgctgataaagtacctattctgaattgtatatggatgctgataaatctcaattacttcatgccagaatgtaatgtaattgttgacgtacattgagccttttt

SEQ ID NO: 2060 - DNA, 1835 bp, Pennisetum glaucum
gggggctcgtcttcttccagtagcgagtgggggactgcgaggagagagagagagagagcctctgcctcagatccgccgagtctccgagccccagtctcccccatgcggccgccggcgatgctccgctgggccacggtggcgctcgcgctcgcgctcgcggcgctcctcgccgccgcgccggccgccgccttctacctccccggcgtcgcgcccaacgacttccagaagaaagatcaacttttggtgaaggtgaataagctgacatccacaaagacacagcttccctactcctattattctcttcctttctgcaagccaaacacgatagttgatagtgctgagaatcttggagaagttctgcgtggtgatcgcattgagaactccccttatgtgtttgagatgagggagcctaagatgtgccagattgtctgcaaagcatcgattgatgagaaacaagcaaaggagctcaaggaaaagatagaggatgagtatcgggtgaacatgattcttgataacctcccactagttgttcctattgcaaggcaggatagggatgccacagtttatcagggaggatatcatgttggtgtcaagggccaatacgctggtaacaaggatgagaaggtctttatccacaaccacttgacatttttagtcaaataccacaaggatgaaactacagaactctctagaattgttggatttgaggtcaaaccattcagtatcaaccatcagtttgaaggccagtggaatgataaaaacactcgtttgatcacatgtgatcctcatgccaacaagctcgtgacaagctcagatactcctcaggaggttgaagctggaaaggaaatcatatttacatatgatgttggctatgaggagagtgatgtcaagtgggcttctcgctgggacacctacctgttaatgacagatgatcaaattcactggttttctattgtgaactctctcatgattgtactcttcttatctgggatggtggccatgattatgctccgcactctgtatagagatatctccaggtacaaccagcttgaaactgaagaagaagcccaagaagagacaggatggaagcttgttcatggagatgtgttccgacctcctgaaaactcggacttgctctgtgtctgcgttgggactggtgttcagttctttggtatgctgctagtaaccatgatttttgctgttctgggattcctttcgccatcgaaccgaggagggctgatgactgccatgctgctcacttgggtcttgatgggattgtttgctggatatgcttcatcacgcttctataagatgttcaaaggatcagaatggaagagtatcaccctaaagaccgccttcctgtttcctgggattgctttcggtattttcttcatcttgaatgctcttatatggggggagaagtcatctggtgctgttcctttcaccacaatgtttgccttggtcctcctttggttcggtatctcggttcctcttgtatttgttgggagctatctgggcttcaagcaacctgccattgaggctccggtgaagaccaacaagatcccgagacaggtccctgagcaggcttggtacatgcaccctgccttcactgttcttattggtggcattcttccatttggggctgtctttattgagctcttcttcatcctcacatcaatctggcttcatcagttctactacatctttggcttccttttcctggtgttcatcattctcatcatcacctgtgcggagattacgatcgtgctgtgctatttccaactgtgcagtgaggactataattggtggtggaggtcctatctcacctcaggatc

SEQ ID NO: 2061 - DNA, 2407 bp, Gossypium hirsutum
cttctctctgtccttcactttctcttcatttcttccctcacaaacaagaaattcaactcagtaagtaaggttttcttcttctttaatccttggaaagtgggaatctgggaaacggctctagatccggacagaaaccatggcgggtcataggtttgacgtcgcatggaccttctctttggtagctctcttcttccttcgagcccattgtttctacctccctggtgttgctcctgaagatttcaaaaagggagatccattgttggtgaaagtgaataagctgacttcaactaaaactcaacttccttattcctattattccctacccttttgtcggcctgagcatatagttgacagtgcagagaatcttggggaagtcctccgtggtgatcgtatcgaaaactctccttatgtgtttaaaatgagagaaccacaaatgtgcaatattgtatgtcgtaaaattcttgataaaaaagctgcaaaggctttcaaggagaagatcaacgatgagtatcgagttaacatgattttggataaccttccattggttgttcctataagaaggcctgatcaggaaaatgctgtagtgtatcagtatggatatcatgttggtctcagaggacagtatgctgggagcaaggaagaaaaacactttatccacaatcacttgacttttacagtcaaatatcacaaggatccattgtcaggctctgcaaggattgttggatttgaggtcaaaccattcagtgttaaacatgaacacgaaggtgagtggaatgagaagacccgtctgacaacctgtgacccccatgcaaaacgtgctgttactagttctgaatctcctcaagaggttgaagaaaaaaaggagatcatatttacatatgatgtcgagttccaggaaagtgatataaagtgggcatcccgatgggatacctatcttctaatggctgatgatcagatccattggttctcaattgttaattcattgatgatcgtacttttcctctcagggatggtggctatgatcatgcttcgaactctttatcgggatatctccaagtataaccaacttgaaacccaagaagaagcccaggaggagacagggtggaagctggtccatggggatgttttcaggcctccagccaattctgacttactctgtgtgtatgtgggaacaggggttcaattttttggtatgattcttgttatgatgatctttgctctcctcggctttctgtccccctcaaatagaggtgggctaatgacagccatgctcctactctgggtcttcatgggcctgtttgctggatattcctcagctcgtctctataagctgttcaagggaacagaatggaagaaaattacactcaaaacagcatttatgttccctgcaactgtatttgccattttctttgtcttgaatgctctgatatggggccagaaatcttcaggagcggtgccatttggaaccatgtttgcattggtattgttgtggtttggaatctcagtaccactcgtttttgtgggtagttattttggttttaagaagccagcaactgaggatccagtgaaaactaataaaatcccaaggcaaattccagaacaggcttggtacatgaacccagccttctccatcctaattgggggtatacttccattcggggctgttttcattgagctctttttcatcctcacttcaatatggttgcatcagttctattacatatttggcttcctcttcattgtctttgtcattcttattatcacttgtgccgagatcacagtcgtactctgctacttccagctatgcagtgaggattacctatggtggtggagatcatacttgacttcgggttcttcagcattttacttattcctctatgctgccttctacttctttacaaagcttgagatcacaaaggctgtatctggggttttatactttgggtatatgttgataatatcttactcgttcttcgtgctaactggtacaattggtttctatgcttgcttctggttcacaaggctcatctactcatctgtgaagattgattgatctgatattgcaacttgaggaagatttagtttgtttcattacaaggatgttcagattacacaaaacagaggaaatcggcgaattaccatttggggttcagttttgaatctttgatcatagaaattgttaattatcttagccacctccatacaggttctatggtggttgttggctatgtttacttgttaattggttccattactattttgtataagacccttgagagattgttgagaaatctcttctagaattgaaggatccatgtattcacacgcataatagtccttgcaattctgtgaagaatgaattccaaatttgtgtcctttaaggataataaaagaaattatcaattca

SEQ ID NO: 2062 - DNA, 1445 bp, Phaseolus coccineus
ccgttgctgtcattggaaagtgcaagtggtttcataggaatttgaggttgtcttctttgctcttcaaacatgggaaaacagagcacacaattctctgccctcaactgcatcgacctatccaactctgacatcaaccaatccgttcatttactcaaacaggcttgtttggattcgggttttttctacgttgtcaaccatgggataagccaggagttcatggacgaggtttttgcacagagcaagaggtttttctctcttcctcaccaggaaaagatgaagattctcaggaatgaaaagcacaggggatatacccctgttcttgatgaactacttgatcctgaaaatcaagttcgtggggactataaagaggggtactatattggagttgaaaaagctgaagatgacccagaatcgaagaagcctttctatggtcagaataaatggcccgcaccagatgttttgccggggtggagggagaccatggaaaagttccatcgagatacactagaagtggggaaaagtgttgcaaagataatagcccttgcacttgatttggatgaaaagttttttgaccagccaaaaatgttcggagagccaattgcaactctgcgtttgcttcactatggaggtcaaatctctgatccctcaaaaggattatatggagctggagctcacactgactatggtttaattacactgttggcaacagatgatgttgcaggccttcaaatatgcaagaatagggatgctaaacctcagatatgggaggatgtggcaccattgaagggagccttcattgtgaatcttggtgacatgctggagcgctggagcaactgtatttttaagtccacactgcacagagttctaggaaatggtcaagaaagatattctattgcatacttcttggagcctagtcatgattgtctagtagagtgcttgcctacctgcaaatcagatagtaatccccccaaatttcctcccatcttatgtcaggactacctgactcagcgctatgaggacactcatgctgatttgaaaatttacaagaaacagcaagcttgagaagtcaacctttggaactgaacagtgttttttcacaagaacactcacttatgctgatttggatatttaccataaaagataaccttaaggatttggtcttttggagctgagtagcctggaaattttgtactgcatgttgttttagagacaacagcatcatatgttagacatgttatttagattttgttggaattacaaattagattgtcctggggaatggggtggggagttagctatatatggtttggttcttattgttacaccttaaacaaaaacatgaatgaaatcaaccgatgtattttatttattcagcccaatgctgggaatatgatatgaagatgaaaattagcatcgcttctagtcaataaatatactttgcaacc

SEQ ID NO: 2063 - DNA, 1445 bp, Vigna unguiculata
  misc_feature (1406)..(1406): n is a, c, g, or t
ggggtggtcattcgaaagtgcaaagtggtttcaggaatttgaggctgtccttctttgctcttcaaacatgggaaaacagagtacacaattctctgtcctcaactgcatcgacctttccaactccgacatcgaccaatccgttcgtttactcaaacaggcgtgtttggattccggttttttctacgttgtcaaccatggcataagccaggaattcatggacgaggtttttacacagagcaagaagtttttctctctccccctcgaggaaaaaatgaagattctcaggaatgaaaaacacaggggatatacccctgttcttgatgaacttcttgatcctgaaaatcaagttcgtggagactacaaagaggggtattatattggagttgaaaaaggtgaagatgacccagaatcgaagaagcctttctatggtcagaataaatggcctgcaccagatgttttgccggggtggagggagaccatggaaaagttccatagagagacattagaagtggggaaagctgttgcaaagataatagcccttgcacttgatttggatgaaacattttttgaccagccaaaaatgttcggagagccaattgcaactctgcgtttgctgcattatggaggtcaaatatcagatccctcaaaaggattatatggagctggagctcacactgactatggtttaataacactgttggcaacagatgatgtttcaggccttcaaatatgcaagaatagggatgctaaacctcagatatgggaggatgtggcaccattgaagggagccttcattgtgaatcttggtgacatgctggagcgctggagcaactgtgtttttaagtccacactgcacagagttctaggaaatggtcaagaaagatattctattgcatacttcttggagccaagtcatgattgtctagtagagtgcttgccaacctgcaagtctgatagtaatcctgccaaatttcctcccatcttatgccaggactacctgactcagcgctacaaggacactcatgcagatctgaaaatttacaagaaacagcaagcttgagtagtcaacctttggaacttaacagcctagtgttttttcacaagaacactcacttacactgatttggatatttaccataaacaagaagcttaagtagtttgtcttttggagctgagtagccagggaattttaaactgcatgttgttttagagacaacagcatcatatgttagatatgttatttagattttgttggaatgacaaattagatagtcctggggacggggtggggagatagctacatggtttggtacttattgctatagctaaaagaaaaacatgaatgaaatcaagcgatgtatttttttattcagcccaatgctgggaataggatatgaagatgaaanttagcactgcttctagtcaataaatatactttgcaaaca

SEQ ID NO: 2064 - DNA, 1577 bp, Lotus japonicus
tttttctttagaaaaaagaaaaaaaaaacatcatcaaaaaccattcacttttcctcttttaatcattgctattgctattgctatttgcttctccttcatttcattgttcttcttcattccaacatgggaaaacagagcaccccttcccctgaagccaccgccaaattctctgctctcaactgcatcaacctctccaatcctgacatcaaccaatccgtgaaactgctcaaacaggcttgtttggattctggttttttctacgttgtcaaccatggaataagccaggagttcatggacgaggtttttgaacaaagcaagagatttttcacccttcctctcaaagaaaagatgaagattctcagaaatgaaaagcacagggggtacacccctgttcttgatgagctacttgatccagaaaaccaagtgcatggggattacaaagaggggtactatataggagttgaagttgctgaagatgacccagaatcgcagaaacctttttatgggccaaataaatggcctgcaccagatattctgccggggtggagggagaccatggaaaaattccatagagaagcattagaagtggggaaagcagttgcaaaggtaatagccctcgcacttgatttggatgctaattttttccatcagccagaaatgctgggtgaggccattgcaactctacgtttgttgcactatgaaggtcaaatttcggatccctcgaaagggttatatggagccggagctcatactgactttggtttaattacactattggcaacagatgatgtctcaggtcttcaaatatgcaaggatagggatgctaaacctcagatatgggaggatgtcgcaccattgaagggagcatttatagtgaatcttggtgacatgctagagcgctggagcaacggtgttttcaagtccacgctgcacagagttctaggaaatggtcaagagagatattctattgcatactttttggagcctagtcatgattgtctagtggagtgcttgccaacctgcaaatcagatagcaatcctcccaaatttcctcctatcttatgccgagactacctgagccagcgctacaatgatactcatgctgatttgaatgtttacaagaaacagcaagcctaagcctggagaactgcatgttgtgttagggatacattcaacaccttattatatagattttgtttaagtagccgattagatatatgtttttttttttttgggaggggagtttgtttagggaaggaggtttagctattcagttcaactttaatatattcacactaagtttctcttctatctcatttccactaatttttttctgtctatccctcttctgtttctatgagccattattcatcatatctcccacttctgtgcctttcatcagattcagttttgttttgtacttgttatttgatctagaaagtaaatatgaagtaatgtattacttttcattcaacgttaaatttgggagtgataagtcttttcctattaagtgggtcgactatgcaatgttatggagctctatcttgtaataaatttatagatagattgtttacctt

SEQ ID NO: 2065 - DNA, 1438 bp, Medicago truncatula
ggattcactagtttgtgtttgtaattcaaagtggtttttaaggtcctcttttttcttcattcttcttcaatttccaaaacatgggaaaacagagcaaagaaacagaatcccctgtttctgacccaacaaaattctctatcctcaatcttatcgacctttcaaattcaaacataaaccaatccgttaatttactcaaacaggcgtgtttggattctggttttttctatgttgtaaaccatggaattagtgaggaattcatggatgaggtttttgaacaaagtaagcgatttttcacccttcctttgaaggaaaagatgaagattttgaggaatgaaaaacatagaggatatacccctgttcttgatgagttacttgatcctgaaaatcaacttcatgtaggggattacaaagaagggtattatattggagttgaagtagatgaagatgacccagaatcaaataaacccttttatgggcctaataaatggcctgcaccagatattcttccaggatggagggagacaatggaaaagtttcacagagaagcattagaagtggggaaagcagttggaaagataatagcccttgcgcttgatttagatgctgattttttcgataagccggaaatgctgggagagtcaattgcgactctacgtttgctgcactatggaggtcaagtatcggatcccttgaaaggattatttggagctggagctcataccgactatggtttaattacgctgttagcaaccgatcatgtctctggtcttcagatatgcaaggatagggatgctaaacctcagaaatgggaggatgtggcaccattgaaaggggcattcgtagtgaatcttggtgacatgcttgagcgttggagcaacggtgttttcaagtccacactgcaccgagttctaggaaatggtcaagagagatattcgattgcatactttttggagcctagccatgattgtcttgtggagtgcctaccaacctgcaaatcagacactaaccctcccaaatatcctcctatcttatgccgcgactacctcagccagcgctacaatgatactcatgctgatttgaaaatttacaagaaacaacaatcataagtagaactagtcagtgtttggagttgaggagcctagagaattttgtttcttagttttgttaatttctttaagcctttttaattgcataatgttttaggaataacagcaccatgtgtttgttgtattatatagcttttgtttaaatagcaaaataattttttaggggggagagagggttagatattcagtttagtacttgttgattctaaaagaaaaccatatatgaaaatccatgttttcactcaataatactcttacattgtgtggtgcacaatatatattgacttaacatgtggtctcatacaaaataaatggaatatacaagtttggtt

SEQ ID NO: 2066 - DNA, 1478 bp, Arachis hypogaea
gtccttcatttttcttcgtcttctttgttccaagttccagcatggttaacgcagattctctcacctcttccctcaattgtgtcgacctctccaaccctgacataaaccaatccgttaattcgctcaaacaggcatgcttggattctggtttcttctacgttgtgaatcatggaataagccaggaattcatggacgaggtttttgcagagagcaagaaattcttctctcttccacataaggagaagatgaagctcctcaggaatgagaagcatagggggtatactcctgttcttgatgaactacttgatcctgaaaaaccaagttcatggagattacaaagagggatattatattggagttgaagtagctgaagatgatccaaaatcacataaacctttctatggaccaaatcgatggccttcgtcaggtattctgcctaaatggagggagactatggaaaaataccatgaacaagcattagaagtgggaaaaaaagttgcaaggataattgcccttgctcttggtttggatgccaatttctttgatcagccgaaaatgctcggagagccaattgcagttctgcgtttgctgcactatgaaggtagaatatcagatcccacaaaaggattatttggagctggagctcatactgattatgggttaattacactattggcgacggatgagatctcaggtcttcaaatatgtaaagatagggatgctaagcctcagaaatgggaggatgtgccgccaatgaagggagcattcatagtgaatatcggtgacatgctggagcgctggagcaactgtgttttcaagtctacactgcacagagttctgggaaacggtaaagagagatattctattccattctttttggagcctagtcatgaatgtctagtgaaatgcttgccaacatgcaaatccgccacaaatccttccaagtttcctcctatcctatgccaggactacctgagccaacgatacaacgatactcacgccaatcttactatttacaagaaacagcaaaatcttcaatactaaaatcctttggacccaagaacagtactactcatgcagaattggacatttcaatgtaagcttaaaatcttaagtatcaaatcttttggaggtgtgaatcctaaagagaatggaaattgctgttttgtttacctacaagcatagtgcattagccaccttatatgtatagatttagtttttacatggtaggtagttggtttgatgtttactaaagctaaaggggaaaaagaaacatatatatgaaattaacagttgtattttattttatttttttgtttggttcaagctcaaatttaggaattataggaggaaggatggtaggatttgcttccacttccattgtgcttttcaaacttttagcacattcaatttctaatgtaggacttgcaaatgaaatttatcttccatatttttcatttatcattagataattattt

SEQ ID NO: 2067 - DNA, 2451 bp, Sorghum bicolor
agccgttttgggcgacttgtcgcgtgtccgcgtccaccctctctcccttcctcggtttcgtggcccgttaccccaccccgctacccgcttctctgcgtgggcacctgacgccgcgggcgaccccgaccccgagcgggctttgccggccaatcggctcgcccgcgccgaccaccgcgtcggccgccgcgcctcctctcctcgccgagatcacctgaaaaggcaagcgaggccagcctgaaaccccacagaagcccgaaccaaaaaaacgagagggccatttcgtctgcccgctcgcgctcggtcgctctcgcccaccccgcgcccccaactcgcctgccttccacttcctccgctctcccgatttctcctccgattccttcgccgacccgtttcttcttggcaatttttggttgcgcgggccatcgccccgccggcgcctgggtacagcagctacaggacagggccaggtccctcttctaggagaggcctcgcccgccgcctcccgccccgtctctacgggcgccgccgtggcccgtggagcggagatccatccggacttggatcggtctcgtctcctgataacagctattgttctattgccagttcgagcaatatgggttggctgaccaagttttttagaggctcaacccacaatatctcggaagggcagtatcacagcaggcctgcagaagatacagcatggaatgaaccctctagctctcctgttgtcactgacatcttttcagagtttaacaatgaggatattgaccgtgctatagcactctctctatcggaagaggagcaaagaaaggcaaagaccatagataaggatatgcatttggaggaggatgagcaacttgcaagagctatccaggaaagtttgaatgttgaatcaccccctcgcagaaatggcagtgccaatggtggcactacatatcatctgcctcgcgaaactggcaatggtggcaatgcatatcagccatctcgcgaaaatggcagtgccaatggtggaaatgcatatcacccattaccatttatgttctcatccggattcagagcgtgcgctggatgtcacagagagattggtcacgggcgttttctcagttgcatgggagctgtttggcatccagaatgctttcgttgccatgcctgtagtcaaccgatatatgactatgagttctccatgtccgggaatcatccataccataaaacttgctacaaggagcagtttcacccaaaatgtgatgtctgcaagcaatttattcctacaaatatgaatggccttattgaatatagggcacatcctttctggctacaaaaatactgtccttcacatgaagttgatggcactccgagatgttgtagttgtgaaagaatggagccaagggaatcaagatatgtattactggatgatggtcgtaagctctgcctggagtgccttgattctgcagtgatggatacaaacgagtgtcagcctttgtatcttgaaattcaggaattttacgaaggactgaatatgaaagtggaacagcaggttcctctgcttctggtagagagacaagctttgaatgaagccatggaaggagagaaggctggtcaccaccatcttccagaaacaagaggactgtgcttatcagaagaacagactgttagcacgatactgaggagaccaagaatggctggaaacaaaattatgggaatgataacagagccatataggctgacacggcgatgtgaagtgactgcaattctcattctgtatggtctcccaagattgttgacaggttcaattttagctcatgagatgatgcatgcatggttgcgacttaaaggataccggacactgagtccagacgtagaagagggcatttgccaagttcttgctcacctgtggatcgagtcagagatcatggccggatcaggcagtggtgctgcttcgtcatcctcaggatcttcatcatccatgtcatccaaaaaggcggggcggtctcagtttgagcacaagcttggggattttttcaagcatcagatcgagacagatacttccatggcctacggagagggtttcagagccgggaaccgggccgttcttcagtacggcctgaagcgcaccctcgagcatatccggctgacagggacctttccattttgaagtggcatggattcacattttgcggaaaatcttatattatatacgtgatttgtcatccagtgttcctttacagccaaagaaaccaattgtacaaacattctttccagaatccagagatatatcttggaaggcaaaatgggtattaaatggttgagatcgatggccagcctgaccaatcattttgtattgtgaccaaactctggaacgaaaacaatggtaattttttttttacacatggcgtgaatttcaataaataccagtacgattttacagtatgtatatacagttgcttgaacttg

SEQ ID NO: 2068 - DNA, 2157 bp, Panicum virgatum
aaaagagaggggccatttcgtcttggtaggatcgcaacctgcccgctcgcgcccggtcgtactcgctcgccccccagccgccttccactcccttccttcctccgttgtctccccgatttctccgattccttcgccggctcgtttttttttttcctggcaattcgttgcgcgggcaatcgcagccgtcttttgggggcagcagctacaggccaggcatctcttcgaggacaggcctcgcccgccgcctcccggcccctctccgcgggcgccgtggagcggagatccatccggacgtggatcggtctcgcctcctgataacagctattgttccactgccattttgagcaatatgggttggcttacaaagttttttagaggttcaacccacaatatctcggaaggtcagtatcacagcaggcctgcagaagagacaacatggaatgaaccctcgagctctcctgttgttactgactttctttcagattttaacaatgaggatattgaccgtgctatagcactctctctatcagaagaggaacaaagaaaggcaaaggcaatagacaaggatatgcatttggaggaagatgagctacttgcaagagctatccaggaaagtttgaatgttgaatcaccacctcgcagaaatggcagtgccaatggaggcaatacatatcatctgcctcgtgaacctggcatcaccaatggtggcaatacatatcaaccacctcgcgaaaatggcactgccaatggtggcaatgcatatcaaccattaccatttatgttctcatctggattcagggcatgcgcaggatgtcaccgagagattggtcacggtcgttttctcagttgcatgggtgctgtttggcatccagaatgtttttgttgccatgcctgcagtcaaccgatatatgactatgagttctccatgtcagggaatcatccgtaccataaaacttgctacaaagagcagtttcaccccaaatgtgatgtctgcaaacaatttattcctacaaatatgaatggccttattgaatatagggcacatcctttctggctacaaaaatactgcccttcacatgaagtggatggtactccaaggtgctgtagttgtgaaagaatggagccaagggaatcaaaatatgtattgctggatgatggtcgtaagctctgcctggagtgccttgattctgcagtaatggatacaagcgagtgtcaacctctgtatcttgaaatccaggaattttatgaaggtctgaatatgaaagtggaacagcaggttcctctgcttctggtagagagacaggctttaaatgaagccatggaaggagagaaggctggtcaccatcatcttccagaaacaagaggactgtgcttatctgaagaacagactgttagcacgatactgaggagaccaagaatggctggaaacaaaatcatggaaatgataacagagccatataggctgacaaggcgatgtgaagtgactgcaattctcattctgtatggtcttccaaggttgttgacgggttcaattttagctcatgagatgatgcatgcatggttgcgacttagaggataccggacattgagtccagacgtagaagagggcatctgccaagtccttgctcacatgtggatagagtcagagattatggcaggatcaggcagcagtgctgcatcatcgtcctcaggttcttcaacgtccagatcatcgaagaaggggggacggtctcagtttgagcggaagcttggggattttttcaagcatcagattgagacggacacatccatggcctacggagagggtttcagagccgggaaccgggccgtcatgcagtacggcctgaagcgcaccctcgagcatatccggctgacagggaccttcccattttgaaacggcatggatggattcacattttggcgagaagcttacatcacatacatgattgtcatttggagttcctttacagccaaagaaatcaactgtacaaacattctttccggaatccagatacatcttggaagggctaactgaagcattggatgagtcgtgatggccagcctgaccaatcattttgtattgtattgtaaccaaactgtggaacgaaaacaatggtatatctgttacatggtgtgaatttcaataagaaaaaaata

SEQ ID NO: 2069 - DNA, 1728 bp, Pennisetum glaucum
gctgagcaagttttttagaggttcaaccctcaatatcgcggaagggcagtatcacagcaggcctgcggaagagacatcatggaatgaaccctctagctctcatgttgtgactgacttccattcagagtttaacaatgaggatattgaccgtgctatagcactctctttattagaagaggaacaaagaaaggcaaagaatatagacaagcatacacatttggaggacgatgagctacttgcaagagctatccaggaaagcttgaatgctgaatcgccccctcacagaaatgccagtgccagtggtggcaatacatatcatccgcctcgtgaacctggcgctgccaatggtggcagtacataccaaccatttcgtgaaaatggcaccgcaaatggtggcaatgcatatcaaccattaccatttatgttctcatctggattcagggaatgtgcaggatgtcagagagagattggtcacggtcgttttctcagttgcatgggagctgtttggcatccagaatgttttcgttgtcatgcctgcagtcaaccaatatatgactatgagttctccatgtcggggaatcatccgtaccataaaacttgctacaaggagcagtttcacccaaaatgtgatgtctgcaagcaatttattcctacaaatatgaatggccttattgaatatagggcacatcctttctggctacaaaaatactgtccttcgcatgaagtggatggtactccaaggtgctgtagttgtgaaagaatggagccaagggaatcaagatatgtattgctggatgatggtcgcaagctctgcctagagtgtcttgattctgcagtgatggatacaagcgagtgccaacctctgtatcttgaaattcaggaattttacgaaggtctgaatatgaaagtggaacagcaggttcctttgcttctggtagagagacaggctttaaacgaagccatggaaggagagaaggctggtcaccaccatcttccagaaacaagaggactgtgcttatcagaagaacagacagttagcacgatactgaggagaccaagaatggctggaaacaaaattatggaaatgataacagagccatataggctgacacgacgatgtgaagtgactgcaattcttattctgtatggcctcccaaggttgctgacaggttcaatattagctcatgagatgatgcatgcatggttgcgacttagaggataccgtacactgagtccagacgtggaagagggcatctgccaagtccttgctcacatgtggatcgagtcagagatcgtggcaggatcaggcagtagcgctgcatcatcttcctcgggctcttcgacatcatcgaaaaaggggggacggtctcagtttgagcggaagctcggggatttcttcaagcaccagattgagtcggacacatccatggcctacggggacggtttcagagccgggaaccgggccgtgatgcagtatggcctgaagcgcaccctcgagcatatccggctaacagggaccttcccattttgaaacagcatggattcaccttcccattttgaaacggcatggattcgcgttttggggaagcttacattacatacatgattgcctttacagccaaaaaagaaatcattgtacaaatattctttccagaatccaggtataacctttggaagggctaaatgaaagtatcgaatgagctgactgatggatggcgcccagagcct

SEQ ID NO: 2070 - DNA, 2179 bp, Oryza sativa
gagcgggtcacctgcctcctcctgccgtgccacaaaaagcaaggcaaagcagcagcgaggaggcgagacagattcccaaatcccgcacaaccccaccccgaatccaccaccccacgccaagcccgctcgccgccgccgcccgagcgcgcgcgcgtacgggcacggcgggcgtacgacgccggaggtggggatcgagcgtgccccctcctccgtcgcggcgggcgacgtcggacgtcgtcggtcgtagcttgccttcgtttcgttgtcgggttttcggtgctgctgctgctgctggtggtggtcgagcaaaggccggtggcggatcgccggcggtcccgtccgcgggaggggcgcgggtgacgcggtgatcagataaaagtgtcccttccaacattgccatttggagctctatgggttggttgaccaaattttttagaggttcaacccacaaaatctcggaagggcaataccacagcaaacccgcggaggagacgatatggaatggaccctctaattccgcagttgtgacggatgtcccgtcagaatttgacaatgaagatatcgctcgtgctatatcactctctctattagaggaggaacaaagaaaggcaaaggcaatagaaaaggacatgcatttggaggaggatgaacaacttgcaagagctatccaggaaagtttgaatgttgaatcgcctcctcgtgctcgtgaaaatggcaacgccaatggtggcaatatgtatcaaccactgccatttatgttttcttctggattcaggacttgtgccggatgtcacagtgagattggtcatgggcgtttccttagttgcatgggagctgtttggcatccagaatgttttcgctgtcatgcttgtaatcaaccaatatatgactatgagttctccatgtcgggaaaccatccataccataaaacatgctacaaggagcgctttcacccaaaatgtgatgtctgcaagcaatttattcctacaaatatgaatggcctgattgaatatagagcacatcctttctggttacaaaaatactgtccatcacatgaggtggacggtactccaagatgctgtagttgtgaaagaatggagccaagggaatcaagatatgtattgctggacgatggtcgcaaactctgcctggagtgccttgattctgcagttatggatacgagcgagtgccaacctctttatcttgaaatacaggaattttatgaaggcctaaatatgaaagtggaacaacaagttcccttgcttcttgtagaaagacaggctttaaatgaagccatggaaggagagaagactggtcaccaccatcttccagaaacaagaggtttatgcttatcagaagagcaaactgtcagcacgatattgaggagaccaagaatggctggaaataaagttatggaaatgataacggagccatataggttgactcgtcgatgtgaagtgactgcaattctcattctttatggtctcccaagattgttgacaggttcaattttagctcatgagatgatgcatgcgtggttgcgacttaaaggatatcgcacacttagtccagacgtagaagagggcatatgccaagttcttgctcacatgtggattgagtcagagatcattgcaggatcaggcagtaatggtgcttcaacgtcttcatcctcatcagcatccacatcatcgaaaaaggggggaagatctcagtttgagcgaaagcttggtgattttttcaagcaccaaattgagtcagatacctcaatggcctatggcgatggttttagagctggcaaccgagctgttcttcagtatggtctaaagcgcacccttgagcatatccggttaacagggactttcccattttgaaatttcatagattcgtcttttgatggaagttatacacgatcgatttgtcattaagcgtccatttacaggaaaagaaagcaattttgagatgtgcaattgtacaaacaatcttttcagttacttttggaagggctaactgacgacattgattaaattgtgatatggttagcccaaccaatcacacatgtatggcattcagaaattctaatggaaacagcggtattttttatgtgacaaaaattaataagaaatttatactaccatgtacaagtgagattctaatggaaacagtagtatgttttatggtt

SEQ ID NO: 2071 - DNA, 2216 bp, Triticum aestivum
tcggacgaggcgcccgccaatcccgccgcggcccggagcgatccaccgccccgccgaccgaccccgcggtcggggtggccggagccggggccctgccctcgcgggtccggttcacgccgtttcttccccgggcgcggcgcccggcggaggcccccctccgatctgtatccatccgtctccccccgcgtagcgcccggcgccgcccgacgcgtcccgccgtcgccgacgccggctgcccccccgccccaccggatcgctgcgccggccgcccccgcctcccgcccgcggccgcgggccccccgtcgcgcgagataacggtgttccttcattgccatttgggaaaatatgggttggttgaccaaattttttagaggttcaacccacaacatctcggaagggcgagaacaaagcaagcctgcagaagagacaagatggaatgaaccctccacttccactgttgtgattgatcccctttcggaatttgataatgaggatattgaccgtgctatagcactttctctattagaagaggaacacagaaaaccaaaggaaacaggaaaggatctgcatttagatgaggatgaacaactggcaagagctattcaggaaagtttgaatgttgaatcaccccctcgtgctcatgaaaatgcctcaccccctcgtcctcgtgaaaatagtgcacaccctcgtgctcgggaaaatggcaatgccaacggcggcaattcgtatcaacagttaccatttatgttttcgtctggattcaggacatgtgctggatgtcacaatgagattggccatggacgttttcttagttgcatgggagctgtttggcatccagagtgcttttgctgccatgcttgtaatcagccaatatatgactatgagttctccatgtcaggaaaccatccataccataaaacttgttacaaggagcgctttcatccaaaatgtgatgtctgcaagcaatttattcctacaaatatgaacggccttatcgaatatagggcacatcctttttggttacaaaaatactgtccatcacatgaggtggatggtactccaagatgctgtagttgtgaaagaatggagccaagggaatcaagatatgtattgcttgatgatggtcgtaaactctgcctggagtgccttgactctgcagtgatggatacaaatgagtgccagcctctttatctcgaaatacaggaattttatgaaggtctcaatatgaaagtggaacaacaggttcctctgcttcttgtagaaagacaggctttaaatgaagccatggaaggagagaaaactggacaccaccaccttcctgaaaccagaggtttgtgcttatcggaagagcagactgtcagcacgatattgaggagaccaagaatgacgggaaacaaaattatggaaatgataacagagccgtataggttgacacggcgatgtgaagtgactgcaattctcattctatatggtctcccaagattgttgacaggttcaattttagctcatgagatgatgcatgcgtggttgcgtcttaaaggataccgcacactcactccagatatagaagagggcatatgccaagtccttgcccacctgtggatcgagtcggagatcatggcaggatcaggcagcaacgccgcatcgacatcctcatcctcttcatcatccacatcgtcgaagaagggcggtaggtctcagttcgagcggaagctcggtgacttcttcaagcaccagatcgagtcggacacctccgttgcctacggggacggtttcagagctgggaaccgggttgttcagcagtacggcctgaagcgcaccctcgagcacatccggctgacagggaccttgccgttctgagaatgccagagatccaccttttcaccggaagctatataccgatttgtcatcgagagtccatttacaggaagaaagaaaagaaggaaatgaattttgaaatgcacaaattgtacaaacgtctggttgatattttttcttggaagggctgagcacagtatattattagagatgcattgaggtggcttgccctgaccaatctgttgtattgagggagatcaaagattgaaatggaaagcagtggtatttctcatgtgatcttaaagttaataaggaaaagtacactccatatatatatgtcgtggcctagcgggtgatatttgcgcgtcatcttttcatttgcgattacaagaatatac

SEQ ID NO: 2072 - DNA, 2138 bp, Triticum aestivum
tcggacgaggcgcccgccaatcccgccgcggcccggagcgatccaccgccccgccgaccgaccccgcggtcggggtggccggagccggggccctgccctcgcgggtccggttcacgccgtttcttccccgggcgcggcgcccggcggaggcccccctccgatctgtatccatccgtctccccccgcgtagcgcccggcgccgcccgacgcgtcccgccgtcgccgacgccggctgcccccccgccccaccggatcgctgcgccggccgcccccgcctcccgcccgcggccgcgggccccccgtcgcgcgagataacggtgttccttcattgccatttgggaaaatatgggttggttgaccaaattttttagaggttcaacccacaacatctcggaagggcgagaacaaagcaagcctgcagaagagacaagatggaatgaaccctccacttccactgttgtgattgatcccctttcggaatttgataatgaggatattgaccgtgctatagcactttctctattagaagaggaacacagaaaaccaaaggaaacaggaaaggatctgcatttagatgaggatgaacaactggcaagagctattcaggaaagtttgaatgttgaatcaccccctcgtcctcatgaaaatgcctcaccccctcgtcctcgtgaaaatagtgcacaccctcgtgctcgggaaaatggcaatgccaacggcggcaattcgtatcaacagttaccatttatgttttcgtctggattcaggacatgtgctggatgtcacaatgagattggccatggacgttttcttagttgcatgggagctgtttggcatccagagtgcttttgctgccatgcttgtaatcagccaatatatgactatgagttctccatgtcaggaaaccatccataccataaaacttgttacaaggagcgctttcatccaaaatgtgatgtctgcaagcaatttattcctacaaatatgaacggccttatcgaatatagggcacatcctttttggttacaaaaatactgtccatcacatgaggtggatggtactccaagatgctgtagttgtgaaagaatggagccaagggaatcaagatatgtattgcttgatgatggtcgtaaactctgcctggagtgccttgactctgcagtgatggatacaaatgagtgccagcctctttatctcgaaatacaggagttttatgaaggtctcaatatgaaagtggaacaacaggttcctctgcttcttgtagaaagacaggctttaaatgaagcaatggaaggagagaaaactggacaccaccaccttcctgaaaccagaggtttgtgcttatcggaagagcagactgtcagcacgatattgaggagaccaagaatgacaggaaacaaaattatggaaatgataacagagccgtataggttgacacggcgatgtgaagtgactgcaattctcattctatatggtctcccaagattgttgacaggttcaattttagctcatgagatgatgcatgcatggttgcgacttaaaggataccgcacgctcactccagatatagaagagggcatatgccaagtcctcgcccacctgtggatcgagtcagagatcatggcaggatcaggcagcaatgccgcatcgacatcctcgtcctcttcgtcatccacatcctctaagaagggcgggaggtctcagttcgagcggaagctcggtgacttcttcaagcaccagatcgagtcggacacctccgttgcctacggggatggtttcagggctgggaaccgggttgttcagcagtatggcctgaagcgcaccctcgagcacatccggctgacagggacattgccattctgagagtgtcagagatgcacctttctgcggaagttatataccgatttgtcatcgagagtccatttacaggaaaaaaaagggaaatgaattttgaaatgcacaaattgtacaaacgttcggttgatattttttcttggaagggctgagcacagtatattattagagatgcattgaggtggcttgccctgaccaatctgttgaattgaggtggatcaaaaatggaaatggaaagcagtggtatttcttatgtgaccataaagttaataaggaaaagtacactc

SEQ ID NO: 2073 - DNA, 1828 bp, Brachypodium distachyon
aacctcgaggttctttttcgctttgccaagatggggtgggttgtatgcacggcgatttggacgttttcaacaaaacggagataatggtgtttattcattgccttctggaacaatatgggttggctgaccaaattttttagaggttcaacccacaacatctcagaagggcaagatcaaagcaaaccggcagaagagaccgtatggaatgaaccctccagttccactgctgtgaattatgccctttcggaatttgacaatgaggatattgaccgtgctatagcactttctctatcagaagaggaacagagaaaatcgaagggaacaggaaaggatcagcatttagatgaggatgagcaacttgcaagagctattcaggaaagtttgaatgttgaatcaccccctcgtgctcgtgaaaagagctcacaccctcgtgctcgtgaaaatggcagtgccaacggtggcaactcatatcagttaccacttatgttttcttctggattcaggacatgtgctggatgtcacagtgaaattggccatgggcgtttccttagttgcatgggagctgtttggcacccggaatgcttttgttgccatggttgtagtcaaccaatttatgactatgagttctccatgtcgggaaaccatccataccataaaacttgctacaaggagcgctttcacccaaaatgtgatgtctgccagcaatttattcctacaaatacgaatggcctgattgaatatagggcacaccctttctggttacaaaaatactgtccatcacatgaggtggatggcactccaagatgctgtagttgtgaaagaatggagccgagggaatcaagatatgtattactagatgatggtcgtaagctctgcttggagtgccttgactctgcagtgatggatacgacagagtgccagcctctttatcttgaaatacaggaattttatgaaggtctgaatatgaaagtggaacagcaagtccctctgcttctggtagaaagacaggctttaaatgaagccatggaaggagagaagactggccaccaccatcttccagaaacaagaggcttgtgcttatcggaagaacagactgtcagcacgatattgcggagaccaagaatggctggaaacaaaattatggaaatgagaacagaaccgtataggctgacacgtcgatgtgaagtgactgcaatcctcattctatatggtctcccaagattgttgacaggttcaattttagctcatgagatgatgcatgcgtggttgcggcttaaaggataccgtacacttagtccagatatagaagagggcatatgccaggttcttgctcacatgtggattgagtcagagatcaccgcaggatcaggcagtaatgctgcgtcaacgtcctcatcatctacgtcttcaaaaaagggtggaagatctcagtttgagcgaaagctcggtgattttttcaagcaccagattgagtcggatacctccgtggcctatggagacggtttcagagccgggaaccaggccgttcttcagtacggtctaaagcgcacccttgaacacatccggctcacagggaccttgccattttgaaaatgccagagagtgacctttcggcggaagttatataccgatttgtcattgagagtccatttacaggaaaaagaaaggaattttgaaacgcacaaattgtacaaacagtatattagatgaattgaaatggctagcctgaccaatctcttgtatggagaccaaagttgaaatggagacgctggtatttgttgcctggcactaaaagttaataaagaaaatacacgctttgttcagttta

SEQ ID NO: 2074 - DNA, 1784 bp, Brachypodium distachyon
ttcattgccatttggaacaatatgggttggctgaccaaaatttttagaggctcaacctacaaaatctcggaagggcaacgccaaagcagaccggcagaggaggcagtatggaatgaaccctccagttccactgttgtgactgatgttctttcagaatttgacaatgaggacattgaccgtgctatagcactttctctatcagaagaacaaaggaagtcaaagggaacaggaaaggatctgcatttagatgaggatgagcaacttgcaagagctattcatgaaagcttgaatgttgaatcacccccttgtgctcgggacaatggctcaccccctcatgctcgtgataatagctcaccccctcatgcccgtgaaaatagctcacaccctcgtgctcgtgaaaatggcattgccaacggtggcaattcaattcagcattcaccatttatgttttcttctggattcaggacatgtgctggatgtcatagtgagattggccatgggcgttttcttagttgtatgggagctgtttggcatcccgaatgcttttgttgccatgcttgtagtcaaccaatatatgattatgagttctctatgtcgggaaatcatccataccataaaacttgctacaaggagcgttttcacccaaaatgtgatgtctgcaagcaatttattcctacaaatatgaatggccttattgaatatagggcacatccattctggttacaaaaatactgtccatcacatgaggtggatggtactccaagatgttgtagttgtgaaagaatggagccaagggaatcaagatatgtattgctagatgatggtcgtaagctctgcctggagtgccttgactccgcagtgatggatacaaccgaatgccagcctctttatcttgaaatacaggaattttacgaaggtctaaatatgaaagtggaacagcaagtccctctgcttctggtagaaagacaggctttaaatgaagctatggaaggagagaagactggtcatcaccatcttccagaaacaagaggtttgtgcttatcggaagaacagactgtcagcacgatattgaggagaccaagaatgacgggaaacaaaattatggaaatgataacagagccgtataggttgacacggcgatgtgaagtgactgcaattctcattctatatggtctcccgagattgttgactggttcaattttagctcatgagatgatgcatgcgtggttgcgacttaaaggataccgcacgcttagtcccgaaatagaagagggcatatgtcaagttcttgctcacatgtggatcgagtcagagatcatggcagggtcaagcagtaatgccgcgtcgacgtcttcgtcctcttcatcatccatttcgtcaaaaaagggtgggagatcgcagttcgagcgaaagctcggcgattttttcaagcaccagatcgagtcggatacctcggtggcctatggaaatggtttcagatccgggaaccaggccgttcttcagtacggtctaaagcgcacccttgagcacatctggctgacagggacctggccattttgagatccacctttaggcggaagtcatatagggatttcattgagagtccatttacaggaagaaaaggaaaggaattttggagtgcacaaattgtacaaggggtctttttcagttaaattttttggaagggctaagtacagtatattagatgcattgagatggctagcctgacccaatctcttgtatatggacatcaaagatggaaatggaaacaatggtattaaagt

SEQ ID NO: 2075 - DNA, 1853 bp, Zea mays
aaaccggagcattccattgtaccccgcggtgacgcgtcccggccccggcggccggcgggtctgcctaccggtaccggccccgctcgctcgccgagtcaacggcttgactgcgcccgcccgccacgttcgtagtactatacaagtacatgcctttgccttccctttcctctcctctcctcctctcccacagtcccacccgtttcgcagtgcagaagccggcgaaacttccaagcccaaggaaggaaaaaaaaactgtcacctttaactcgatcccctcttccccgcccgagtcagagcggcggcgccggagccggagccgacagcttccggcaagcgggggctacttggtgcggcgggctatttccgcggttttgtgccacagcgggactgaactgcccgcccaggctgccctatcagggtcaccaagattgaacaagactgaactgccgcgcttcaggatactgaactgccatctcagttaaatgatatactgcacaacagtgggcagcgatagtttgagacacattagcaatgagttgtttttctcaccttttcaagagaaaaagggggccacaacaacaagacgatccatctgacaattatttcactggttctgagaatataacaagattcagctacagggaactggttagagccacatcaaattttgaccaaggcaataagattggtgagggcggctatggacctgtctacaagggaacactcaaggatgggacacttattgccgtgaaggttctgtctttacattctagacaaggggcaaaggagtttcttaatgagcttcttgcaatctctgatgtaacacatgagaatcttgtcaaactctatggctgctgtgtagaaggaaaccacaggatccttgtctacaattatcttgaaaataatagtcttgcacatacccttctagattcgcgacacagcaacatccagttcaactggagaactcgggtaaatatctgcatcggtgttgcccaaggattagctttcctccatggcagtgtcagccctcacattgttcaccgtgacatcaaggcgagcaatatacttcttgataaggatatgacgccaaaaatatctgattttggtctggcaaagcttctacctccggatgtatcacatgttagcacaagagtcgcagggaccctaggttacttggctcctgaatatgcaattcgaggacatgttacacggaaggcagatgtctacagctatggcgttctgcttatcgaaattgtgagcggaagatgcaacactgatacgaaattgccctatgatgaccagattctccttgagaagacatggagatactatggtcgcgggaatctggagaagatcatagacagctcccttggcgacgacctggacgttgacgaagcctgcaggtttctgaagatcgggctcctctgcacccaagacggcacgaaacgccggccgggcatgtctgcggtggtggccatgctgagaggcgaggcggacgtggacacggagacgatcagcaagcccgacgtgatcagggatttcggagacctgaagctgcggagcagggccacgtcgtccacgctgctgacctcgatcatggcgcggtcgtccccgctgtcgtctgaggagacgacgcgcacctccatcaccttcaccgagatatcggagcgcgactgactgacgatcgccgttaattcgccgacaagaagtgggctgtgagcctgtgaccgtgtagctggaggagcggaaagtgtacgtagcataggccggggagaattctttttgctggttttatgtgatctgtgtgcgtatttctatattacaatcgcggtaggaaacggcgcttcaaagac

SEQ ID NO: 2076 - DNA, 1854 bp, Zea mays
aaaccggagcattccattgtaccccgcggtgacgcgtcccggccccggcggccggcgggtctgcctaccggtaccggccccgctcgctcgccgagtcaacggcttgactgcgcccgcccgccacgttcgtagtactatacaagtacatgcctttgccttccctttcctctcctctcctcctctcccacagtcccacccgtttcgcagtgcagaagccggcgaaacttccaagcccaaggaaggaaaaaaaaaactgtcacctttaactcgatcccctcttccccgcccgagtcagagcggcggcgccggagccggagccgacagcttccggcaagcgggggctacttggtgcggcgggctatttccgcggttttgtgccacagcgggactgaactgcccgcccaggctgccctatcagggtcaccaagattgaacaagactgaactgccgcgcttcaggatactgaactgccatctcagttaaatgatatactgcacaacagtgggcagcgatagtttgagacacattagcaatgagttgtttttctcaccttttcaagagaaaaagggggccacaacaacaagacgatccatctgacaattatttcactggttctgagaatataacaagattcagctacagggaactggttagagccacatcaaattttgaccaaggcaataagattggtgagggcggctatggacctgtctacaagggaacactcaaggatgggacacttattgccgtgaaggttctgtctttacattctagacaaggggcaaaggagtttcttaatgagcttcttgcaatctctgatgtaacacatgagaatcttgtcaaactctatggctgctgtgtagaaggaaaccacaggatccttgtctacaattatcttgaaaataatagtcttgcacatacccttctagattcgcgacacagcaacatccagttcaactggagaactcgggtaaatatctgcatcggtgttgcccaaggattagctttcctccatggcagtgtcagccctcacattgttcaccgtgacatcaaggcgagcaatatacttcttgataaggatatgacgccaaaaatatctgattttggtctggcaaagcttctacctccggatgtatcacatgttagcacaagagtcgcagggaccctaggttacttggctcctgaatatgcaattcgaggacatgttacacggaaggcagatgtctacagctatggcgttctgcttatcgaaattgtgagcggaagatgcaacactgatacgaaattgccctatgatgaccagattctccttgagaagacatggagatactatggtcgcgggaatctggagaagatcatagacagctcccttggcgacgacctggacgttgacgaagcctgcaggtttctgaagatcgggctcctctgcacccaagacggcacgaaacgccggccgggcatgtctgcggtggtggccatgctgagaggcgaggcggacgtggacacggagacgatcagcaagcccgacgtgatcagggatttcggagacctgaagctgcggagcagggccacgtcgtccacgctgctgacctcgatcatggcgcggtcgtccccgctgtcgtctgaggagacgacgcgcacctccatcaccttcaccgagatatcggagcgcgactgactgacgatcgccgttaattcgccgacaagaagtgggctgtgagcctgtgaccgtgtagctggaggagcggaaagtgtacgtagcataggccggggagaattctttttgctggttttatgtgatctgtgtgcgtatttctatattacaatcgcggtaggaaacggcgcttcaaagac

SEQ ID NO: 2077 - DNA, 1698 bp, Panicum virgatum
gagagagacagagacttccaagccagagagagagagagaaggcggcgtctttaaccgatcgacgccctcccggctccctccccgccggggtttgcttgctgcggcgggcgggctattcggtttccggcggctcccggtccgcgcggcggcggggttgggactctccgcgggccgcgcctcggcggctgcgtccaccgcctccttcgccgttgcggttcgggatatgatggctgctgctgaatgttgatgaaattcacttatagatactgaactgccatctaatctaagttaaatgaaacacggcacaactgtgtgcactgagagtttgaaacatgtcagcaatgagttgtttttctcactttttcaagaggaaaacagggccccaacgtcaagacgatccggctagtgatgacttcactggttctgagaatataacaagatacagctatagggaactggttagagcaacatcaaattttgaccaagccaataagattggtgagggaggttatggtcctgtctacaagggaaccctcaaggatggaacagctattgctgtaaaggttttgtctttacattctagacaaggtgcaaaggagtttctcagtgagcttcttgcaatctctgatgttgcacatgagaatcttgtcaaactctatggctgctgtgtagaagggaaccacaggatccttatctacaattatcttgagaacaatagtctttcacatacccttctaggttcagggcatagcaacatccaattcaactggagaactcgagtgaatatctgcatcggtgttgcccagggattggttttcctccatgataatgcccgccctcacattgttcaccgcgacatcaaggcgagcaatatccttcttgataaggaccttacgccaaaaatatctgattttggtctggcaaagcttctaccttcggatgtatcacatgttagcacaagagctgcaggaactctaggttacttggctcctgaatatgcgattcgaggacaagtgacacggaggcagatgtctacagctatggtgttctgctcatggaaataattagtggaagatgcaatactgatactaaattgccttatgatgatcagattcttcttgagaagacatggagatactacgaccaggggaatctggagaagatcatagacagttctctaggcgacgacctggacgtcgaccaagcctgcaggttcctgaagattgggctcctctgcacccaggacgtcacgaagcggcgtccaggcatgtcaacagtggtggccatgctgaaaggcgaggtggaagtgaacactgagatgatcaacaagcccgacgtgatcagggacttcagggacctgaagctccggagcagggccacatcatcgaccatgctgacctccatcatggcgcgctcatccccgctatcgtctgaagagacgacgcgcacctccatcaccttcacagcaatatcggagcgcgactgatgatcggggatgcgattgactgtgtctgcaaccgtttagctagagcaaattgtatgtagcataggccagaatcctttttggtggttgtatgtttcgtgtgcatatagatgtgcgttttcccctgttatagagcatatgaacaaattgattatactttcagagccagaatcaacctgtgaagtaaagaaatggaagtctgctcatttcaaatt

SEQ ID NO: 2078 - DNA, 1230 bp, Pennisetum glaucum
acttgctgcggctcccggttcgcgagccagggttgcgcttcggcggctgcatccaacacctctctccctcgccgttgtggtccaggatatgatggctgcagctgaatgtcgatgaaatccacttatcggcttacagataccgaactgccatctaagttaaatgtaacacagcacaacagtgtgcactgggagtttgaaacacgtcagtaatgagttgtttttctcactttttcaagaggaaaagggggaccgaacaacaagatgatccatctagtgattacttcactggttctgaaaatataacgagatacagctatagggaactggctagagcaacatccaattttgaccaaaccaataagattggtgagggaggttatggtcctgtctacaagggaacgctcagggatggaacagctattgccgtaaaggttctgtgtttgcattctagacaaggtgcaaaggagtttcttaacgagcttcttgcaatctccgatgtagcacatgagaatcttgtcaaactctatggctgctgtgtagaagggaaccacaggatccttgtctacaactatcttgaaaacaacagccttgcacgtacccttctaggttcagggcatagcggcatccaattcaactggaggactcgagtaaatatttgtatcggtgttgcccagggattgacattcctccatgacagtgtccgccctcacattgttcaccgcgacatcaaggcgagcaatatacttcttgatacagatcttacgccaaaaatatctgattttggtctggcaaaacttctaccttcggatgtatctcatgttagcacaagagtcgcaggaactctaggttatttggctcctgagtatgcgattcgaggacaagtgacacggaaggcagacgtctacagctatggtgttctcctcatcgaaatagttagtgggagatgcaatactgatacgaaattgccctatgatgatcagattcttcttgagaagacatggagatactacgaccaggggaatctagaggagatcatagacagttctctgggcgatgacctggacgtcgaagaagcctgcaggttcctgaaggtcgggctcctctgcacccaggacgtcacgaagcggcggccgggcatgtcagctgtggtcgccatgctgaaaggagaggcggacgtgcacaccgagatgatcagcaagcccgacgtgatcagggacttcaaggaactga

SEQ ID NO: 2079 - DNA, 1724 bp, Pennisetum glaucum
ttcggcaccgcctcctccgcttaccagtacgagggagctgtgaaggaagatgggagagggaagaccacctgggacacgtttgcgcacacttttggcaaggtcgccgacttcagtaatgctgacgttgcggtcgatcactaccaccgtttcgaggaggatatacagctcatggcagacatggggatggacgcgtatcggttttcgattgcgtggtcgaggattctgccaaatggcattggccaagtcaatcaggccgggatcgaccactacaacaaactgattgacgcactgctagcaaaaggaattcagccttatgtaaccctctaccactgggacctcccccaggtcctggaagataggtacaacgggtggcttgacaggcagataatccacgattttgctgcctacgccgagatatgtttcaaggctttcggagaccgtgtgaagcactggatcactatcaacgagccacacacggttgccgtccaaggctatgacgacgggcttcaagcgcctgggcgctgttctttgctgctccatctgtactgcaaggcagggaattcaggcaccgaaccctacattgtcgcccacaactttatcttagcccatgcgacggcttcagacatttacagaaggaattacaaggctactcagaatggggaacttgggatagcatttgacgtcatgtggttcgaaccgatgacgaataccacaattgatattgaggctgccaaaagagggcaagagtttcagctaggatggtttgcggatccattcttcttcggtgattacccggcgtcgatgagatcacgggttggggacaggctccccaagttcacaccagaagaggctgcccttgtgaagggagcgctggactttgtgggcataaaccactacaccacttactacaccaggcataatagcaccaatatcattgggcgcctgctgcataacactttggcagacaccggaaccatcagcctcccattcaggaacgggaaggcgattggtgacagggccaattcgatatggctgtacattgtgcccagcgggatgaggagcctgatgaactacgtcaaggaaaggtacaacagcccaccaatctacataactgaaaacgggatggatgatggcaacagccctttcacctccatcaaggatgcactcaaggacagcaagaggatcaagtaccacaacgactacctcacaaacctcgccgcctccataaaggaggacgggtgcgacgtgcgtgggtacttcgcgtggtcgctgctggacaactgggagtggacggccgggtactcctcaagattcgggctctacttcgtggactacaaggacaacctcaagagataccccaagagctcggtgcagtggttcaagacccttctcagctccagctgagggattagatgcctggatgtacattgttttgtctcccataggccatagtcccattgccatttcttgttcaggccaggccatcaagtcatgtatacaataacgccatggtgtgcccaagtccatgtgttagaagttaaaaccatccatggttaagccttttaaattcagtgatgaaatacacagaatcactcaatgatgatcatgatctgatgaacaatggacgtattgcccgccaacagtaaagtaaatgatttacatgaccagtaccatttggaaaaatccttgaccatgcgatcgaaaaccgatctgcatccatcccc

SEQ ID NO: 2080 - DNA, 956 bp, Hordeum vulgare
aaaaagcatttcgtactaggactctaggagagggaggccatgaagaagaccgtcgtcctgtaccctggcgtcggcgtcggccacctggtgcccatggtcgaggtcgccaagctgtttatcaagcacggccagtccgtcatcgttgccgtcgtcgatccgcaggtcgagtccaccgacttctcagacgcggtcgtccgcgcgagggcctccaacccctccgtcgccttccacgtcctgccgccgccgcccgccgactccaactccgacagcgcgcccacgcaccccgtcgtgcagattttccggctcctgaaagccatgaacgccccgctcctcgacttcctccgctcgctgccctccgtcgacgcgctcgtcctcgacatgttctgcgtcgacgcccaggatgtcgcgtccgagctcgggctgccggtctactacttctacgcgtcggccgccgctgacctcgcgctcttcctcaacctgccgagcaagctcgccggcgttaaggcaaagataaaggagctcggcgactctgtcatcaaattcccgggcgttcctccgttcaaagctaccgacttgcccgaggtcatgcacaacgatgaagtgctcaaggccatcctaggcatgttcgaccgaatgccagattccgacggaattctcattaactccgtcgagtcgctggagacgcgggcggtgcgcgctctcaaggacgggctctgcgtcccgggtcgtgccacgccaccggtctactgcatcgggcctttggtctcgggaggcggaggcaaggagcacgagtgcctccgctggctggacgcgcagccggaccagagcgtcgtgttcctctccttcggcagcatgggcacgttcccggttaagcagctccaggagattgcaaccggactggaaaagtcagggcagagattcctgtggggtcgtgcggagcccgcgcaatcccgact

SEQ ID NO: 2081 - DNA, 897 bp, Triticum aestivum
cccacacgtccggggcttcgctgggcaactggagcacaaggacactgccatggacagatttgagtacaaagaggtgagctccacacatccaaatcaaccataaaggcattgcgggctatgactttacaagagtgaacccatgaagaataccgttgtcctgtaccctggcatcggtgtcggccacctggtgccaatggtggaggtcgccaagctgttcctcaagcacggactggccgtcaccgtggtgctcattgatccgtctggcgagtccacggacttctcctccgccttagcccgtgcgaggtcctccaagccctccgtcgccttccacgtgctgccgccgtcgcccgcggattccatctccgacaccgtgcccacgaaccccgtcatccagattttccggctcctgaaatccatgaacgcccccctcctggacttcctccgctcgatggcctcaattgacgcactcgtcctcgacatgttctgcgtcgacgcccaagatgtcgcggctgacctcaagctgccggtttactacttctacgcgtcggccgtcgtcgacctcgcgctcttcctcaacctgacgagcaagcttgccggcagtaaggtgaaggagctcggcgagtctatcatgactttcccgggttgtcctccgttgagagatccgtacttagccgaggttacccaacacgatgaaatactcagggccatattgggcatgttcgaccgaatgccagatgccaaggaaatctcatcagttcctgcgagtcgtggagaaccggggggtgctcgctctcagggacgggtttccatccctggttgtgccatgcaccgacttattctttgggcctttgtgtgtgggaggcggtgaccgggaacacgaatgccccgggttgctgg

SEQ ID NO: 2082 - DNA, 1521 bp, Glycine max
aacgtaacgcagaggcgaagcagcaacaacagaagaatgctccgttcaactccatttccggcaccgtacaattcggcgccagttctctctcgcgcacgcacgtgcccctctccagcactcgcacgtgcccttcattctcattcctctttgtgtttgtcgcggccgccgcgaagaagcaacaacggcgcggcggcgctgagctcgccgtaatggacggcggtttcgacgacggtgatttttatgatgcttacgatgatgatgaagaagaagaagaatttgatgatgatgatgatgaagaagaagggatgcttccgttggatgacatgaacaaatggttcgagaagaagccgaggggttttggagaagggaaagtgtacgacacttcggttgaggataagctgctcgaggaaatgcgccagagtagaatagcgcaggctgaaaacttgacgaagcttaagagcaatcctgtgaagcatgcttcaaacgaaagtgttcaaaagaagaaagattcagaacttgttccaattggaggtcgagtgtgcttggtgaacctaccaaagaaaaagaacatccataaagatctgaaatcagccttgcaagggattcctggcataactaatatagtcccagctgttactggaaacaagaagacgagggacccaatctgcaagggttttgcatacgttgatttcgagtgtgaagaagatgcaattaggtttgttgagttatacactggacaagctattacttttggtaaaattcagaagcagataaaatgtgagcttctaaatgtacagtcttcatcttcttctctgaaattaagcaaaaaccttaatgctgctccgcaacttgtggcccgctttgaagaagtttcaaatgaggattctaacttggatggttctgcccttagttcctgggatgaggccaactcttcagatgatttggatgacctggactatcagatgaatggagaagaacaggaagatgatgaggacaatcaagagtctgtctccactttgggggtggatcatgatgatagtgtggaaatgaggatcgatcctgaaatttgttctcttccctcagagcaggttgacagaaaccatgcagctgagcagaagtcatctgccaaggttaaacaggagaatgcccgtaagaaaaaaccaacttccaaagatagagacaaaaaagttttaggtgttcctggatcctcaagaaggttaaagatcagggaaaaggctgttttaagtgacgttttctccaagtacggattaaaagctactcttgcttcaaaagataattagtaaattgctaatgaggtgagatcgccaaagtctaaatcatctcccagcacgtagggtctaaaaactaaaaggtcatattagatgcaatgggactttctagttggccatggatgctagtttttgattcagtgtacaatcaaattgtagcataagagtcttgtagaaaaattgatgatagtagattattatttttatgaatatcaaaacattctttattagc

SEQ ID NO: 2083 - DNA, 2600 bp, Panicum virgatum
gtttttgagcgagttacaaaaaattcagtccgtggaatatggtcacgcagatcaaaactcaaccttgttggtgcccatataaatgtctttactggtgaatggacacagaaggatgctggaattggcacaagcattgattctttctatgaatatcttctaaaggcatatttattgtttggagatgaagagtacctgtatatatttcaggaggcttacaaggctgccatgcaccatctccatcatgatccttggtatgtggaggtcaatatgaattctggtgctactgtttggccattattcaatagcctgcaggcattctggccaggacttcagccggagatgttgatcctgctattcgaacacatgatgccttcttcagcgtttggaaaaagtatggtttcacccctgaaggttttaatcttgctacatcaactgtccagaatggacaacgcagctacccgctacggccagagttgattgaaagcacatattggttattcaaggctaccagagattatagatatattgatgttggaagggacatattattaagccttcaatatggtgctagatgcccttgtggctactgccatatatcagatgtggaaacccacaagcaggatgaccacatggagagtttcttccttgcggaaacggtcaaatatctctggcttctttttgatttagctgctggacctgataacattgttgaaaatggaccatataagtatatatttagtacagaaggtcatttgctacctgttactcctgagatagccttggtagatgagcattgttcgtattttggagcattctgtaatggcagtgcagactggggatatggtacaagtgctagttctactaagtatcaaaaagcaaactatactcagttagatgatatccaaaccccttccagtcaccatccagcgtccaacatgtttgcaacaagaggttacatcaagggagtttgtccaggattgactcatgcacagaaacttgggatatcgtattctgatgaagagggtaacgttatagagcaggcttctgaaagtcatgagcatcatggtgaatctgcagtagaatctagcgtccaagtccaatcaagtaatattatactgatctctcacccagttgcaagtcaacaggatcaggctttggggaggtggtctggaactggagatcatgcagatattgtggtaactgctgattctgattctgtaagccatgataatactgacggctcacttggagtgaacactgaagaacttaccaaggacaccgaacgctcctccaaacagtctgaagatgaagatattgctcagaatttgatgtcgaatgaagatatcagctgaccttaagttcaatagggaacgatttttgtcacttatctgcggaaccttcagggtcaaagctcgcctgacgcacaagttagtaagcaagcatatttagtcagtatctggccccttaactagttgagatgagctggtgaggtcatgaggccattgttgcttcggggacagtgacctgcaacctccggaattgatatttactttcagatatgttttttttttctatagtatgataacatagggtgagcattcaccaatttgttccttctgtgtattggttgcaaggttcttttgatcaatagcaaatgtaaatttttttgtataacagaagtatatgaacagaaagtgcatacatgatgggctttattgaataactgattattacggcaattccaaccgagacactaccagctactttcatacactcgctatgtcatttaaacactacaaatagaaagtgaatggcgcttaaaaatatatttccattcaataacccgtcttctctccccttttctgtcacagccccattctacttttccttggttttagattagaaaccgaggagctgaagctgacatgctgttggtatgtgtggagaacatggacttgtaaacttggtgtcggccacggcggtgtactggcctgtggcctgtgggaatggaggccccaccgtgttggaagtgggttgtcattgtgacgacgaggcagatgaatgtttggcccaggttgatcaggagcttgcaaagagattcttcgcctttaaacagcaagagctctactgaaagctcaaactttcgcagaacattatagtgatttttttcctcgcgaagttgcactacacgcgtaatctccacggatcaacatatcatcacttcatgatccaacgcaaaagcgaagcttagatacaaattaaatagccaagtctgacattacaccgatgaccaccgccatgtttacatccggagcagtcgtagtaacaggagcagaggatggacacgatatgatctagagcgagaggccgccggactcctcgtcctcgtcgaggtcggaggtgtagacggtgtagagcgaccagatgaggccgaagacccccaggaggatccaccccagcaggttgttgctgagccccaggctcagcccggtgccctccgtcgacatcctctcgtccacgagcgccagcgccggccccgccgacgcggtcaccgcgcccgccgcggccagcagcgacgcgccggcgcccctagcgctcac

SEQ ID NO: 2084 - DNA, 2093 bp, Citrus sinensis
  misc_feature (777)..(778): n is a, c, g, or t
  misc_feature (995)..(995): n is a, c, g, or t
  misc_feature (1093)..(1094): n is a, c, g, or t
  misc_feature (1100)..(1101): n is a, c, g, or t
  misc_feature (1775)..(1775): n is a, c, g, or t
  misc_feature (1873)..(1873): n is a, c, g, or t
  misc_feature (1878)..(1878): n is a, c, g, or t
  misc_feature (1880)..(1880): n is a, c, g, or t
cttcatcagtgtcaagctcagatcctggaacttcaccattttttatctcaggaattaatggagatttgaagaaggaatcatcagtcattagggaagaccggaatcttgaagactctagttcggacacagacagtgaaaatttgtctgtgtcatcggccagtatgaggttccaaccatggatgacagagtttcttagatctcatcatcagtcatcacaccagatggaagaagaatgctctagaagaactaataataagactcaagcatcgacaactaaagctttgcttgagaagttctctaggctcgatcgagatgctggagttggaatgtcaagctatcggactgacttggaattcagtggaaacgttagagaagcaatatcactatccagaaatgcgcctcctggccctcctccattgtgctcaatatgtcaacataaggcgccggtatttggcaagccaccaaggtggtttagctatgctgaattggagcttgctaccggcggcttttcacaagccaatttcttggcagaaggtgggtttggatctgttcataggggggtactgccagatggtcaggcagttgctgtcaagcaacacaaattggctagttctcaaggggatcatgaattttgctcagaagtggaagttctgagttgtgcccagcacagaaacgttgttatgttaattggattctgtattgaggacaggaggaggttactggtttatgaatatatatgtaatgggtctctggattctcatctatatggatgtcatnnagagccattagaatggtctgcacggcaaaagatcgctgtgggagctgctcgaggtctgcgatatcttcatgaagaatgcagagtgggctgcattgtgcatcgtgacatgcgaccaaataacatccttctcacccatgattttgaaccactggttggagattttggccttgcaaggtggcagcctgatggtgacatgggtgtggaaacaagagtaatnggaacatttgggtatttggcgccggaatatgctcaaagtggccagattactgaaaaagctgatgtctattcatttggtgtggtattagttgagcttgnnacgcgnncgaaaagcagtggacctcaaccgaccaaagggccaacagtgtcttactgaatgggcacgtccgcttcttgaagaatatgctatagatgaactggttgacccaaggctagggaatcactattctgaacatgaagtatattgcatgcttcatgctgcatctttgtgtataaggcgcgatcctcattccaggccccgcatgtcacaggtgcttcgcatattggaaggtgacacggtcatagacacttacatgtcaacacctgggtatgatgttggcagccggagtggacggatctgggtagagcagcagcagcatcagcaacagcaactaccttatagcggtcccttgatgaatgaggctttggaaggattcggtaggaagctcccccttgattcactaaaggcagccttttgggaaagggataaggccagaaggacctcccgcgaaaatgatctgtaaagagcttacctttcatatcaactagtattctgctaaatacgtattttggtccttttgtaatcccctttttcccttttacccagttctaggttctttctatttttttcccaatgtccatctatattttgctcatgtatagtggtagggaaagtaggcaaagttaagcttttgtaattctttcgaaaaaatggaggaagctgagagtatcatgttcttanttctatctcatctgtgtgccttttggcttaaatcaattaagccttacatggattaagcccttccaaaaaaaaaaaaaaaaaaaaaaaaaaaaaggggngggcncnaaaaggaatccaaacctttccgtccgccggggaatggcaagatcttaaacctcttccgataaggggacaccaaattttcaatttccgggggcgagcgtttttttaaacttcccttgaaggggaaaaaaaacccggggtgttttccccaaattaaataccgctctttcacaccatattcccccctttggccacaacttgggattataaaaaaaa

SEQ ID NO: 2085 - DNA, 2561 bp, Aquilegia formosa
gagagaaagtgaagaactagaagaagatatctatctatctatctatctttctcttctttctttctctgtagatgggtagtaggaagagttggatctggtgaagaagggttttgagtaattagtgagattttagtgtgatgactagtttacagcaaaagagagggaaatcagagaaaggtgggaatgttgcagagaaagtggtggttgctgttaaagcatccatgaaagaaattcctaaaactgcattagtttgggctttgactcatgttgttcaacctggggattgtattactcttcttgttgtggttcctgccattagttcaggtaaaaaactatggggtttcccaagatttgctggagactgtgccagtggccacaagaggtctctaataggaaccagttcggagcagaagtttgatcttacagattcatgttctcaaatgatgcttcagcttcatgatgtttatgatccaaacaagataaatataaagataaaaatcgtttcgggatcaccatgtggagcagtggcggtagaatctaaacgtgctcaacctagctgggttgtattggacagacagcttaagcacgaggaaaaacgatgtatggaagagttgcaatgtaacattgtagttatgaaacgttcccaggcgaaagtacttcgtttgaacttagttggatcacctaagtcagatgctgaagagacctgcccattaccttccgagttagaagaagcatcagaaaactatttgaaggataataatgttccaataaattcaatccgtggtccacttgttactccgaatagtagtcctgagcttgggactccatttactgtaacggaagctggaacatcatcagtatcaagttcggacccaggaacttcaccatttttcacttctgaagtaagtagtggcctgaaaaaagtgtcattagccacaaaagaaagccaaattttggatgatagttgttctgacatagatagtgaaaatatgagtccaccttccacaagtttaagttttcagccatggatggcagaaattatcagtaaaagccgctcctcattaaaacatgctgatgaaagctcacagaggcgcagggataatattcgttcttccaccgccaatgccttggcagataaattttcgaaacttgaccatgaagtcggatttagaaggcttaactacaggcaggatcttgagttcagtggaaatgtcagagaagcagtatcattgtccagaactgcacctccaggacccccgccattgtgttcaatctgtcagcacaaggcacctgtatttgggaagcctccaaggtggtttagttatgctgagcttgaacttgctacaggtggattttcacaagcaaatttcttggccgaaggtgggtttggctctgtccacaggggagtcttaccagatggccaggcagttgctgtcaagcagcataaactggctagttctcagggtgatcttgaattctgctcagaagttgaggttcttagctgtgcacagcacagaaatgttgtgatgctgataggattctgcgttgaggacaaaagaaggttgttggtctatgaatatatatgcaacgggtcgttggattctcatctttatgggcgtaaccgacaaccattagaatgggctgcacggcaaaaagttgcagttggagctgcgcgaggattgagataccttcacgaagaatgtagagtaggctgcattgtccaccgcgatatgcgccccaacaatatcctcatcacccatgattttgaaccactggttggagactttggactggcaaggtggcagccagatggagacatgggtgtggatacaagagtcattggaacattcgggtatttggcgccagaatatgctcaaagtggccagatcactgaaaaagctgatgtgtattcatttggtgtggtattggtagagcttgttacaggacgaaaagctgttgacattaccaggcctaagggtcagcagtgtcttactgaatgggcgcgcccactactagaagaatatgccattgatgaactgatagacccatccttagaaaacagttatgcagaaaatgaagtttattgtatgcttcatgctgcatccttgtgcattcggcgagatccccattcaaggcctcgcatgtctcaggtcttgaggatattggaaggtgacatgatcttcgactccaattacgtatcaacacctgggcatgattctggtagcagaagtggaagatcatgggcggaacagcatcaccaacacttcagtggtcccatcatgaatgaggcatcagaggggctaagtggtaaactttctcatgaagcaataaaagcagcttactgggaaagagagcaggcaagacgaaccccaagcaatggtcatttgtaacctcggttttcatatatatatacttcatgtttgtttcttttccacgtctcatcctgatttttttgtttatgtacagaatttataagttgtaagcgtttttgcttgttaggacttacgagggtgaagggaatgtagctgatagccatagaagtactttggcctttatattgg

SEQ ID NO: 2086 - DNA, 3463 bp, Aquilegia formosa
aagaaagaagaaaagacagattttattaataaatttcagatttcaaatttcaaataattttttacaatttataggatttcaagaagaagaagatagaataaaaataaaatatatcaaatctttcaatttcatttgatttgatgtttttggtaacaaaatgccgaattcatcactattgaagaacaagaagaagatcatcaaatcatagtagtgtagtgtagtatatacaatatgtatgtatgtcgttttctacatttcttactaaattgaattgagagattttataaagatttttagctttttgggaatgttttgctaaaagtaagagaaaaagaaagttttagttttaaaagggttcaatcaatcaattgaactttattgtttattagggtttcataaagtgaaatctctgaaataataaataacaagtagtattgttttctttttttctttttgtgtgtaaaactaactgtgtttgccttttcgtgtacatttgtttctgatcaggggttaaaaagagtcatatcatgtcaatctcttgtttctatttctagctaaataaagtagctggcaagtctagggttttgtttttctgtcttccttaataaataaataaaaccagagagagaaagtgaagaactagaagaagatatctatctatctatctatctttctcttctttctttctctgtagatgggtagtaggaagagttggatctggtgaagaagggttttgagtaattagtgagattttagtgtgatgactagtttacagcaaaagagagggaaatcagagaaaggtgggaatgttgcagagaaagtggtggttgctgttaaagcatccatgaaagaaattcctaaaactgcattagtttgggctttgactcatgttgttcaacctggggattgtattactcttcttgttgtggttcctgccattagttcaggtaaaaaactatggggtttcccaagatttgctggagactgtgccagtggccacaagaggtctctaataggaaccagttcggagcagaagtttgatcttacagattcatgttctcaaatgatgcttcagcttcatgatgtttatgatccaaacaagataaatataaagataaaaatcgtttcgggatcaccatgtggagcagtggcggtagaatctaaacgtgctcaacctagctgggttgtattggacagacagcttaagcacgaggaaaaacgatgtatggaagagttgcaatgtaacattgtagttatgaaacgttcccaggcgaaagtacttcgtttgaacttagttggatcacctaagtcagatgctgaagagacctgcccattaccttccgagttagaagaagcatcagaaaactatttgaaggataataatgatccaataaattcaatccgtggtccacttgttactccgaatagtagtcctgagcttgggactccatttactgtaacggaagctggaacatcatcagtatcaagttcggacccaggaacttcaccatttttcacttctgaagtaagtagtggcctgaaaaaagtgtcattagccacaaaagaaagccaaattttggatgatagttgttctgacacagatagtgaaaatatgagtccaccttccacaagtttaagttttcagccatggatggcagaaattatcagtaaaagccgctcctcattaaaacatgctgatgaaagctcacagaggcgcagggataatattcgttcttccaccgccaatgccttggcagataaattttcgaaacttgaccatgaagtcggatttagaaggcttaactacaggcaggatcttgagttcagtggaaatgtcagagaagcagtatcattgtccagaactgcacctccaggacccccgccattgtgttcaatctgtcagcacaaggcacctgtatttgggaagcctccaaggtggtttagttatgctgagcttgaacttgctacaggtggattttcacaagcaaatttcttggccgaaggtgggtttggctctgtccacaggggagtcttaccagatggccaggcagttgctgtcaagcagcataaactggctagttctcagggtgatcttgaattctgctcagaagttgaggttcttagctgtgcacagcacagaaatgttgtgatgctgataggattctgcgttgaggacaaaagaaggttgttggtctatgaatatatatgcaacgggtcgttggattctcatctttatgggcgtaaccgacaaccattagaatgggctgcacggcaaaaagttgcagttggagctgcgcgaggattgagataccttcacgaagaatgtagagtaggctgcattgtccaccgtgatatgcgccccaacaatatcctcatcacccatgattttgaaccactggttggagactttggactggcaaggtggcagccagatggagacatgggtgtggatacaagagtcattggaacattcgggtatttggcgccagaatatgctcaaagtggccagatcactgaaaaagctgatgtgtattcatttggtgtggtattggtagagcttgttacaggacgaaaagctgttgacattaccaggcccaagggtcagcagtgtcttactgaatgggcgcgcccactactagaagaatatgccattgatgaactgatagacccatccttagaaaacagttatgcagaaaatgaagtttattgtatgcttcatgctgcatccttgtgcattcggcgagatccccattcaaggcctcgcatgtctcaggtcttgaggatattggaaggtgacatgatcttcgactccaattacgtatcaacacctgggcatgattctggtagcagaagtggaagatcatgggcggaacagcatcaccaacacttcagtggtcccatcatgaatgaggcatcagaggggctaagtggtaaactttctcatgaagcaataaaagcagcttactgggaaagagagcaggcaagacgaaccccaagcaatggtcatttgtaacctcggttttcatatatatatacttcatgtttgtttcttttccacgtctcatcctgatttttttgtttatgtacagaatttataagttgtaagcgtttttgcttgttaggatttacgagggtgaagggaatgtagctgatagccatagaagtactttggcctttatattggtgtataatgtaattctcccataaccccatcacaatcctgttgcttcaaataaacttgtaaaggttataggtttctgttggcaagtttatatttcataagtcctgtaagtggttgattccctaaactgaggcattattgtccagtcagtatcttcaaatcgtacctttgtttgggtggctgtttgacattgttagtctgtaccttcagggaagtctcttaaaatctacaagtaccttctgtaagaactttacctattttttttctaatgcgagtatgcga

SEQ ID NO: 2087 - DNA, 2673 bp, Populus trichocarpa
gccagagcgaagggagaaaaaaatctcacagagacgcacgcatttaatattcggaacaggattatcccattttttttgttctcatcttcgaaaaatttgagcgctggaagtctacgtgagcctgtttgatttcaaaagtgatgagtagagaacagaagaaggggaagcaagagaaaggcggctcggatgttgctgtgaaggtggttgtcgcagttaaagcctccaaggagattcctaagactgctttggtctgggctttgactcatgttgtgcaacctggagactgcattactcttcttgtggttgtcccttcacacgctccaggtcgaagattatggggattcccaagatttgctgctgactgcgccaatggtcaccggaagtctcattcgggagcaacctcagatcagaggtgtgacattacagattcctgttcccagatgatccttcagcttcatgatgtttatgatccaaacaaaatcaatgtgaagataaaaattgtttctggatcaccttgtggggcagtctctgcagaagccaagaaggcgcaagccaactgggttgtactagacaaacagctgaagcacgaggaaaaacgctgcatggaagagctgcaatgcaacatagtggttatgaaacgatcccaggcaaaagtcctccgcttgaatctggttggaacatcaaaggaacctgaagttgtgggcccatcaccttccaaactaaatgaagcttctgagcagcattcaaaaaataagaataattcttcaggctccattcgaggaccggtggttactccaacaagtagtccagagcttggaacaccctttactgtgactgaagcaggaacttcatcagtctcaagtgatccgggagcttcaccattttttatctcagaaacaaatggagaactcaagaaagaggaaccactggtcattaaggaaaatagggatcttgatgaatctagttcagacacagacactgaacatttatctttggcttcaagtttaaggtttgaaccatgggtaggagagttacttggttctcatattaaatcctcaagacacgtagaagaaagctctcagagaagtaattgcatggcgcaaacatcaacaacagaagctttgctagagaagttctcaaaacttgatagacaaacaggaattggaatgtcaaactacaggactgatctagacttgagtgtaaacgtgagagaggcaatatcattatccagaaatacgcctcctggcccgcctcctttgtgttcgatatgtcagcataaggcacctgtatttgggaagcccccaaggtggtttagctatgctgagttggagcttgctactggaggattttcgcaagccaatttcttggcagagggtgggtttggatctgttcacagaggtgtattgccagatggccaggcagttgctgtcaagcagcacaaattggctagctcacagggggatgtagaattttgctcagaggtggaagtccttagctgtgctcagcatcgaaatgttgttatgctcatcgggttttgtattgaggacagaaggaggttgttagtttatgaatatatatgcaacgggtcactagattctcatctgtatgggcatcatagggagccattagaatggtccgcgcgccagaagattgcagtaggagctgctcgagggttacgttatcttcatgaagaatgcagagtaggttgcatagtccatcgtgatatgcggccaaacaacattctcataacccatgattttgaacccctggttggagattttggcctagcaaggtggcagcctgatggcgatactggtgttgaaacaagagtgatcggaacatttgggtatttggctccagaatatgctgaaaccggtcaaatcacagaaaaagctgatgtttattcctttggagtagttttggtcgagcttgttacaggacgaaaggcagtggacctcaaccggccaaagggccagcagtgtctcacggaatgggcgcgccctctattggaagaatatgccatagtggaactgattgacccacagcttggcaatcactattcagaacaggaggtctactgcatgctccatgcagcatcgatatgcatacgacgggatcctcattccaggcctcgtatgtctcaggttctccgcatactagaaggtgacatgcatgttgacacgaattacatgtcagcacccgggtatgatgtggggaaccggagtggaaggatttacatagatagaacagcagcagcagcagccgccatcaaaacattatggtgttctgctgtcaacgaatgaggcattggaaggattcagtgggaagctctctttcgacaccctagagccaactttccgggaaagggataccgccaggaggatttcatgccaagatgatttgtaaagtgctaacccttaatgaaccacatatggtatgctaaatatgtcgctggcccatttgcattttgtatttgttttgttttccttttttttgccttgtgtatgttcaaatgccatcttgattttgctttgtatagtagaagggaagtaggggtcgcaatgttctgtgtaattctttggtaaatgataggaactgatatcaaatagcaacgatgcagagtattagtgaatacgtaatgcttcgaatcaatgaagcagcagcttctgggaa

SEQ ID NO: 2088 - DNA, 2440 bp, Manihot esculenta
tggtggcaatgagtagagagcaaaagagaggaaagcaagagaaaggcggctctgatgttgccgagaaggttgtagtcgcagttaaggcatccaaagaaattcctaagactgccttggtgtgggctttgactcatgtcgtgcaagctggggattgcatcactctgtttgtggttgtcccttcacagagttcaggtcgaaagttatggggtttcccaagatttgctggggactgtgccagtgggcagcggaagtctcattctggagcatcctcagagcagaactgcgacatcacagattcctgctcccagatgttccttcagctccatgatgtttatgatccaaacaagatcaatatgaagataaaaattttttctggatcaccttgtggggcagtggctgcagaggccaagagggcacaagccaattgggttgtactagacaaacagctaaagcatgaggaaaaatgctgcatggaagaattacaatgcaatattgttgttatgaagcgttcccagccaaagattcttcgcttgaatttggttggatcgtctaaggaagctgaaaccactggtcaattgccttgtgaactagatgaagcttctgataaatgcacaaaacataaaaatgattctttagtttccattcgaggaccagttgtcactccaacaagcagtccagagctagggacatcatttactgctactgaagctggaacttcatctgtttcaagtgatcctggcacttcgccattttttacctcggaaatgaatggagacctgaagaaagagggatcattaatcattaaggaaaatatggatgttgatgaatctagttcagacacagacagggaacatttatcatcagcttcagcaagtttgaggtttgaaccatggatgggagaattcattagttcctacattcaatcctcacggcatatggaggaaggttcacgccgaaataccaatatggctcaagaatcaacaactaaagctttgctagacaagttctcaagacctgatagaaaaactggaactggaatgcgcaactacaggacagatgtagacttgagtggaaatgtgagagaagcaatatcattatccagaaatgcacctcctggaccccctcctttgtgctcaatatgccaacataaggcacctgtttttggaaaacctccaaggtggttcagctatgctgagttggagcttgcaactggtggattttcacaagctaatttcttggcagagggtgggtttggatctgttcacaggggcgtattgccagatggccaagtagttgctgtcaagcaacacaaattggctagttcacaaggggatcttgaattttgctcggaagttgaagtcctgagctgcgctcagcatcgaaatgttgttatgctgattggattttgtattgaggaaaaaaggaggttgttggtatatgaatacatatgcaatggatcacttgattctcatctatatgggcgtcatcgggagcccctgcagtggtctgctcgccagaagattgctgtgggagctgctcgagggttacgctatcttcatgaagaatgcagagtcggttgcattatccaccgtgacatgaggccaaataacatccttattacccatgattttgaaccgctggttggggattttggccttgcaaggtggcagcctgatggagatatgggtgtagaaacgagagtcattggaacatttgggtatttggctccagaatatgcccagagtggccaaataactgaaaaggctgatgtttattcatttgggattgtattggttgagcttgttactggaaggaaagcagtagatcttaaccggcccaagggccagcagtgtctcgctgaatgggcacgccctctgttggaggagtatgccatagatgaactgattgacccacagctggggaaccgctattcagaacaggaggtttactgcatgcttcatgcagcatcattatgtatacagcgggatcctcactctaggcctcgtatgcgacaggttcttcgcatactagaaggtgacatgctaatggatgcaagttacacatcgactcctggatatgatgtgggaaaccagagtggacagatttgggcagaacagcagcagcagcaacattatagtggtcctcctttcaaaggaagggttcagtaagccttctttggatacgctgaggctacagttctgggagagggataaggccaggaggatttcatgtgaagatgatctgtgaaaggttaatccacagtggaaaagacacggtaagctaaatatatccctgcccttttttttgtgtacttggatttttgccttcaattttttggttcaatgacatccaagattttgctttgtatagtaggagggtagtaacgttttgtaatttttttgttaaatgatagaaaccgatgttatgcacgattttcttt

SEQ ID NO: 2089 - DNA, 1747 bp, Gossypium hirsutum
agctcgggacaccatttactgctactgaagcaggaacttcttcagtgtcaagctctgatctgggcacttctccttttttcaactcagcagggaatggagacctgaagaaggatgaatcattggttattaaagaaattcaggatcttgatgaatctggttcagatcccgagagtgaaaatttatccttatcttcaacaagtttaaggttccaaccatggataacagagtatcttacttctcagcatcaatcctcacgacacctggaagaaacttcagttagagctcatgacagggttcaagcttcaacaacaaaagccttgctggagaaattttcgaaacttgatagagaagcaggcattggaatatcaagctttaggagtgattctgaatttagtggaaatgtgagggaagcagtttcattatcaagaaatgcccctcctggccctcctccattgtgttcaatatgtcagcataaggcacctatatttggaaaaccaccaaggtggtttacctatgctgagttggagcttgcaactggtggattttcacaagctaatttcttggctgagggtgggtttggatctgttcatagaggggtactcccagatggacaggcgattgcagtcaagcaacacaaattggctagttgtcaaggagatcatgaattttgctcagaagtggaagtcctcagctgtgctcagcacaggaatgttgttatgctgattgggttttgcatcgaggatagaaggcggctgttggtttatgagtacatatgcaatggatctctagatgctcatctatatgggcatcatcaggaacctttagaatggtctgcacggcaaaagattgctgtgggagctgctagaggtctgagataccttcatgaagaatgcagagttggctgcattgtgcaccgtgacatgcggccgaacaacattctcatcacccatgattttgaacctttggttggtgattttggccttgcaagatggcagcctgatggtgatactggagtggaaacaagagtgattggagcatttgggtatttggcaccagaatatgctcaaagcggccaagtcaccgaaaaagctgatatttattcctttggagtggtgttagttgaactagttacagggcggaaagcggtggaccttaataggcctaagggccagcaatgtctaactgaatgggctcgtccacttttggaagaatatgctatagatgaattggtggacccaagattggaggattgctattccgagcatgaagtctattgtatgctccatgccgcatcattatgcataaggcaggatcctcattctaggcctcgcatgtcacaggtgctacgcatattggaaggtgacatgcttatggactcgaattactcattgccaagatacgacattgggaaccgcagtggccgggtttgtgcagaccaaaaatattacagtggatccctggaaaatgaggcattagaagagttcaatgggaagctctaccttgacgggctaaggtcaggaaccaggaggacttcgtgcgcagatcatctgtaaaagcctacagggggttctttacacgcatggtacgcatatcaatctatcaatctatacatataattttgtgtagtagtagtattggaagcaaggggtaactgggttcttgtaattcttttgtggaaatgctgatctccaaagctatggtgaaatattatatgcttttctaattaaaccaatgaagcaccgcttga

SEQ ID NO: 2090 - DNA, 2685 bp, Glycine max
gcatcaacctcgtcttgctgctttctgatccacaaaagggaattggcaacacatatgctttggatggttgttgagagttcaaccttttgagcaaggtagtttttgaggcattattattattggtgccgatgagtcaagagcaacagaagcgggggaagcaagagaaaggttctgatggtgttgagaaggttattgttgccgttaaggcatcaaaggaaattccaaagactgctcttgtttggtctctcagtcatgttgttcaacctggggattgcattacactactagtggttgtgccttcacaaagttcaggcagaagattatggggttttccgagatttgctggtgattgtgccagtggtattaagaagtaccctccaggaacaatatcagagcagaagagtgacatcactgattcttgctctcagatgatcctacagcttcataatgtctatgatccaaacaagataaatgtcaggattaaaattgtatccggatcaccttgtggagcagtggctgccgaagccaagaaagcacaagccaattgggttgtattagacaaacagcttaaacatgaggaaaagcgatgcatggaagaactgcagtgtaacattgtagttatgaagcgttctcagcctaaagtactgcgcttgaatttgattggaccacagaagaaggaagttgaagaagcaggtccatcaccttctgagcaagatgacatgcctgaaaaccgaaccaaaataaagctggattccttaaattctatcaaaggaccagctgtaactccaactagcagccctgagctagggacaccattcactgcaactgaagctggtacttcatcagtttcaagctctgatccaggaacttcaccattcttcatatcagagatgaatggtgagttcaaaaaagaggaaactatcaaggaaagtcaagaacttgttgatactaattcagacacagaaagtgaaagtctatccacatcttcagcaagcatgagataccagccatggataacagaattgcttttacatcaaccatcaacacaatgcaatgaagagagatcagagatgtctcacggtatgcctcaagcatcaacaaccagagctttcctagaaaagtattctaggcttgatagaggagctggatttgaaatctcaacctatagaaatgacatggatttcagtgggaatttaagagaagcaatagcattatctggaaacgccccacctggtccccctccattatgttcaatatgtcaacacaaggcacctgtttttggaaaacctccaaggtggttcagctatgctgagttggaacttgctactggcggattttcacaggccaacttcttggcagaaggagggtttggatctgttcaccgaggggttctaccagaaggacaagtcattgctgtcaagcaacataaattggctagttctcaaggtgatcttgaattttgctcagaggtggaagtcttgagctgtgctcagcaccgcaatgttgttatgctcattgggttctgtatagaggataaaagaaggctactggtttatgagtatatatgcaatggatcattggattcacatttatatgggcgacaacgggatccattagaatggtctgcacggcaaaaaattgctgttggagctgctcgtggtttacgatatcttcatgaagagtgcagagtaggttgtattatccaccgtgacatgaggcctaacaatattctcataactcatgattttgaacctctggttggcgattttggtctggcgaggtggcagcctgatggggacacaggtgtcgaaactagagtgattggaacatttgggtatttggctcctgaatatgctcaaagtggccaaatcactgaaaaagctgatgtttattcctttggggtggtattagtggagcttgttactgggagaaaagctgtggatctcactaggccaaaggggcagcaatgccttactgagtgggcacgaccacttttggaagaagatgccattgaggaactgattgatccaaggcttggtaaccactattcagaacacgaggtctattgtatgctgcatgctgcatcattatgcatacagcgagatcctcaatgtagaccacgcatgtcacaggttctccgaatactagaaggtgacatggtgatggactcaaattacatctcaactccaggttatgatgcaggaaaccggagtggtagactttggtcagagccgttacaaaggcagcaccattatagtggtccccttttagaagagtctctggagtccttcagtggaaagctatcccttgacaagtacaagccttcctattggggagatagggacaaggctagaagggcttcatgtgtagatgacatctgaagtgattaatgatgaaaagttgcattcttgttatgctaaatataaaatatgtttgttacccacctattattttgttgtttcttatttcttctttttgttcaatgggatctgattttgcatctgtatagcagagtgaaagtaggataggtaagtatagaaaaccttttgaaaaatttcaggaaatcatgtaaactagtgcctaaatgaccttggcagactttaagtgctgtctatggtcttcactctctctccttgatcaattacatggtccaagactatcatgattctgacccattttcactta

SEQ ID NO: 2091 - DNA, 2601 bp, Glycine max
ttttgagcaaggtagtttttgaggcattattattattggtgccgatgagtcaagagcaacagaagcgggggaagcaagagaaaggttctgatggtgttgagaaggttattgttgccgttaaggcatcaaaggaaattccaaagactgctcttgtttggtctctcagtcatgttgttcaacctggggattgcattacactactagtggttgtgccttcacaaagttcaggcagaagattatggggttttccgagatttgctggtgattgtgccagtggtattaagaagtaccctccaggaacaatatcagagcagaagagtgacatcactgattcttgctctcagatgatcctacagcttcataatgtctatgatccaaacaagataaatgtcaggattaaaattgtatccggatcaccttgtggagcagtggctgccgaagccaagaaagcacaagccaattgggttgtattagacaaacagcttaaacatgaggaaaagcgatgcatggaagaactgcagtgtaacattgtagttatgaagcgttctcagcctaaagtactgcgcttgaatttgattggaccacagaagaaggaagttgaagaagcaggtccatcaccttctgagcaagatgacatgcctgaaaaccgaaccaaaataaagctggattccttaaattctatcaaaggaccagctgtaactccaactagcagccctgagctagggacaccattcactgcaactgaagctggtacttcatcagtttcaagctctgatccaggaacttcaccattcttcatatcagagatgaatggtgagttcaaaaaagaggaaactatcaaggaaagtcaagaacttgttgatactaattcagacacagaaagtgaaagtctatccacatcttcagcaagcatgagataccagccatggataacagaattgcttttacatcaaccatcaacacaatgcaatgaagagagatcagagatgtctcacggtatgcctcaagcatcaacaaccagagctttcctagaaaagtattctaggcttgatagaggagctggatttgaaatctcaacctatagaaatgacatggatttcagtgggaatttaagagaagcaatagcattatctggaaacgccccacctggtccccctccattatgttcaatatgtcaacacaaggcacctgtttttggaaaacctccaaggtggttcagctatgctgagttggaacttgctactggcggattttcacaggccaacttcttggcagaaggagggtttggatctgttcaccgaggggttctaccagaaggacaagtcattgctgtcaagcaacataaattggctagttctcaaggtgatcttgaattttgctcagaggtggaagtcttgagctgtgctcagcaccgcaatgttgttatgctcattgggttctgtatagaggataaaagaaggctactggtttatgagtatatatgcaatggatcattggattcacatttatatgggcgacaacgggatccattagaatggtctgcacggcaaaaaattgctgttggagctgctcgtggtttacgatatcttcatgaagagtgcagagtaggttgtattatccaccgtgacatgaggcctaacaatattctcataactcatgattttgaacctctggttggcgattttggtctggcgaggtggcagcctgatggggacacaggtgtcgaaactagagtgattggaacatttgggtatttggctcctgaatatgctcaaagtggccaaatcactgaaaaagctgatgtttattcctttggggtggtattagtggagcttgttactgggagaaaagctgtggatctcactaggccaaaggggcagcaatgccttactgagtgggcacgaccacttttggaagaagatgccattgaggaactgattgatccaaggcttggtaaccactattcagaacacgaggtctattgtatgctgcatgctgcatcattatgcatacagcgagatcctcaatgtagaccacgcatgtcacaggttctccgaatactagaaggtgacatggtgatggactcaaattacatctcaactccaggttatgatgcaggaaaccggagtggtagactttggtcagagccgttacaaaggcagcaccattatagtggtccccttttagaagagtctctggagtccttcagtggaaagctatcccttgacaagtacaagccttcctattggggagatagggacaaggctagaagggcttcatgtgtagatgacatctgaagtgattaatgatgaaaagttgcattcttgttatgctaaatataaaatatgtttgttacccacctattattttgttgtttcttatttcttctttttgttcaatgggatctgattttgcatctgtatagcagagtgaaagtaggataggtaagtatagaaaaccttttgaaaaatttcaggaaatcatgtaaactagtgcctaaatgaccttggcagactttaagtgctgtctatggtcttcactctctctccttgatcaattacatggtccaagactatcatgattctgacccattttcactta

SEQ ID NO: 2092 - DNA, 2562 bp, Glycine max
cacggaagtttttgaggcaatcttattggtgctgatgagtcgagagcaacagaagcgggggaagcaagagaaaggttctgatggtgctgagaaggtcattgttgccgttaaggcatcaaaggaaattccaaagactgctcttgtttggtccctcagtcatgttgttcaacctggggattgcattacactactagtggttgtgccttcacaaagttcaggcagaagattatggggttttcctagatttgctggtgattgtgccagtggtattaagaagtaccctccaggaacaatatcagagcagaagagtgatctcactgattcttgttctcagatgatccttcagctccataatgtctatgatccaaacaagataaatgtcaggattaaaattgtttccggatcaccttgtggagcagtggctgcagaagccaaaaaaacacaagccaattgggtcgtattagacaaacagctcaaacatgaggaaaagcgatgcatggaagaactgcagtgtaacattgtggttatgaagcgttctcaacctaaagtactgcgcttgaatttgattggaccacaaaagaaggatgttgaagaagcaggtccatcaccttctgagcaagatgacatgcctgaaaaccgaaccaaaataaagcttgattccttaaattctatcaaaggaccaactgtaactccaactagcagtcctgagctagggacaccattcactgcaactgaagctggtacttcatcagtttcaagctctgatccaggaacttcaccattcttcatctcagagatgaatggtgagttcaaaaaagaggaaactatcaaggaaagtcaagaactggttgatactaattcagacacagaaagtgaaagtctgtccacatcttcagcaagcatgagataccagccatggatcacagaattgcttttacatcaacaatcatcacaacgcaatgaagagagatcagatatatctcacggtattcctcaagcatctacaaccagagctttcctagaaaagtattctaggcttgatagaggagctggatttgaaatctcaacctatagaaatgacatggatttcagtggaaatttaagagaagcaatagcattatccggaaacgccccacctggtccccctccattatgttcaatatgtcaacacaaggcacctgtttttggaaaacctccaaggtggtttacctattcggagttagaacttgctactggtggtttttcacaggccaacttcttggcagaaggagggtttggatctgttcatagaggggtcctaccagaaggacaagtcattgctgtcaagcaacataaattggctagttctcagggtgatcttgaattttgctcagaggtggaagtcctgagctgtgctcagcaccggaatgttgttatgctcattgggttctgtatagaggataagagaaggctactggtttatgagtatatatgcaatggatcattggattcacatttatatgggcgacaacgggatacattagaatggtctgcacggcaaaaaattgctgttggagctgctcgcggtttacgatatcttcatgaagagtgtagagtgggttgtattatccaccgtgacatgaggccaaacaatattctcataactcatgattttgaacctctggttggcgattttggactggcaaggtggcagcctgatggagacacgggtgtggaaactagagtgattggaacatttgggtatttggctcctgaatatgctcaaagtggccaaatcactgaaaaagctgatgtttattcctttggggtggtattagtggagcttgttacagggagaaaagctgtggatctcactaggccaaaggggcagcagtgccttactgagtgggcacgaccactgttggaagaatatgccattgaggaactgattgatccaaggcttggtaagcactattcagaacatgaggtctattgcatgctgcatgctgcatcattatgcatacagcgagatcctcaatgtagaccacgcatgtcacaggttctccgaatactagaaggtgacatggtgatggactcaaattacatctcaactccaggttatgatgcaggaaaccggagtggtagactttggtcagagccgttacaaaggcagcagcattatagcggtccccttttagaagagtctctggaatccttcagtggaaagctatcccttgacaagtacaagccttcctattggggagacagggacaaggctaggagggcttcatgtgaagatgacatctgaagtgattgatgatgaaaattgcattcttgttatgctaaatataaaatatgtttgttgcctacctattttgttgtttcttatttccttttttgtgcaatgggatctaattttgcatctgtatagcagagtgaaagtaggataggcaagtatagaaaagcttttgaaaaaaattcaggaaatcatgtaaactagtgtctgaatgacttgacagacctaactgctgtctatatgatcttcactcttcaaccctccctaatttattttatgttccaact

SEQ ID NO: 2093 - DNA, 2434 bp, Lotus japonicus
attgtcctgtggaagttgaaatgtacaaggcacaagcatgttggtgataaatgataattgtactggtggggcaggcttatggtattgaacatcttcttgtgtttcactttcttctacattggagttagggacatgtatgcttttcatggttgttgttgaaacttaaaagagctgaattttttgagttaagttcttgtggcattattattgctgatgatgagtcaagagcaacagaaacggggtaagcaagagaaaggttctgatggtgctgagaaggttattgttgccgttaaggcttcaagggaaattccaaggactgctcttgtttggtccctgactcatgttgttcaacctggagattgcattactctgcttgtggttgtgccttcacaaaattcaggtagaagattatggggatttccgagatttgctggtgactgtgccagtggtattaagaagtaccctccaggaaccattttagagcagaaaagtgatatcactgattcttgctcccagatgatccttcggctccatgacgtatatgatccaaacaagataaatgtcaggattaaaattgtttccggatcaccttgtggagcagtggcggcagaagccaagaaagcagaagccaattgggtggtattagacaagcatctcaaacaagaggaaaagcgatgcatggaggagttgcagtgtaatattgcggttatgaagcattctcaaccaaaagtgctacgcttgaatttgattggaccacaaaagaaggatgttggagaagcaagtccatctccttctgagcaagatgatatgcctgaaaagggaaccagaaacaagattgattctttaaattctatcaaagggccaactgtcactccatctagcagccctgagctagggacaccgttcactgctactgaagctggtacctcatcagcttcaagctctgatccaggaacctcaccattctttaactcagaggtgaatggtcaatcaaagaaagaggaaaccatcaaggaaaatgaagagcttggtgatactaattcagatacagaaagtgaaagtctgtccacatcttcagcaagcttgagatttcagccgtggatcacagaattgcttttacatcaacaatcatctcaatgcaatgaagaaagatcagagacatatcctggtatgcctcaagcacctacaaccagagctttggtagaaaagttttctaggcttgatagaggagctggaattgaaatctcaacctatagaaatgactctgatttcagtggtaatttaagagaagcaatagcattatcaggaaatgctccaccaggtccccctccattgtgttcaatttgtcaacacaaggcacctgtttttggaaaacctccaaggtggttcagctatgctgagttagaacttgccactggtggattttcacaagccaacttcttggcagaaggagggtttggatctgttcacagaggggttctacctgaaggacaggtcattgctgttaaacaacacaaattggctagttctcaaggtgatattgagttttgctctgaggtagaagtcttgagctgtgctcaacaccggaatgttgttatgctgattgggttctgtatagaggataaaagaaggcttctagtttacgagtacatttgcaatgggtcattggatgtacatttatatgggagacaaagggatccactagaatggtctgctcggcaaaaaattgctgttggagctgctcgtggtttaaggtatcttcatgaagagtgcagagtgggttgcattatccaccgtgacatgagaccaaacaacattctcataactcatgattttgaacctctggttggtgactttggactggctaggtggcagcctgatggagatacaggtgtggaaactagagtgattggaacattcgggtatttggctcctgaatatgctcaaagtggccaaatcactgaaaaagctgatgtatattcctttggggtggtattagtcgaacttgttacagggagaaaagctgtggatctcactcggcccaagggacagcagtgccttactgagtgggcacgaccgctcttggaagaatatgccattgatgaactgattgatccgaggctaggtagtcactatgcagagcaagaagtatattgcatgctgcatgctgcagcattatgcatacggcgagatcctcattccagaccacgcatgtcacaggttctccgaatactagagggagacatggtcatggacacaaattacatatcaactccaggttatgatgtgggaaacaggagtggtcgaatttggtcagagcctctacagaggcagcacccttacagtggtcccctcttagaagaatcattcagtgggaagctatctcttgacaaatacaaacctgcctactgggatagggataggcactagcctt

SEQ ID NO: 2094 - DNA, 1330 bp, Vigna unguiculata
  misc_feature (1246)..(1246): n is a, c, g, or t
ggttctaccagaaggacaagtcattgctgtgaagcaacataaattagctagttctcaaggtgatcttgaattttgttcagaggtggaagtcctgagctgtgctcaacaccggaatgttgttatgctcattgggttctgtatagaggataagagaaggctactggtttatgagtacatatgcaacggatcattggattctcatttatatgggcgacaaaaggatccattagagtggtctgcacggcaaaaaattgctgttggtgcagctcgtggattacgatatcttcatgaagagtgcagagttggttgcattatccaccgtgatatgaggccaaacaacattctcataactcacgattttgaacctctggttggtgattttggactggcgaggtggcagcctgatggagacacaggtgtggaaactagagtgattggaacatttgggtatttggctcctgaatatgctcaaagtggtcaaatcactgaaaaagctgatgtttattcctttggggtggtattagttgagcttgttactgggagaaaagctgtggatctcactaggccaaagggacagcagtgccttaccgagtgggcacgacctctcttagaagattatgcaaccgaggaactgattgatccaagacttggtaaccactattctgaaaatgaggtgtattgcatgctccatgctgcctcattatgcattcagcgagatcctcaatgtagaccacgcatgtcacaggttctgcgaatactagagggtgacatggtgatggacacaaattacatctccactccaggctatgatgcaggaaaccgaagtggtagactgtggtcagagccattgcaaaggcagcaccattatagtggtccccttttagaagagactctggagtccttcagtgggaagctatcccttgaaaagtacaagccttcctactggggtgatagggacaaggctagaagggcctcatgtgaagatgacatttgaattgattgatgaagaagattgcgttcttgttatgctaaatatatagaacatgcttgttctccacctattttgttagttttttattccttttttcttgtgcaatgggatctaattttgcatttgtatagcagagtgaaagtaggataggtaaatatagaagcttttgaagaattttcaggaaatcctgtaagttagtgcctcagtgaccttgatagagttagtgctgctgtctactatcttcatcactctttnaatctctctctctgatcttttatattatattatatgatccaaaaaccattacaatttcagtaaaaattgattagaaatatctga

SEQ ID NO: 2095 - DNA, 3515 bp, Aristolochia fimbriata
gcgtaggttttgaagttctccagcgtttttcttttggggttttgtctgttgttaccgtgtcgccgactgtgtgaaagggataagaggctgaagacgccgggaactggagagagcctctagcttgagccggatttgatccagttttgtaacttcccttgctggaatccggagtggaagaatattgtttttcggatttcgaactgtggtaatgcaggtttcgtgcctggtttgcacctgaacttgcttggattcagggactggagacttctccttctccgtgtttgagtgaaagccggaggttcttagtgtgctttgcttctcaaaatttgttgcttgctctgttgacctttgaggcgaactgaacgaacgagtttgtttgaagtctcatccgaaagcttcttaggctattcgtaagaagtgggaaaccaaccgcaattaagctatttagtgctgtagatcacagagcgaccgactttgctggtagatccttttgccgatcacgaatctggttattttaccaagccggaacttggggaccctttgtttggattctcaagaggccttgtcagtgtgtttgaaagatcattactattggaatatcttaaagtcgtatgcggtgcttggatttttgagacgctgttgtaaattcgttggagaaaagcctccatttcccatttcaagggtgccccgaattgtgaagcttcgccagctgcctgtttctcgcttcggttaatccttctctgaaggtttcgagtagacgcaaatatttgaatttattttcgcggcattgattcaataaagagggagggagagagagagagaagagagcagttgttttaagatttggctcgcgggctttcccgattcttaaagttaagaggagcgcaggaaggtaaaagaatctttctgtgtggaaaacttttccgaggggcgtcgatttttctctttaaatctgttctgtttctacagaggcaggaacagagccttctctcaacccggaagtgtttccaggttttatcagtgagaagagaggttttggataatgaagccggtgtaaggctgccttcaagtttttggatgccatgagcaataatctccaacataggcgtgggaaggagagggactcggatattactgagaaagttgttgttgctgtcaaagcttctaaagaaattccgaggacagccctcgtttgggccttaactcatgtcgttcagcccggtgattgcattacgctgttagtagtagtgccatctcatagttcaggcagaaagctgtggagtttcccaaggtttgccggagattgtgcaagtggccataaaaggtctcattcaggaactaccacagagcagaaatgtgacattacagattcatgctcgcagctgatgctgcagctccatgatgtctatgatcctaacaagataaatgtgaagataaaggtaattactgggtcaccatctggtgcagtggctgcagaatgcaagagagctcaagctagctgggttgtgttagacaaacaactgaagcaagaagagaagcgctgcatggaggagctgcaatgtaatatagtagtaatgaagcgttctcaaccaaaagttctccgtctcaacttggctggatcaccccaaaaagagctaacagattccttatccaacgaattacatgagccatcctctaagcctcctccaaagatcagtcacagctccatggcttccatccgtggacctgtcgtgactccaactagcagtcctgagctagggaccccctttacagctacagaggtagggacctcctctgtctctagttcagatcctggaacttcaccatttttggtatctgatgcaaatggaagcttgaaaaaagaaggggccaacatcatggaggatagccggaatttgcccacaagctcagactctgatagtgagaatctaagccccccttccacaagtctagatgtccagccctggatgactgatattctaagtcttaggcatcacactttaaaacatgttgaagacaaatcagagagagtgaatgataaaactcatacttctactgctaaagctttgcttgaaaaattttctaagcttgatctagaggctggaattggtacactgaactatagatcggaacttgacttcagtggaaatgttagggatgcaattgcactgtcaagaagtgcacctccaggtcctcctcccctttgttccatatgccaacacaaggctccagtttttggaaaaccaccaaggtggtttagttatgctgaattggagcttgccacgggtggattttctcaagcaaattttttggctgaaggagggtttggatcggtgcatagaggtgtttttcctgatggtcaggcggttgcggtgaaacaacacaaactgggtagttcacagggggatcatgagttttgcttggaggtggaagttttaagctgtgcacaacataggaatgtagttatgttgattggtttttgtgttgaagacaagcgccggctgctggtttacgaatacatttgcaatggatctttagattctcacctttatggaaataatcgagacccgttggcatgggctgcacgtcaaaagattgcagttggtgctgctcgaggcttgcgataccttcatgaagaatgtcgtgtaggttgtattgttcatcgtgatatgaggccaaataatatactcatcacgcatgattttgagcctttggttggagattttggccttgcaaggtggcagcctgatggagacatgggagtggaaacaagagtaattggaacatttgggtatctggcgccagaatatgctcaaagtggccagattactgagaaggctgatgtttattcatttggtgttgtactcgtggagcttgtaactggcaggaaagctgttgatataaaccggccgaagggtcagcagtgtctcactgaatgggcgcgccctttattggaagagtatgccattgatgaactagtggatcctcgcttggagaaccattattgtgaacatgaggtgtattgcatgctgcatgctgccgccttatgcattcgtcgtgatccccagtccaggcctcgaatgtcccaggtgctgcgtatattggagggtgacctggtggtggattccaattatgcttctacgccggtttatgagcctgggagcaggagtaggagaatgtggccagagcagcagcaacatagtggtccaatcactacggatgcggaggggttcagtgggaagctttcgtacgaagctttgagagcggcgtactggggaaaggagaaagctaggcaagaatcttgtaatcgggacgacggttgcttctgagtctaggagggaaacatcagatgtcacatgtacgagacccaattccttccattctcatctcttttgcacgggaatcccttatctgcttcattgaatttttgcttgtacagttgttgcattataagctattgtataaatgtgcttgaagtcgaaggaaatgatgctttacgactatgtcggcagtcg

SEQ ID NO: 2096 - DNA, 1514 bp, Gossypium hirsutum
ccgcgcaggttcaactcgagcttatgtcagggctcaaggttctacatcaaaagccttactggagaaattttcaaaacttgatagagaagctggaataggaatgtcaagctttaagagtgatattggatttagtggaaatgtaagagaagcagttgcgttatccagaaattcccctcttggccctcctccattgtgttcaatatgtcagcataaggcacctatatttggaaaaccaccaaggtggtttacctatgctgagttggagcttgcaactggtggattttcacaagctaatttcttggctgagggtgggtttggatctgttcatagaggggtactcccagatggacaggtgattgcagtcaagcaacacaaattggctagttgtcaaggagatcatgaattttgctcagaagtggaagtcctcagctgtgctcagcacaggaatgttgttatgctgattggcttttgcatcgaggatagaaggcggctgttggtttatgagtacatatgcaatggatctctagatgctcatctatatgggcatcatcaggaacctttagaatggtctgcacggcaaaagattgctgtgggagctgctagaggtctgagataccttcatgaagaatgcagagttggctgcattgtgcaccgtgacatgcggccgaacaacattctcatcacccatgattttgaacctttggttggtgattttggccttgcaagatggcagcctgatggtgatgctggagtggaaacaagagtgattggagcatttgggtatttggcaccagaatatgctcaaagcggccaagtcaccgaaaaagctgatatttattcctttggagtggtgttagttgaactagttacagggcggaaagcggtggaccttaataggcctaagggccagcaatgtctaactgaatgggctcgtccacttttggaagaatatgctatagatgaattggtggacccaagattggaggattgctattccgagcatgaagtctattgtatgctccatgccgcatcattatgcataaggcaggatcctcattctaggcctcgcatgtcacaggtgctacgcatattggaaggtgacatgcttatggactcgaattactcatcgccaagatacgacattgggaaccgcagtggccgggtttgtgcagaccaaaaatattacagtggatccctggtaaacgaggcattagaagagttcaatgggaagctctaccttgacgggctaaggtcaggaaccagcaggacttcgtgcgcagatcatctgtaaaagcctacagggggttctttacacgcatggtacgcatatcaatctatcaatctatacatataattttgtataatagtagtagtattggaagcaagaggtaactgggttcttgtaattcttttgtggaaatgctgatctccaaagctatggtgaaatattttatgcttttctaattaaaccaatgaagcaccgcttgagaagtagatggttattttcttccttc

SEQ ID NO: 2097 - DNA, 2901 bp, Medicago truncatula
ggcacgaggctcacctcactcatcaaaacaaagctcacacctttcttcttcattccaataaacactcttttctctttcagggtcaccttatctctcattaaagtcttcaactttctttcattttctttgacccctcatttccataaccgttttctcaaatacattttacctggaagaaatcaacattaaacaacacaacaataattggtggaaaatttgatgatgaagtttgatagagctacaaagctaaatgaacctataaatgatcatgtgagggttgattgtgttgtttcctgttgaaatagaaagcatagggtcccaagatactatttgtgtatagcaaatttggaattattggtggatttttccttctaagttgcttttttttaggtactagagccaagcacaaaaaagcaaagctagtgaaatgatgaaagggtgaggtgcattttgaacttcagggggggctgctactagtgtgaaaacatcttgctttctgagccacaaaaaggggtaagctaagggtattgaaagtcttcttgtggagcatatatctatcatacatggtctttgagacttgaattgagagttagttttaagcaaggtagtttttgtggcattgttatcggtgacgatgagtcgagagcagcagaagagggggaagcaagagaaaggctgtgatggtgctgagaaggttattgttgctgttaaggcatcgacaaaggaaattccgaagacagctcttgtttggtcactgactcatgttgttcaacctggtgattgcattacacttctggtggttgttccttcacaaagttcaggtagaaaatggggttttccaagatttgctggtgactgtgccagtggtattaagaagtatcctccaggaacaattttagagcagaagagtgatatcactgattcttgctctcagatgatccttcagctccatgatgtctatgatccaaataagataaatgtcaggattaaaattgtttccggatcaccttgcggatcagtggctgcagaagccaagaaaggacaagctagttgggttgtattagacaaacatctcaaacccgaggaaaagaaatgcatggaagagctgcagtgtaacattgttgttatgaagcgtgctcaaccgaaagtgcttcgcttgaacttgattggaccaaaaaagaaggaagttgaagaggcatgtacatcaccttctgtgcaagacgatatgcttgaaaagcaaaccaaaaataagattgattctttagtagattctatcaaaggaccaaatgttactccaactagcagccctgagttaggtacaccattcactactactactgaggccggtacttcatcagcctcaagctctgatcctggaacatcaccgttctttatctcaatgaatagtgagtcgaagaaagaggaaaccatcaaggaaagtcaagaactttgtgatactaattcagacacagaaagtgaaagtctgtccacatcttccgctagctttagataccagccgtggatcacggaattgcttttacatcaacaatcatctcaacacaacgaggaaagatccgagccttatcacggtatgcctcaagcaactacaaccaaagccttgctagaaaagttttctaggcttgatagaggagctggaattgaaatgtcggcagcatatagaaaggactcggactttagtggtaatttaagagaagcaatagcattatcaggaaatgctccacttggtccacctccattgtgttcaatatgtcaacacaaggcacctgtatttggaaaacctccgaggtggttcagctatgctgagttggaactcgctaccggtggattttcacaagctaacttcttggcagaaggagggtatggttctgttcaccgaggggttctaccagaaggacaggtcattgctgtcaagcaacataaattggctagttctcaaggtgatgttgagttttgctctgaggtagaagttctgagctgtgctcagcaccggaatgttgttatgctgattggattttgtatagaggataagagaaggctactggtttatgagtacatatgcaatggatcattggattcacatttatatgggcggcaaagggatccattagaatggtccgcacggcagaaaattgctgttggagctgctcgtgggttaaggtatcttcatgaagagtgcagagtaggttgtatcatccaccgtgacatgaggccaaacaatattctcataactcatgattttgaacctctggttggtgattttggactggcaaggtggcaacctgatggagacatgggtgtggatactagagtaattggaacatttgggtatttggctcctgaatatgctcaaagtggccaaatcactgaaaaagctgatgtttattcatttggggtggtactggtggagcttgtaactggtagaaaagctgttgatctcactaggcccaagggacaacagtgccttgctgagtgggcacggccgctgttagaagaatatgccattgacgaactgattgacccgagggctgggaggtcactatttagaacatgaggtctattgcatgcttcatgctgcttcattatgcataaggagagatcctcattctagaccacggatgtcacaggttctccgaattctagagggtgatatggtgatggacgcaaattacatttcaactccaggctatgatgttggaaacaggagcggtcgcctttggtcagagccactgcagaggcagcaccattgcagtggtcccctcttagaagattcattggagtcatcattcagtggaaatctatctcttgacaagtataaacctgcttcctattgggataggagcagggacaagccaagaagggcatcatgtgaaggtgatactt

SEQ ID NO: 2098 - DNA, 2447 bp, Artemisia annua
ggtagaatttgtatttggcgttatttatgggttcagttagtaaagaagcgaatatggggaaaacggaaaagggttcggatgctgctgctgagaagatagttgtcgctgttaaagcgtctaaggagatcccgaaaactgcgctggtttgggctttgactcatgtggttcaaccgggacactgcattacattgcttgtggtcttgcctgcacaaacttctggtagaaaattatgggggtttccaagatttactggagactgcgctagtggctaccggaagtctcttttaggaacaactttagaccaaaaaaccgatattacagattcttgctcacagatgatccttcagcttcacgacgtatatgatcctaataagataaatgtgaaaataaaaattgtttctggttcaccgtgtggagcagtagctgcagaagccaagaaaattcaagcaacttgggttgtcttggacaagaagcttaaacatgaacaaaagcgatgtatggaagacttacaatgcaacatcgtgataatgaaaaagtcacaaccaaaagttgttcgtttaaatttagtcgaaacgcctaagacgagacctggagcaggctgtccattgccttccaaagataaaccgtctgaaaaacaaacgaaaaacacaagctcatcccttggttccagtagtggaccagttgttactccaacaagtagtcctgaagtatttaccacaactgaagccgggacctcatccgtctcaagttctgatcctggaacttcacccttttttgtacctgtaacgaacggttccttaaagaaagagaaatctataatgggaaaggagagtcaggatctcatcgagtcgagttcagactctgaaagcgagcatttatcatcaacttcttctagcttaaggtttcaaccgtggatggtggacagaattacgtcaagctgtcaatcttctcacaacctagctcaaacttccacaactcaagacatgttcaggaggttatctaagcttgatagagatagcgaacatggaagccacagaagtgacgttgactttagtattaatgtaagagacgcaatatctttgtctagaaacgttccttctggcccacctccgttatgctcaatatgtcaacacaaggcgcctatatttggcaagcctccacggtggttcacgtatgctgagctggagcttgctactggtggattttctaaagctaacttcttggcggaaggagggtatggttctgtacacagaggggtacttccagatggtcaggcggttgctgttaagcaacataagttagcaagttctcaaggggatcaagaattctgctcagaagttgaagtgttgagctgtgctcagcacagaaacgttgttatgctgattggattttgtatcgaggacggaaggagattactcgtttatgaatatatatgcaatggatcattagatactcatctttatggacgtcaacgagatcctttagaatgggcagcacggcaaaaagttgcggttggagctgcaagaggattacgatatcttcatgaagaatgcagagtaggctgcattgtgcatcgtgacatgcggccaaacaacatcctcatcacccatgatttcgaacctttggtaggggattttggcctagcaaggtggcaacctgatggtgacactggagaagaaactagagtcattggaacattcggatacttggctcctgagtatgcacaaagtgggcagatcaccgagaaagctgatgtgtattcttttggagttgtattggtggagcttgttacaggacgaaaagcagtggatcttaaccgacctaaaggccagcaatgcctcacagaatgggcacgtccattgttggaagaagacgccattgatgagttaattgacccacgactagggaactcttactcagaagatgaggtttattgcatgttgcaagctgcttcactatgcataaaaagagatccacagttgcgtccacgcatgtcacaggtactacggatactagaaggtgacatgatcatggactcaagtcttgacgttgggaatcggagtggtaggatttatttggatcatcatcaactaagtccaatgagggagacactggaagtgtttgatagcaaactttctctcgactcaatgcgtactccttattggcaaagagataaggccaaaaggacttcatgtgaagatcgaaggtaaatcaaacccaaatgcttaacacgatgaacttaatcatccttttttgttcatcttgtatgcttttgtccctgtacgggacatatgattagttagtctttttgtaattcatcctgaatgagaagaaagttgcacaaagtgttggtttaagtccatggcgagtatattatttggaatttcaacaaacacaatcacatccattgcgaaaaaaacaaaaaaaaaacatgtcgcatctagaat

SEQ ID NO: 2099 - DNA, 2922 bp, Solanum phureja
tatatatacaattagctgtcttcttcacctgatcatttttttcatatctatatttctgtgtaaacatttctataacaatgtctaaaaccaactgttagacaaaaaaaataataaaaaatctctgtagctgcacaaatatacatttttcactgatattggaaaaacacaaactcatcattcattcagcagaaattattgattttgatgagttgttgtaagttgtgggtcaactttgaaaaaccccatttcaagtttttttgattcatctctttcaggtggaggagggagattcgttctataatctgagtgctttttgggttttggttgtggagatttggaggggcttgaggtgtcactattattatcgatacatcagctacaggtcactgaaaactcaactcttgtgtcaattcaacgatttgacatgatttacttgtgggttctcagaatctagtaaagagaaatggtctagcatgttgatttgagttgaaagttgttaaggcaaataggaaaggaagacattgttgtgttctgatgagtcgtgagatgaagaaagggaaacaggatatgagttctgatgccgcagagaaagtgatggtggctgttaaggcatcaaaggaaatacccaaaacagctcttgtatggtctttgactcatgttgttcagcctggtgattgcattacactactcgtggttgtgccttcacagagttccggtaggaagttatggggtttccctaggtttgctggagattgtgccagtggccactggaagttacactctggaaatagttcggagcacaagtccgacataacagattattgctcccagatgatccttcagcttcatgatgtttatgatcccaacaagataaatgtcaagattaaaattgtttctggtacaccgcatggagctgtggctgctgaggcgaagaagtctcaggcaaattgggttgtcttggacaagcatctcaaacatgagaagaaacgctgcatggaagagttgcagtgcaatattgtaatcatgaagcgatctcaaccaaaagttctccgtttaaatttagtaggctcacctaaaaaggaacctgatgtcatgggcacattatcttcagatcaaactcaaatatgtggaaaagaatcaaacaagaaggattcattggattcttctcgaggtccacttgtaactccatccagtagtccagagatgttcagtacgactgaagctggtacttcatcagtttcaagctctgaccctggaacttcgccattttttgtcgctgaagtaaatagggatctgaagaaagcaaatttattagctgccaaggaagatgtagatgaatcgagttcagagagtgagagtgagaatttatccgcatcatcaagtttaaggttccaaccatggattgtggacataatcaattcacattctgaactctcgcaaatcaaaggaaagagctcactgagaactcatgacaggccacaagattccacaaataagacatttctgcggaagtttagtaagcttgacgaggaaagtgattttggatccccgagttatagagctgatttggagtacagtgggaatgtgagagaagcagtttctctgtctagaagtgcacctcttggccctcctcccttgtgctcactttgtcaacacaaggcacctgtatttggtaaaccgcccaggtggtttacttatgctgagctggagcttgcaactggaggattttcgcaagcaaattttttggctgagggaggatatggatctgttcatagaggagtccttccagatggtcaagttgttgctgtgaagcaacacaaattggcaagttctcaaggggatcaagagttttgctcggaagttgaagttctcagctgcgcacagcaccgaaatgttgtaatgctgataggattctgtattgaggacagcagaagactactagtatacgaatatatatgcaacggatcgttggattctcatctatatggtcgtacgagagatcctttggagtggtctgctcgtcaaaaaattgctgttggtgctgcacgaggtttacgctatcttcatgaagaatgcagagtgggctgcattgtccacagagatatgagacccaacaacattctcatcacccatgacttcgaaccactagttggagactttggtttggctaggtggcaacctgacggtgacacaggcgttgaaacgagagtaattggaacatttgggtacttggcgcctgagtatgctcaaagtggccagattaccgaaaaagctgatgtttactcatttggagtggtactggtggagcttgttacaggacgcaaggcagtggatcttaccaggcctaaaggccagcagtgtctcacagaatgggcgcgtccattgttgcaagaatgtgctgttgatgagctaatagatccccggctagagaactgctactcagaacatgaaatatactgcatgttgcatgctgcatctctgtgcatacggcgggatcctcagaacaggcctcgcatgtctcaagtacttcgaatacttgaaggcgaccttatcatggaatctggaaaattgtcaacaacgcctggatatgatgttggaaaccatagtggaaggatatggtcagatgcccagcaacagtatcaaaggttcagtggttctttattaaacgatggatcggaggaattcagtgccaagctctcatttgacaaaaggaatccctcaaatatttgggacagggatcaatccaggacaacatattagggaccatctgtagataaattgatcttgagacactaagatacattttgctgctttatcaggtttatttagccaggcagttttgtcgaagccatgtgattgttttattatatccttgtatagaaggtaggcgtaatatagtagtatatgtttcgtatttgatgt

SEQ ID NO: 2100 - DNA, 2466 bp, Cucumis sativus
gtaatgagtcgggatctgaagcgaggaaagcaggacaaaggttctgatgatgtccagaaggtgattgtcgcagtgaaggcttccaaagaaattcctaaaactgcactggtttgggcgttgactcatgttgttcaaattggagattgcataactctgttggttgttgtcccttctcaaagctctggtagaaaattctggggttttccgagatttgctggggattgtgcaagtggtcacaagaaagctcattctggaacaagctcggagctgaaatgtgatattactgattcctgttcacagatgattcttcagcttcatgatgtttatgatccaaataagataaatgtgaaaattaaaattgtttcgggttcaccgagtggggctgtagctgctgaggccaagagagctcaagctagctgggttgtattagacaaacagctcaaacacgaggagaaatgttgcatggaagagttacagtgcaacattgtggtaatgaaacgatcacaaccaaaagttcttcgtttgaacctggttgggtctccaaagaaggaaccagaagttccctctccgtcaccttctgatatatatgaagggtctgaaagccatcaaaaagaaaataatgaccctctagattttatacggggaccagttgtgactcccagtagcagtccagaattgggcacaccttttactgctactgaagctggaacatcatcagtgtcaagctcagatcctggaacttcaccatttttcaactctgaaatgaatggagacacaaagaaggaggaattgtttgttataaaggaaaataaagaacttgatgctgctagttcagactctgatattgagaatttatctgtgtcgtctgcaagtttaagattccaaccatggatgacagagtttctaagttctcatcttcaatcctcacaacacattagtggaaggtcacagagatgcgatgataggaatcaagcgtcaacaagaaattcttttctactgaagtcttctaaacttgacagagaatcaagtattggaatgtcaagccatagaagtgacaatgattttcacggggatgtacgagatgcagtttcattatccaggaacacgccaccaggccctcctccattatgttcaatatgccaacacaaggcaccagtttttggaaagcctccaaggtggttcagctatgctgaactggagcttgctactggtggattttcacaagctaactttttggctgaaggaggatatggatctgtccacagaggggtactcccagatggacaggtggtcgctgtcaagcagcacaaactagctagttctcagggagaccttgaattttgttcagaagtcgaagttcttagctgtgcacagcatcgaaacgttgttatgttgattggcttttgtatagaggagaagagaaggttgttggtgtatgaatacatctgcaatggttcattggattctcatttatatggacgccaacaagagccacttgaatggtctgcacggcaaaaaattgccgtgggagctgcaagggggttacgatatctccacgaagaatgtagagttggttgcattgttcatcgggatatgcggccaaacaacattcttatcacacatgattttgaaccactagttggagattttggccttgcaaggtggcagcctgatggagataccggtgttgaaacaagagttatcggaacatttgggtatttggctccagagtatgctcaaagtggccaaatcacagaaaaagctgatgtttattcctttggggttgtactggtggagctaattactggaagaaaagcagtagaccttagtcggccgaaaggtcaacagtgtctcactgaatgggcccgccccctgctggatgaatttctcattgatgaactgattgatccaaggttggtaaatagctttgcagagcatgaagtatactgtatgctgcatgctgcatcattatgcatccgaagagatcccaacgcaaggcctcgtatgtcacaggttttacgaattctggaaggcgacctcgtcatggatgctaattacttttccactcccggatatgatgtgggaaaccggagtggtcggatgtggactgagcaacagcagcagccacaaaactacagtggcttgttatcggatgagactgtagaaaggttcaatgaaaaggtctgtgttgaaagtttaagaccaggttactgggaaagagacaagacaaggaggacttccagtggaagtgaattgtaaagtggctcagcattcttaagatatacattgcaccctttagtctgctgaatttgtacttccccaattaatttttttgggtaattatttttttctcattataaacttttggtttgtgtatagtagtattagtaagtggaaaatatggtgggagttttttttgtaagttttgtagggaaaaatagtgtagtagtagtaagagcctatatg

SEQ ID NO: 2101 - DNA, 1550 bp, Cajanus cajan
gaacagagatgtctcataataggcttcaatcatccaccactagagctttgctagaaaaagttctcaagacttgatacagaagctgaaattgaaatctcaaactataagactgatgtggatttcagtggaaatgtaagagaagcaatagcattatctagaaacaccccaccttgtccacctccgttatgttcaatatgtcaacacaaggctcctgtttttggtaaacctcctagatggttcagctatgctgatttggagcttgccactggtggattttcacaagccaatttcttggcagaaggaggatttggatctgttcacagaggggttctaccggatggacaagtcattgctgttaagcaacataaattggccagttctcagggtgatcttgaattctgctcagaggtagaagtcctgagctgtgctcagcaccgaaatgttgttatgttgattgggttttgtattgaggataagagaaggctattggtttatgagtacatatgtaatggatcattggattctcatttatatgggaggcagcgagaaccattagaatggtcttcccggcaaaaaattgctgttggtgctgctcgagggttgcgataccttcatgaagagtgcagagtgggttgcattatccaccgtgacatgcggccaaacaacattcttattactcatgattttgaaccactggttggtgattttggtctggcaaggtggcagcctgatggtgacacaggagtggaaacgagagtaattggaacatttgggtacttggctcctgaatatgctcaaagcggccaaattactgaaaaggctgatgtttattcctttggtgtggtattagtggaactagttacgggacgaaaagccgtcgatctcaatcggcccaagggacaacagtgtcttactgagtgggcacgaccactattagaagaatatgccattgaggaactgattgatccaaggttgggaagtcactattcggaacatgaggtctattgcatgctacatgctgcctccttatgcataaggcgagatccttattctagaccacgcatgtcacaggttctgcgaatactggagggtgatacagtcatggatctaaattgcatttcaactcccagttatgatgtgggaaaccggagtggttaattttgttttttggccagaaacgcaagccattacagggtggtcccttgttgtaagagtcactggaagcgttcagtgagaagctctgagtacaagaaaccttgcctgttgggaaaggaacaagtctaagtggacaacatgtgaagatagaacttttttcacaatgaaggttgtagtcttatgctaaatatgttttttgccttactattttgtaatttgtagttttctttctatttctccgcaatttaatctaattttgcatgtgtatagtagggtaagtaatatatataatatatagaagctttttctgccttttgaaattcttttgcggaaattatgcaaccaatcctgtgtctatatgaccttgatgatgatgaaacgaactattattgtca

SEQ ID NO: 2102 - DNA, 2937 bp, Solanum lycopersicum
tatataatacaattagctgtcttcttcacctgatcagttttttcatatctatatttctgtgtaaacatttctataacaatgtctaaaatcaactgttagacaaaaaaaaataatattataaaatctctgtagctgcacaaatatacatttttcactgatattggaaaagcaaaaactcagcagaaattattgattttgatgagttgttgtaagctgtgggtcaactttgaaaaaccccatttcaagtttttttttgattcatctctttcaggtggaggagggagattagttctataatctgagtgctttttgggttttggttgtggagatttggaggggcttgaggtgtcactgttagtatcgataaatcagctacaggtcactgaagactcaactcttgtgtcaattcaacgatttgacatgatttacttgtgggttctcagaatctagtaaagagaaatggtctagcatgttgatttgagttgaaaaggcaaataggaaaggaagacgttgttgtgttctgatgatgagtcgagagatgaagaaagggaaacaggatatgagttctgatgccgcggagaaagttatggtggctgttaaggcatcaaaggaaataccaaaaacagctcttgtatggtctttgactcatgttgttcagcctggagattgcattacactacttgtggttgtaccttcacaaagttccggtaggaagctatggggtttccctcggtttgccggagattgtgcaagtggccactggaagttgcactctggaaatagttcggagcacaagtccgacataacagattattgctcccagatgatccttcagcttcatgatgtttatgatcccaacaaggcaagcattcaaattcttttcatctccactgctataaatgtcaagattaaaattgtttctggtacaccgcatggagctgtggctgctgaggcgaagaagtctcaggcgaattgggttgttttggacaagcatctcaaacatgagaagaaacgctgcatggaagagttgcagtgcaatattgtagtcatgaagcgatctcaaccaaaagttctccgattaaatttagtaggctcacctaaaaaggaacctgatgtcacgggcacattatcttcagagcaaactcaaatttgtggaaaagaatcaaacaaaaaggattcattggattcttctcgaggtccactagtaaccccatcaagtagtccagagatgttcagtacgactgaggctggtacttcatcagtttcaagctctgatcctggaacttcaccattttttgtctctgaagtaaatagggatctgaagaaagcaaatttatcatctgctcaggaagatgtagatgaatcaagttcagagagtgagagtgagaatttatccgcatcatcaagtttaaggtttcaaccatggattgcggacataatcaattcacattctgaactctcacaaatcaaaggaaagagctcattgagaactcatgacaggccacaagattccacgaataagacattgctgcggaagttcagtaagcttgatgaagaaagtgattttggatccccaagttatagagctgatctggattacagtgggaatgtgagagaagcagttgcgttgtctagaagtgcgcctcttggccctcctcccttgtgctcgatttgtcaacacaaggcacctgtatttgggaaaccacccaggtggtttacttatgctgagctggagcttgcaacaggaggattttcgcaagcaaattttttggctgagggaggatatggatctgttcatagaggagttcttccagatggtcaagttgttgctgtgaagcaacacaaattggcaagttctcaaggggatcaagaattttgctcagaagttgaagttctcagctgcgcacagcaccgaaatgttgtaatgctgataggattctgtattgaggacagcagaagactgctagtatatgaatatatatgcaacggatcattagattctcatctatatggtcgtacaagagatcctttggagtggtctgctcgtcaaaaaattgctgtgggtgctgcacgaggtttgcgttatcttcatgaagaatgcagagtgggctgcattgtccacagagatatgagacccaacaacattctcatcacccacgacttcgaaccactagttggagactttggtttggctaggtggcaacctgatggtgacacaggcgttgagactagagtaattggaacatttgggtatttggcgcccgagtatgctcaaagtggccagattacagaaaaagctgatgtttactcatttggagtggtactggtggagcttgttaccggacgcaaggcagtggatcttactaggcctaagggccagcagtgtctcacagaatgggcgcgtccattgttgcaagaatgtgctgttgacgagctaatagatccccggctagagaactgctactctgaacatgaaatatactgcatgttgcatgctgcatctttgtgcatacggcgtgatcctcaggccaggcctcgcatgtctcaagtacttcgaatacttgaaggcgaccttatcatggaatctggaaaattgtcaacaacgcctggatatgatgttggaaaccatagtggaaggatttggtcagatgcccagcaacagtgtcaaaggttcagtggctcctctgatggatcggaggaattcagtgccaagctctcatttgacaaaaggaacccctcgaatgtttgggataggtcaacatattagggaccatctgtagataacttgatcttgcttgacacacataagatacatttttctgctatatcaggtctatttagccaggcagttttgtcttaagccatgtgtttgtttgttttattatatccttgtatagaaggtagccgtaatatagtgcatgttatcctatttgatgt

SEQ ID NO: 2103 - DNA, 2547 bp, Eucalyptus grandis
cttattaaggtgcaattttggtttgggaagtgagcaactctgtcgcagaagacaactgagattttatttggcaatgagtagagaacagaagagaggaaagctggaaaagggcaacggtgatgttgctgagaaggtggtggttgctgttaaggcctcgaaggagattccgaagacagctctcgtgtgggctttgactcatgtcgttcaacctggggattgcattaccctgctggttgtggtttcttcccaaagttcaggaagaaagttatggggtttcccaaggtttgcaggggactgtgccagtggccatcggaagtcccatttaggttcaagtacggagcagaagattgacataactgattcttgctcccaaatgatccttcagcttcatgatgtgtatgacccaaataagataaatgttaagataagaattgtctctggctcgccgtgcggagcagtggctgcagaggcaaagaaagctcatgcaagttgggttgtgttggacaaacagttaaaacctgaggaaaaacgatgcatggaagagctgcaatgcaacattgttgtaatgaaacggtctcaggcgaaagttcttcgcttgaatttgacgggatcgccgaagaaggagattgaagctcaacccccgccatctgaactggatgaagcatctgataaacatcgcaaaattcagcatgaagccacgaattctgtccgtgggccagttgtcactccaaccagtagtccagagttagggacaccattcacttctactgaagctggagcttcatcagtgtcaagctctgaccctggaacttcaccctgtctcattcaatacgtgaatgcagacataaaaaagaatgccccttctgtagtgaaggaaaccagggatgttgatgaatgtagtagctcagactcagacaatgaaaatttatctctagcttcaacgagctggagatttcaaccattgatggcagaattacttaattctaattgtcacgattctgttcattttggacagaattttcagagagctaatgacacagtgcaggcattaatgaccaaggatatgccaagtaagtttgctagaagcaatgaagatgatctgattcaactgccagactacagggataatatggacataggtggaaatttgagaggagcaatctcactgtccagaaataagcccagtggcccccctccattgtgctcaatatgtcaaaataaatctcctgtttttggaaaacccccaagatggttcagctatgctgagctagagcttgcaactggcggtttttcacgggctaatttcttggctgaaggtggttttggatctgttcatagaggggtacttccagatggtcagatagttgctgtcaagcaacacaaattggctagttctcagggtgaccacgagttctgctcggaggttgaagtcctgagctgtgctcagcaccgaaacgttgtcatgctgattgggttctgtatagaggacaaaagaagattactggtgtatgagtatatctgcaacggttccctggattcacatctatacggatgtcatcaagagacattagaatggtcggcacggcaaaagattgctgtcggagctgctcgaggtttgcgatatcttcatgaagagtgcagagtgggttgtattgtccatcgtgacatgcgtcccaataacatcctcataactcatgattttgaaccactggtaggggattttggccttgctcggtggcagcctgatggacgcactggtgttgaaacaagagtaattgggacctttggatatctagctccagaatatgctcaaagtggacaaatcacagagaaagctgatgtatattcattcggggtggtgttggtggagcttgttactgggagaagagctgtggacgttgatcggcccaagggtcagcaatttttaactgagtgggctcgtccactgttggaagaatttgcgatggatcagctgatagatccacgactggaaaatcactattccgaggacgaggtttgctgcatgctccatgctgcatcgctatgcatacggcgcgatcctcattctaggcctcgcatgtcacaggtgctgcgcattcttgaaggcgatatgcttgtcgacatcaattacatgtcaactccagggtctgatgcaggaagccggagcggacgactttgggcagagcagcagccacagcattatcacagcagttccttactgaacgaagcaactgaagcatttagcgggaagctgagccacaaaacacggaggctctctatcaagtagcgggagatggccaggaggatatcatgtgaagatgagatgtgaggagaggctcatccagttctatatggcaagagttatttgccattttgcataattttttgggtctatctaaaaaattttggttgtgtacagtgcttaaggagagtagggaatagcatgctagtgtaattctttgaatagtgaatgctaagatgtgaaagtttggaagtatgtcatatattatagttaaatggttaaatcaagaatgcatctctctctct

SEQ ID NO: 2104 - DNA, 2328 bp, Glycine max
tgatgatgagtcgagaacaacagaagcgagggaagcaagaaaaaggttctgatggagctgaaaaggttattgttgccgttaaggcttcaaaggaaattccaaagactgctcttgtttggtccctaactcatgttgtgcaacctggcgattgcattacactgctagtggttgtaccttcacaaagtgcaggccgaagattatggggttttccaaggtttgctggtgactgtgccaatggtcagaagaagtctacttcaggatcatcaagttcagaacataagagtgatatcactgattcttgctctcaaatgatccttcagctccatgatgtctatgatcctaacaagataaatgtgaagattaaaattgtttctggatcaccatgtggagcagtggctgcggaagccaagaaatcccaagccaattgggttgtactagacaagcagctcaaacatgaggaaaaacaatgtatggaagagctgcagtgcaacatcgtggttatgaagcgttcccaacccaaggtactccgcttgaatttggttggaacacaaaagaaggattttgaagaattatgcccattaccttctgaacaaaatgagatgcctggaaaacaaattaagaagaagaatgattctttaaattccataaagggaccagttgtcactccaactagcagccctgagctagggacaccatttactacaactgaagctggtacttcttcggtttcaagctctgatcaaggaacttcaccattcttcatctctgagatgaatggtgagtcaaagaaagaggaaactattaaagaaaatccagaacttgatgattctatatcagacacagacagtgaaaatttgtccacatcttcgacaagcttgagattccagccatggatcactgatttacttttgcatcaacagtcatctcaacccaaggaagaaagaacagagagatcttataataggcttcaatcatctaccactagagctttgctagaaaagttctcaagacttgatagagaagctgaaattgaaatctcaacctataagaccgactacgatttcagtggaaatgtaagagaagcagtggcattatctagaaataccccacctggtccacctcccttatgttcaatctgccaacacaaggctcctgtttttggaaaacctcccagatggttcagctatgctgaattggagcttgccacaggtggatttcaaaagccaatttcttggcagaaggaggatttggatctgttcacagagggcttctgccagatggacaagtcattgctgtcaagcaacataaattggctagttctcagggtgatctagaattctgctcagaggtagaagtcctgagctgtgctcagcaccgaaatgttgttatgttgattgggttctgtatagaggataaaagaaggctattggtatatgagtacatatgtaatggatcattggattctcatttatatgggagacagccagaaccattagaatggtctgcccggcaaaaaattgctgttggagctgctcgagggttgcgatatcttcatgaagagtgcagagtgggttgcattatccatcgtgacatgcggcctaacaacattcttatcactcatgattttgaaccactggttggtgattttggactggcaaggtggcagcctgatggtgacacaggagtggaaactagagtaattggaacgtttgggtacttggctccagaatatgctcaaagcggccaaataactgaaaaggctgatgtttattctttcggtgtggtattggtggaacttgttacaggacgaaaggctgtggatctcaatcgaccgaagggacaacagtgtcttactgagtgggctcggccactattagaagaatatgccattgaggaactgattgatccaaggttgggaagtcactattccgagcatgaggtctattgcatgctgcatgctgcctcattatgcataagacgagatccttattctagaccacgcatgtcacaggttctgcgaatactggagggagacacggtcgtggacccaaattacatttcaactcccagttatgatttgggaaaacggagtggttgattttgttttttggccagaaacataagcaaagaaagcgccattacaacagtggtccccctttggtaagagtcactggaagcgttcagtgggaacctctgagtacaaaagccttttcctattgggaaagcaacaagtctaagtggacagacaacatgtgatgagataataactgttaaaacggttcagatgaaaattgcaatattgttatgctaaatatctttcttgcctta

SEQ ID NO: 2105 - DNA, 1191 bp, Amaranthus tuberculatus
ggaggttttgggtcggtccatcgaggtatattacccgagggtcaagctatagctgtgaaacagcataagttagcaagctcgcagggtgacgtagagttttgtgccgaggtagaagttttgagttgtgctcagcatcgaaatgtagttatgcttattgggtattgtatcgaggataaacgaaggttgctggtttacgagtacatatgcaatggatccctagatgcccatttatacggacgtaatcaacccccattggaatggtttgctcggcaaaagattgcagtcggagcagctcgaggactacgatatctacacgaagagtgcagagtgggttgcattgttcaccgtgacatgcgtccaaacaacattttactcacccatgattatgaaccattggttggggattttggcctggcaaggtggcaacccgatggagacactggagtcgaaacaagagtgataggcacatttgggtatttagctccggagtatgcacaaagtgggcaaatcacggaaaaggctgatgtctactcttttggtgttgtacttgttgagcttcttacgggaagaaaggctgtcgacttaacccgacctaaaggccagcagtgtcttactgaatgggcacgaccccttttggaagacggtgctattgatgagctaatcgaccctcgtcttggtaaccggtatctagaacccgaggttcattgccttatgcatgctgcttcattgtgtatacgacgggatcctcactctaggcctcgaatgtcccaggtcctgcgtgtattagagggtgacatgttcatggattcaagtgttatgtcgacaccaaggcacgacgttgggagtcgcagcggaagaatgaggctacaagatcgagaatcattcagcggtccaatacgcaatgaggagacggaagtttacacgggtagtctatcactcgaatcactaaggtcggctttgtgggagcgggaaagggttaggaattagtagaacgtcaagatagaattgatgggttttgaatgaaggtagttttatggattcagaattgtcctataattttggtttaatgtatagtatatggaggtgggttttgagaggattgtagtccattttggtgccttgtgatattcggttgtcaatattatatgcatttcgtgcatcatatatactattctattcctaatgaaatag

SEQ ID NO: 2106 - DNA, 1107 bp, Helianthus annuus
cggtacatagagggatacttccggatggtcaggtagttgctgttaaacagcataaattagcaagctctcaaggggatcaagaattctgctcggaagttgaagtgttgagctgcgctcagcatcggaatgttgttatgctgattggattttgtatcgaagacggaaggaggctgcttgtttatgaatatatatgcaacggatcactggattcacatctttatggacgtcatcgagatccactagaatgggctgcacgacaaaaaatcgcggttggagctgctcgaggcttacgctatcttcacgaagaatgcagagttggttgcattgttcatcgtgacatgcggccaaacaacatcctaatcacccatgattttgaacctctggtaggagattttggcctagcgagatggcagcctgatggtgataccggagaagaaacaagagtaatagggacatttggatacctggctcctgagtatgcacaaagtggccagattaccgagaaagctgacgtgtattccttcggagttgtactggtagagcttgttacgggacgaaaagcagtggatcttaacagacctaaaggccaacaatgcctcacagaatgggcacgaccattgttggaagaagatgccattgacgagttaatcgacccacggttagggaacgcttattcagaacaagaggtttattgcatgttacaagcggcttctctatgcattaaacgcgatccacagttacgcccgcgcatgtcacaggtgttacgcatactagaaggggacatgatgatggattcgagtaacgatgttgggaaccggagtggtaggatttacatggatcgtcaactgagtccaatgcgggagatgatggacgggttgagtagcaaagttgctgtggactcgatgcggcattggcaaagagaaaagacgagaagaacaacatgcgatgatcgaaggtaatgatgcaaaaacgtagaggtcccaagtacagcgtgtccaacctttttggttcatcgtgtatgcttttgtccttgtacaggacatgattggttggtgtttttgtaatcattatcattttgaatgaagaaacagctgcacaaagtgttgg

SEQ ID NO: 2107 - DNA, 1165 bp, Helianthus annuus
  misc_feature (423)..(423): n is a, c, g, or t
  misc_feature (558)..(558): n is a, c, g, or t
  misc_feature (1005)..(1005): n is a, c, g, or t
gcagctaacttcttggctgaaggaggatttgggttggtacatagagggatacttccggatggtcaggtagttgctgttaaacagcataaattagcgagttctcaaggggatcaagaattctgctcagaagttgaagtgttgagctgtgctcagcatcggaatgttgttatgctgattggattttgtattgaagacggaaagaggttgctggtttatgaatatatatgcaacggatcactggattctcatctttatggacgtcatcgagatccattagaatgggctgcacgacaaaaaatcgcggttggagctgctcgaggcttacgctatcttcacgaagaatgcagagttggttgcattgttcatcgtgacatgcggccaaacaacatcctaatcacccatgattttgaacctctggtaggngattttggcctagcgagatggcagcctgatggtgataccggagaagaaacaagagtaatagggacatttggatacctggctcctgagtatgcacaaagtggccagattaccgagaaagctgacgtgtattccttnggagttgtactggtagagcttgttacgggacgaaaagcagtggatcttaacagacctaaaggccaacaatgcctcacagaatgggcacgaccattgttggaagaagatgccattgacgagttaatcgacccacggttagggaacgcttattcagaacaagaggtttattgcatgttacaagcggcttctctatgcattaaacgcgatccacagttacgcccgcgcatgtcacaggtgttacgcatactagaaggggacatgatgatggattcgagtaacgatgttgggaaccggagtggtaggatttacatggatcgtcaactgagtccaatgagggagatgatggacgggttgagtagcaaagtttctgtggactcgatgcggcattggcaaagagaaaagacgagaagaacaacatgcgatgatcgaaggtaatgatgcaaaaancgtagaggtcccaagtacagcgtgtccaacctttttggttcatcgtgtatgcttttgtccttgtacaggacatgattggttggtgtttttgtaatcattatcattttgaatgaagaaacagctgcacaaagtgttggtgaatatattcttttctagatgt

SEQ ID NO: 2108 - DNA, 2330 bp, Solanum phureja
cttgaaagtttaaagaaaggtgtgaaaactattctggggtaatgagtaaggaggtgaagaaagggaagcaggagggtaaaagtagtggtgatgttgctgagaaagttatggtggctgttaaggcatcaaaagagatacctaaaaatgctcttgtgtgggctttgactcatgttgttcaacctggagattacattacacttcttgtggttgttccttcacaaagctctggtagaaagatgtggggtttccccatgtttgctggagattgtgccaatggtccccagaagtcacattccggaaatagtagtgagcaaaagtcagacttaacagattcctactctcagatgatccttcagctccaagatgtttacgatcccactaagataaacttgaagattaaagttgtttctggttcaccgcatggagctgtggctgctgaggcaaagaagagtcaagctaattgggttgttttggacaaacatctcaaacatgagaagaaatgttgtatgcaagagctgcattgcaatatcgtagtaatgaaacgatctcaaccaaaagttctccgcctgaatttagtcggttcacctaaaaaggaacctgatgtctcgggctcattatcttctgagaaagctcaatcatgtggaccagaactagaaaagaattattcattggcttcttctagaggtccattagtaacaccaacaagtagtccagagattttcagtgttactgaagctggtacttcatcagtttcaagttctgatccaggaacttcaccattttttgtcgctgaagtaaatcgggatttgcataaggcagagttgttggccttaaaggaagatcaagatgtagatgattcaagttcagagagtgagagtgaaaatctatcttgttcaagctcaagattccaaccgtgggtggtggacagtgtcagttcacattgtcaactctctcaacgccagcaaattagctcgatgagatcttttgacaggccacaaacatctacaaccaattcattactggagaagtttactaagcttgatacagaaggtggctccggatccccgagctatagagatgatatggattacaatcgaaatttgagagaatcaggtacattaaccagaagtgcacctcttggccctcctcccttgtgttcaatatgtcaacacaaggctcctgtatttgggaaacctcccaggtggttcacttatacagagctggagcttgcaacaggaggattttcacaagccaatttcttggctgagggaggatatggatccgttcacagaggagtccttccagatggtcaagttgttgctgtcaagcaacataagttggcaagttctcaaggggatcaagaattttgctcggaagttgaagtgctcagctgtgctcagcaccgaaatgttgtcatgttgataggattctgcattgaagacaggagaagattgctagtgtatgaatatatatgcaatggttctttagattctcatctatatggacgcaataaggaacctttggagtggtctgcacgtcaaaagatagctgttggagctgcacgaggtttgcgatatcttcatgaagagtgcagagtgggctgcattgtccatcgggacatgagaccaaacaacattctcatcactcatgactttgaaccactagtcggagactttggtttggctagatggcaaccggatggtgatacatgtgttgaaacgagagtacttggaacatttgggtacttggctcctgagtatactcaaagcggccaaattactgagaaagctgatgtttactcgtttggtgtggtgctcgtagagcttgtaactggtcgtaaagcagtggatcttaacaggcctaaaggccagcagtgtctcacagaatgggcacgtccattgttggaagaatgtgcaatcgatgagttaatagatgcccggataggaagcagctacaaggagcacgaggtgtattgcatggtgcatgctgcatctttgtgcataaggcaggatcctcagactaggcctcgaatgtctcaggtacttcgaattcttgaaggtgacctgatgatggattctggtaaaatgtctacaacacctaggtatgatgtgggaagccaaagtggaaggattttgtctaatcacctcatgcagtatgaaaggtacagtggttctatacgaaatgacgaattggaggggctaagtccaaagctctcgtttgataaaaggaacccttctattatttgggataggaatagtagtcacaggactgcattttcaaatcatctgtaaatcactttgtactgactcttgtgatcaaagatatatatt

SEQ ID NO: 2109 - DNA, 2432 bp, Solanum lycopersicum
ctttaaagtttaaagaaaggtgtgaaaactattctggggtaatgagtaaggaggtgaagaaagggaagcaggagggtaaaagtagttgtgatgttgctgagaaagttatggtggctgttaaggcatcaaatgagatacctaagaatgctcttgtgtgggctttgactcatgttgttcaacctggagattacattacacttcttgtggttgttccttcacaaaactctggtagaaagatctggggtttccccatgtttgctggagattgtgccaatggtccccggaagtcacatagtagtgagcaaaagtcagacttaacatattcctactctcagatgatccttcagctccaagatgtttatgatcccactaagataaacttgaagattaaaattgtttctggttcaccgcatggagctgtggctgctgaggcaaagaagagtcaagctaattgggttgttttggacaaacatctcaaacatgagaagaaatgttgtatgcaagagctgcattgcaatctcgtagtaatgagacgatctcaaccaaaagttctccgcctgaatttagtcggttcacctaaaaaggaacctgatgtctcgggctcattatcttcggagaaagctcaatcatgtggaccagaactagaaaagaattattcattggcttcttctagaggtccattagtaacaccaacaagtagtccagagattttcagtgttactgaagctggtacttcatcagtttcaagttctgatccaggaacttcaccattttttgtcactgaagtaaatcgggatttgcataaggcagagttgttagccttaaaggaagatcaagatgtagacgattcaagttcagagagtgagagtgaaaatctatcttgttcgagctcaagattccaaccgtgggtggtggacagtgtcagttcacattgtcaactctctcaacaccagcaaattagctcgatgagatctttagacaggccacaaacatctacaaccaattcattatcggagaagtttactaagcttgataaagaaggtgactccggatccctgagctatagagatgatatggattacaatcgaaatatgagaggatcaggtacattaaccagacatgcacctcttggacctcctcccctgtgttcaatatgtcaacacaaggctcctgtatttgggaaaccccccaggtggttcacttttacagagctggagcttgcaacaggaggattttcacaagccaatttcttggctgagggaggatatggatccgttcacagaggagtccttccagatggtcaagttgttgctgtcaagcaacataagttggcaagttctcaaggggatcaagaattttgctcggaagttgaagtgctcagctgtgctcagcaccgaaatgttgtcatgttgataggattctgcattgaagacaggagaagattgctagtgtatgaatatatatgcaatggttctttagattctcatctatatggacgcaatagggaacctttggagtggtctgcacgtcaaaagatagctgttggagctgcacgaggtttgcgatatcttcatgaagagtgcagagtgggctgcattgtccatcgggacatgagaccaaacaacattctcatcactcatgactttgaaccactagtcggagactttggtttggctagatggcaaccggatggtgatacatgcgttgaaacaagagtacttggaacatttgggtacttggctcctgagtatactcaaagcggccaaattactgagaaagctgatgtttactcgtttggtgtggtgctcgtagaacttgtaactggtcgtaaagcagttgatcttaacaggcctaaaggccagcagtgtctcacagaatgggcacttccattgttggaagaatgtgcaatcgttgagttaatagatgctcgtctaggaagcagctacaaggagcacgaggtgtattgcatggtgcatgctgcatctttgtgcataaggcaggatcctcagactaggcctcgaatgtctcaggtacttcgaattcttgaaggtgacctaatgatggattctggtaaaatgtctacaacacagcctaggtatgatgtgggaagccaaagtggaaggattttgtatgaaaggtacagtggttctatacgaaaggacgaactggaggggctaagtccaaagctctcatttgataaaaggagcccctctattattagggatagggatagtagtcacaggactgcattttcagatcatctgtaacttactttgtaccaattcttgtgatcaaagatatatattgctgctatatcagttgaaaccagggagttctgatcaaaagccatatatatttccattacttgtgcacaagtgagtcataatagtgtgtttttttgtgttggtgctcaatctacttgtgttgatctc

SEQ ID NO: 2110 - DNA, 1428 bp, Triphysaria pusilla
aagaaagataaattaatttccataaaacaagaacacgatcacgaacccgattccgaatcggacactgaaaacgaaagcctctcgtcgtcgagtatgaggttccagaatatcgattatggcggcagcctgagagaggcaatttcgttctcgagagcgggcccatgcgggcacccgccgttgtgctctatatgccaacacaagacgcctgtgtttggaaagccaccaaggtggttcacgtacgctgagctggagcatgcgacgggcgggttttcgaaggcgaatttcttggccgagggcgggtacgggtcggttcaccggggcgtgttgtcagacgggcagacaatcgcggtgaagcagcacaagctggcgagctcacaaggggatcaggagttttgctcggaggttgaggttttgagctgtgctcagcaccgtaatgtggttatgttgatcggattttgcatcgaggatgggaggagattgttggtgtacgagtatatatgtaatggatcacttgattctcatctttatggacgacatcaaaatacgctaagttggagtgctcgtcaaaaaattgcaattggagcagctcgtggattgaggtatcttcatgaagaatgcagggtcggttgcattgttcatcgggacatgcggccgaaccacattctaattactcatgattttgaaccattggtgggagactttggtctagctcgatggcaaccagatggggagacaggtgtcgacaccagagtaattggaacattcgggtacttggcacccgagtacgcacaaagtggtcaaattacagaaaaagccgacgtttactcctttggagtagtattagtcgagcttgtaaccggacgtaaagcagtggaccttaataggccaaagggccaacaatgccttacagaatgggcacgaccattattggaagcttatgacattgatgaattggtcgatccacggttaggaagcaacttttcggaaggcgaagtttacagtatgttgcatgctgcatcgttgtgcatacgccgtgatcctcaagtgaggcctcgtatgtctcaggtgcttcgagtacttgaaggtgatggtatggattcgggccaattgacacctgggttcgatgtgggcagccggagtggaagaataatgtcgggccacacgataaacgagttgtctggacgatttagctcaaagctttgtcctaattgaagatcgggtttcagggatggagatgaaacaagacgatgttctatgaacaaaggctttacttttgtgatgcttttgctacgtttttctaaatatgaaacagtcatttttttgtgttgtgagtttttggggttgtataggagttgggtggtataaatctttttgtaatcactaccgagaaatgaatttgatgattagcttaagaaaaaaaaaaaaaaa

SEQ ID NO: 2111 - DNA, 1215 bp, Phaseolus coccineus
  misc_feature (1119)..(1119): n is a, c, g, or t
caaggtgatcttgaattttgttcagaggtggaagtcctgagctgtgctcaacaccggaatgttgttatgctcattggcttctgtatagaggataagagaaggctactggtttatgagtacatatgcaatggatcattggattcgcatttatatgggcgacaaaaggatccattagagtggtcagcacggcaaaaaattgctgtgggagcagcccgtggattacgatatctacatgaagaatgcagagtgggttgtattatccaccgtgacatgaggccaaacaacattctcataactcacgattttgaacctctggttggtgattttggactggcaaggtggcagcctgatggagacacaggtgtggaaactagagtgattggaacatttgggtatttggctcctgaatatgctcaaagtggtcaaatcactgaaaaagctgatgtttattcctttggggtggtattagttgagcttgttacagggagaaaagctgtggatctcactaggccaaagggacagcagtgccttacggagtgggcacgacctctcttagaagaatatgcaactgaagaactgattgatccaagacttgataaccactattctgaaaatgaagtctattgcatgctgcatgctgcctccattatgcatacagcgagatcctcaatgtagaccacgcatgtcacaggtcctccgaatactagagggtgacatggtgatggacacaaattacatctcaactccaggctatgatgcaggaaacagaagtggtagattgtggtcagagccattacaaaggcagcaccattatagtggtcccctgttagaagagtctgtagagtccttcagtgggaagctatcccttgacaagtacaggccttcctattggggtgatagggacaaggctaggagggcctcatgtgaagatgacatttgaattgattgatcataaagtttgggttcttgttatgttaaatacaaagtatgcttgttccacacctattttgtctgtttttttaatcctttttttgtgtgcaatggatttaatattgcatttgtatagcagagtgaaagtagaataggtaaatatagaagcttttgaagaattttcagganatcctgttagtgtctcaatgaccttgatagaatcagtgctgctgtgctgtctactatcttcactcttgaaatctctctctttgatctatcatctat

SEQ ID NO: 2112 - DNA, 1412 bp, Triticum aestivum
  misc_feature (1352)..(1352): n is a, c, g, or t
  misc_feature (1359)..(1359): n is a, c, g, or t
  misc_feature (1361)..(1361): n is a, c, g, or t
  misc_feature (1365)..(1365): n is a, c, g, or t
  misc_feature (1373)..(1373): n is a, c, g, or t
ccacgcgtccgccggactactgtcgttgttaccaaccagccggcaatctccatccacaagctctaaagaaagaaacgggcaatcagaaagccttctcttccaagaagtgacgcgggagaggggcagagcggcgcaagccatggccatggcggagcagcagcagcagatcgagcacagccacctcgccatcagaggcctcaacctccacgtagcccaagcaggcacaggcgagctcgggacggtgctgttcctgcacggcttcccggagatatggtactcgtggcgccaccagatgctggccgtggccgccgccgggtaccgcgccatcgcgccggactggcgggggtatggcctctccgaccagccaccggagccagaggcggcggtgtaccgcgacctggaagaggatctccttgccgtcctggatgcactatccgttcccaaggcttaccttgtggcaaaggatttcggagccatgccagcttatgattttgctcttcgtcaccccaaccgcacatgcggtgttatgtgtttgggtatcccttttcttcacggtggctcctccttcactgccatgcccgaaggcttctatatactgcgttggcgggaaccaggaagagcagaggcagactttggcaggtatgacgtcaagcgagtcgtgcgcaccatctacattctcttctctagaagcgaaatcccgacagcgaaggaagatcaagaaatcatggatctcgcggacctgtcgactccccttccagagtggttcaccgaggaggatcttgcagtctacacgtccctctatgagaaatcaggtttcgtgtatccactgcagatgccatacaggtctctccataagaggcatccaatcgaagacccaaaatttgaagtcccggtgttcgtcgtcatgggggagaaagactacgtgatcaagttccccggggtcgaggccgtcttgaaaaatggcaccatggagaagtttgcgccagatctgaagatcacttacatccctgaaggaagccatttcgttcaggagcaatttccggacaaggtcaatgagctcctccttggcttcctcaaggaccatcctgtggcttgacacacggggtctagtctactatgcttggcctgccctcggtctcataagaaccctactccgtgcacattccgcagtgttatgaacatatgatgcgtgcttccattgaagtgaaggatatgctagtttcatcaacaatctttaataaatacgtatgtatgttgggtccgtgttgtatctaatcctttagaacgccatagtgttcagtcctcctgggaaccgtgtatttcgccaaaaacctatctgaatttcacttggnatccaangnatcnaatcgaanatcgtctctagcctcgtatgcccaagaggtgaaaaaaaa

SEQ ID NO: 2113 - DNA, 1159 bp, Pseudoroegneria spicata
  misc_feature (236)..(236): n is a, c, g, or t
  misc_feature (475)..(475): n is a, c, g, or t
gaaagaagcgggtaatcaaaaagccttccaagaagtgacggaggtgcagagggcggcggaagccatggccatggtggagcagcagcagcagatcgagcacagccacctcgccatcagaggcctcaacctccacgtagcccaagtaggcacaggcgagctcgggacggtgctgttccttcacggcttcccggagatatggtactcgtggcgccaccagatgctggccgtggccgccnccgggtaccgcgccgtcacgccggactggcgggggtatgggctctccgaccagccaccggagccggaggcggcggcgtacagcgacctgatagaggatctcctcgccgtcctggatgcgctctccgtccccaaggcttaccttgtggcaaaggattttggaaccatgctagcttatgattttgctcttcgtcaccccaaccgcacatgcggtgtcatttgtttgggcatcccttttctncacggtggctcctccttcaccgccatgccagaaggcttctatatactgcgttggcgggaaccaggaagagcagaggcagactttggcaggtatgacatcaagcgagtcgtgcgcaccatctacattctcttctctagaagcgaaatcccgatagcgaaggaagatcaagaaatcatggatctcgcggacctgtcgactccccttccagagtggttcaccgaggaggatcttgcagtctacacgtccctctatgagaaatctggttttgtgtatccactgcagatgccatacaggtctctccataaggggcaaccaattgaagacccaaaattcgaagtcccagtgttcgtcgtcatgggggagaaagactacgtgatcaagttccccggggttgaggccgtgttgaaaaatggcaccatggagaagtttgcgccggatctgaagatcacttacatccctgaaggaagccatttcattcaggagcagttcccggacaaggtgaatgagctcctcgttggcttcctgaaggaccatcctgtggcttgacatatgctctatgcttcacctgcactcagtctcataagcaccgtacacattctgcagtgttgtgaacatatgatgcgtgcttccagtgaagtacagtatgtgctagttttatcagcaataaatgtgtggatgttgtca

SEQ ID NO: 2114 - DNA, 1175 bp, Leymus cinereus x Leymus triticoides
  misc_feature (778)..(778): n is a, c, g, or t
  misc_feature (796)..(796): n is a, c, g, or t
  misc_feature (808)..(808): n is a, c, g, or t
  misc_feature (815)..(815): n is a, c, g, or t
  misc_feature (829)..(829): n is a, c, g, or t
  misc_feature (835)..(835): n is a, c, g, or t
  misc_feature (928)..(928): n is a, c, g, or t
  misc_feature (968)..(968): n is a, c, g, or t
  misc_feature (1001)..(1001): n is a, c, g, or t
  misc_feature (1024)..(1024): n is a, c, g, or t
  misc_feature (1026)..(1028): n is a, c, g, or t
  misc_feature (1093)..(1093): n is a, c, g, or t
  misc_feature (1124)..(1124): n is a, c, g, or t
  misc_feature (1144)..(1144): n is a, c, g, or t
  misc_feature (1151)..(1151): n is a, c, g, or t
  misc_feature (1153)..(1155): n is a, c, g, or t
ccgttgctgtcggagggcgcaagccatggccatggtggagcagcagcagcagatcgagcacagctacctcgccatcagaggcctcaacctccacggagcccaagtaggcacaggcgagctcgggacggtgctgttcctgcacggcttcccggagatatggtactcgtggcgccaccagatgctggctgtggccgccgccgggtaccgcgccgtcgcgccggactggcgggggtatgggctctccgaccagccaccggagccggaggcggcggcgtacagcgacctggaagaggatctcctcgccgtcctggatgcgctctccgtccccaaggcttaccttgtggcaaaggatttcggagccatgccagcttatgaatttgctcttcgtcaccccaaccgcacatgcggtgttatgtgtttgggtatcccttttcttcacggtggctcctccttcaccggcatgccagaaggcttctatatactgcgttggcgggaaccaagaagagcagaggcagactttggcaggtatgacgtcaagcgagtcgtgcgcaccatctacattctcttctctagaagcgacattccgatagcaaaggaagatgaagaaatcatggatctcgcggacctgtcgactccccttccagagtggttcaccgaggaggatcttgcagtctacacgtccctctatgagaaatcaggtttcgtgtatccactgcagatgccatacaggtctctccataagaggcaaccaattgaagatccaaaattcgaagtcccngtgttcgtcgtcatgggngagaaagactangtgttcnagttccccggggtngaggcngtcttgaaaaatggcaccatggagaagtttgcgccggatctgaagatcacttacatccctgaaggaggccatttcgttcaggagcagttcccngataaggtcaatgagctcctcgttggcttcctgaaggacnatcctgtggcttgacatatgctctatgcttcanctgcactcggtctcataagtagngnnnaccgtgcacattctgcaatgttatgaaaatatgatgcgtgtttccagtgaaggacgtgtgatggntagtcaactagtatgttgtatcttgtttttnctgctagtttatcagcaatnaatatantnnnatgttgtcctgtggtccttc

SEQ ID NO: 2115 - DNA, 1284 bp, Avena sativa
ggctcgtcactatcccaatcttgatagaccttgttgcagagctcggttgtgtccttgcacagcatctccgggactgttgtcccaatcttctaagaagtcgcgggagagagcgcgaagccatggctacggtggagcagccgcaaatcaagcagagccacctcgccatcagaggcctcaacctccacgtagcccaagcaggcacaggtgagctcgggacggtgctgttcctgcacggcttcccggagatatggtactcgtggcgtcaccagatgctggctgtggccgccgccgggtaccgcgccgtcgcgccggactggagagggtacgggctatccgaccagccgccggaggctgaggaggcgtcgtacgctgacctgcaagaggatctcctggccctcctcgatgcgctctccgtccccaaggttttccttgtggcaaaggattttggaaccatgccagcctatgactttgctctttgtaaccccaaccgcacatgtggtgttatgtgtttgggtatcccttttcttcacggtggctcctccttcaccaccttgccagaaggcttctacattctgcgctggcgggaaaaaggaagggcagaggcggattttggcaggtatgacgtaaagcgagttgtgcgaaccatctacattctcttctctagaagcgagatcccaatagcgaacgaagatcaagagatcatggacctcgcggacctgtcgactcctcttccagagtggttcaccgaggaggatcttgccgtctacacgtccctgtatgagaagtccggtttccggtacccaatggagatgccatacaggtctctccataagaggcagccacttgaagatccaaagttccaagtcccggtgtttgtggtcatgggggagaaagattacgtgttcaagttccctgggatcgaggccgtcttgaaagatggtaccatggcgaagtttgcaccagacctcaaggtcacatacatccctgaaggaagccatttcgttcaggagcagttccccgaaatggtcaatgagctcctccttagcttcctcaaggaccatcctgtggcttgacagatgttctctgcttcacctgagactgcatctcacaagcatacacattccgcaatgttgtaaacttattatatgtggcttcagtgaaggatatgttatgcctgatattgctttgagtatgctaagtcaaatatgtctgaactagtatatatgttatggctgtatcttgtttgtactgctagatttatcagcaataaaaacgccacattat

SEQ ID NO: 2116 - DNA, 1387 bp, Oryza sativa
acctcacactcccaccaccgtcacgtcgcccctctgctctctgcactgctgcggcgaggagctagctcgagccggccggaagccatggccacggcggagcagcggcagatcgagcacgtccacctccccgtgcgggggctcaccctccacgtcgcgcaagccggcaaaggggagctcgggacggtggtgttcctgcacgggttcccggagatatggtactcgtggcgccaccagatgctcgccgtcgccgccgcagggtaccgcgccgtcgcgccggactggcgtgggtacgggctctccgaccagccgccggagccggaggcggcggtgtacgacgacctcatcgaggatctcctcgccatcctcgacgccctcgccgtgcccaaggcattccttgttggaaaggattttggggcaatgccagcttacgactttgctctccgtcacccaaaccgcacatgtggtgtgatgtgtctgggcatccccttaggcactgctggtttgtcctttgacacattgccagaaggattctacattttacgttgggcgcaaccaggaagagcagaagctgactttggcaagtatgatgtaaagagagttgtgcgcaccatctacatactattctctaggagcgagatccccatagctaaggaaaatcaagagatcatggatcttgcagacttatcgacaccccttcccgagtggtttagtgaggaggatcttgatgtctactcatccctctatgagaattctggttttagatatccgctacagatgccatataggtctctgcaccagagaaaaccaattggagatgcaaaattccaagtcccagtgtttattgtcatgggagaaaaagattatgtctttaagttccctggtatcgagtctgctatgaaagacggaactatggagaagcatgcaccaaacataaagatcacctacatccctgaaggagggcattttgtgcaggagcagttccgtgactatgtgaatgagctccttcttggcttcttgaaagatcatcctgtggttatataaatgctattgtagcctcagttgtgcttcacccgtagttcaagttggcttagaaaacgttgtgctatatcatggtatgaatttgtcaacaaactaaggatcagctatggctagtttgttactttcagtaatgcctatttgagcttgttgtatctaggttgtcctgctggtgttactagcaatgtaaagactaaacccattgctatacttctaccatgacttttgcaagccaatgatgtgaacttataccatgattttagaaagtcttactgtaaaagacggagtacgtagttactatgtatacggatgattaatcataattatataaaaaattaaaaaattaacaatc

SEQ ID NO: 2117 - DNA, 871 bp, Pseudoroegneria spicata
  misc_feature (826)..(827): n is a, c, g, or t
gcatacgacttcggaattacaggttcttttatatgtttgtcttctcaacgactcttctctgcctctatgtctttggattctcctgggtgtacattattaagatcagagatgcagagcagataacaatatggaaggcaatggcaaagacccctgcgtctatcgctctggttgtctacacatttatcgcagtttggtttgttggtggcctctcagtgtttcacttgtatctgatgagcactaaccagacaacctatgagaacttcaggtatcgctatgaccaacgggccaacccatacaacaggggggtcgtggagaacatcaaggagatcttcttcacgccgatccctgcttccaggaacaacttcggcgccagagttccacaggagcagggcctgaggcctcgctcaacaaacggtttcatgagcccaaacatggggagagctgtgggtgacatcgagatgggcagaaagccagtggcatgggatgagccaaggatggcagctgagataggcgatctgggaggtctgggcaacttgctggaggacaaggatggcaggttccgcaacgcgtcccctgatctaagccgcgacgccctcgtggtcggaggcttagatgagcaaggctcctcggtgatgaacccaccacggacgagctggggagtcgaagcgggcagatgatggtaaggtaattggtcaatttggccatgtaagcagctatagtggaggactaagggatgtatgttagtgccagcttgttcgtagtttggtgtcgtggttgagactcggggtcgctgatgttgttattaggcctatgacctggttgttgnnttgctttgcatttcatgtatcattggtttttaagcagaaaaaaa

SEQ ID NO: 2118 - DNA, 913 bp, Hordeum vulgare
gttgtatacacatttatcgcggtttggtttgttggtggcctctcagtgtttcacttgtatctcatgagcactaaccagacaacctatgagaacttcaggtatcgctatgaccaacgggccaacccatacaacaggggtgttgtggagaacatcaaggagatcttcttcacgccaatccctgcttccaggaatgacttcagtgccagggttccacaggagcagggcctgaggcctcgctcgacgaacggtttcatgagcccaaacatggggagagctgtgggcgacatcgagatgggcagaaagcccgtggcatgggacgagccaaggatggcagccgagataggcgacctgggaggtctgggcaacttgctggaggacaaggatggcaggttccgcaacacatcccctgatctaagccgcgacgccctcgtggtcggaggcttggacgagcaaggctcctcggtgatgaacccacctcggacgagctggggagtcgaagcgggcagatgatggtaaggtaattggtcaattcggccatgtaagcagctatagtggaggactaaggggtgtatgttagtgccagcttattcctagtttggtgtcgggttgaaactcgcggtcgctgatgttgttattaggcctatgacctggttgttgttttgctttgcatttcatgtatcagtggatttaaagcagattgttggcgtgtgaggtctccagttgagtagaatcctgattgggtctgtatatatggtttggagtggtgaacctggaaatggattggtttgctttggcttccgttgtcaaagatttgtgaacggcgttgtacctttcaatttgagctgtgccactccagagcttgaatgtctccctatcttttttaatggccagatgttgattttgctgttgctgc

SEQ ID NO: 2119 - DNA, 920 bp, Hordeum vulgare
cgctctggttgtatacacatttatcgcggtttggtttgttggtggcctctcagtgtttcacttgtatctcatgagcactaaccagacaacctatgagaacttcaggtatcgctatgaccaacgggccaacccatacaacaggggtgttgtggagaacatcaaggagatcttcttcacgccaatccctgcttccaggaatgacttcggtgccagggttccacaggagcagggcctgaggcctcgctcgacgaacggtttcatgagcccaaacatggggagagctgtgggcgacatcgagatgggcagaaagcccgtggcatgggacgagccaaggatggcagccgagataggcgacctgggaggtctgggcaacttgctggaggacaaggatggcaggttccgcaacacatcccctgatctaagccgcgacgccctcgtggtcggaggcttggacgagcaaggctcctcggtgatgaacccacctcggacgagctggggagtcgaagcgggcagatgatggtaaggtaattggtcaattcggccatgtaagcagctatagtggaggactaaggggtgtatgttagtgccagcttattcctagtttggtgtcgggttgaaactcgcggtcgctgatgttgttattaggcctatgacctggttgttgttttgctttgcatttcatgtatcagtggatttaaagcagattgttggcgtgtgaggtctccagttgagtagaatcctgattgggtctgtatatatggtttggagtggtgaacctggaaatggattggtttgctttggcttccgttgtcaaagatttgtgaacggcgttgtacctttcaatttgagctgtgccactccagagcttgaatgtctccctatcttttttaatggccagatgttgattttgctgttgctgc

SEQ ID NO: 2120 - DNA, 917 bp, Brachypodium distachyon
tatctctacatgttcattgcagtttggttcgttggtggcctctcagtatttcacttgtatctcatgagcgctaaccagacaacatatgagaacttcaggtatcgctatgaccaacgggccaacccatacaacagaggagttgtggagaacatcaaggagatcttcttcacgccaatccctgcttccaggaataacttcagtgccagagttccacaggagcagggcctgaggcctcgctcgacgaacggtttcatgagcccaaacatggggagagctgttggcgacatcgagatgggcagaaagcccgtggcatgggatgagccaaggatggcagcagagataggcgacctgggaggtctgggcaacttgctggaggacaaggatggcaggttccgcaacacatcaccagatctaagccgtgacgccctcgtggtcggaggcttggatgagcaaggctcctcggtgatgaacccaccacggacgagctggggagtcgaagcgggcagatgatggtaaggtaattggtcaatttggccatctaagcagctatagtggaggaggactaaggggtgtatgttagtgccagcttattcctagtttggtgtcgtggttgaaactcgcggtcactgatgttgttattaggcctatgacctggttgttgaattgctttgcatttcatgtatcagtggatttaaagcagattgttggtgtgtgaggtctccagttcagtagaatcttaattgtgtctgtatatatggtttggagtggtgaacctggaaatggattggtttgctttggcttccgttgtcaaagatttgtgaacggcattgtacctttcaatttaagctgtgccactccaaagcttgaatgtctccctatcttttttaatggccagatgttgattttgctgttgctgc

SEQ ID NO: 2121 - DNA, 1215 bp, Pennisetum glaucum
gggaattgatggataatttctcttatggtatgggattgtctgtgatgattgcagcagttctattcacagcatatgatctgagtcttctgcttctaacttctggaagagatccgggtatcatacctcggaatgcacatcctccagaaccagaaggttttgatggcaatgcagaggttggggctaaccagactccacctttgcgtttgccccgagtgaaggatgttgttgtcaatggaatcactgtgaagacaaagtactgtgacacttgcatgttatacaggcctcctcgttgctcccattgctcaatctgcaacaattgtgtggaacgttttgaccatcactgcccatgggttggacaatgcataggactgaggaattacaggttcttctacatgtttgtgttctcaacgactctgctctgcctttatgtattcgggttctgctgggtgtacattattaagatcagaaatgcagagcagataacaatttggaaggcaatggcaaagaccccagcatctattgctctaatcatctatacattcattgctgtatggtttgttggtggcctctctgtgttccatttgtatctcatgagcacaaatcagacaacatatgagaacttcagatatcgctatgatcagcgagccaacccatacaacaggggagttgtagaaaacatcaaggagatcttctttacacccatccctccttccaagaacaacttccgtggcagggtcccacaggagcatggtctacggcctcgtgcaacaaatggtttcatgagtccaaacatggggagagctgttggcgacattgagatgggtagaaaaccagtggcttgggatgagccaaggatggcagctgagattggtgatttaggagcaggtctaagcaacttgttggaggacaaggatggcaggtttcgtagtgcatctccagatctcagccgtgatgcccttgctgttggaggaggcttagaagagcaaggctcctcagcgatgaaccctgggcggacaagctggggagtcgaagcaggtcgatgatggcagtgaccatgtaagcagctagtgagagtctcagggttgttagtgccagttcacagctaatttcttgtttggtttgagatttgaggtcactaatgtctatgacgtgtatggcggttgtttttgccttttggatttaagtttctcctttctcttagtttgagatgtcttt

SEQ ID NO: 2122 - DNA, 1467 bp, Saccharum officinarum
cagctcccggcctgattcccgggtcgccccacgcgtccgttctgcttctaacttctgggagagatccggggatcatacctcgcaatgcacatcctccagaacgcggaaggttttgatggcaatgcagaggttggggctaaccagactccacccgtgcgtttgccccgagtgaaggatgttgttgtcaacgggatcactgtgaagacaaaatactgtgacacttgcatgctgtacaggcctcctcgttgctctcattgctctatctgcaacaactgtgtggagcgttttgatcatcactgcccatgggttggacaatgcataggacttaggaattacaggttcttctatatgtttgtattctcaacaactctgctctgcctgtatgtctttgggttctgctgggtgctcattgttaagatcagaaatgcagagcagataacaatttggaaggcaatggcaaagacccctgcatctattgctttaatcatctacacattcattgcggtttggtttgttggtggcctctctgtgttccatttgtatctcatgagcacaaatcagacaacatatgagaacttcaggtatcgctatgatcaacgagccaacccatacaacaggggagtcatagaaaacatcaaagagatcttctttacaacgatccctccttccaagaacaacttctgtggtagggtccaacaggagcatggtctgaggcctcgtccaacaaatggtttcatgagtccaaacatggggagagctgttggcgacattgagatgggtagaaaaccagtggcttgggatgagcctaggatggcagctgagattggtgatttaggagcaggtctgagcaacttgttggaggacaaggatggcaggtttcgtagcgcatctccagatctcagccgtgatgcccttgcagttggaggaggcttggaagagcaaggctcctcagcgatgaaccctgggcgttcaagctggggagttgaagcaggtcgatgatggcattgaccatgtaagcggctatagtgagatgctcagggttattagtgccagttcgttgctaatttgttgttctgtttgagatttgaggtcactaatgttattagactcatgacctgtatggcggttgtttctggactttcttttcttctttctcttaatttgagatgtcttgcatgtctattgtctgaagcagttggtttgtgacgtctccagtttggcactgtcagtttttgtctgtatataatcggagcagtaagcctaaaataggtttcagttgcttgaatttggatggtaatggttgtgaacaatgtcgaacctttgcattgcagtaaatgaacattcgtcgatcttggtgccccatgtttagatttaaaaaacacaacaaaaactctttctgtttctcctggccctctcgtgttcgtctttctccgtgcgtctccgcgtgtccctcccgtcccgttcccg

SEQ ID NO: 2123 - DNA, 1840 bp, Sorghum bicolor
gtccccagcagagggcctccatttggtctcatctcatctcgcttctctccctcccgcgacatcagcggcggcgcagcggtggggttgggggggtggggggacggcattgcgagctcacgccacctgcggcgcggcgatctcgggaggttgctgtgccgccccggctatgtagtgatctgggccgtgatctcgacggctattcgcggctgagcgggcggcggcgatgaacggagcgagcgccagcgctggcgtcggcaccggcgccggcgctgctggggaggcgccgctggtgtacaaggcctggaagggtaacaatgtgtttttactgaaggggaggttcatatttggtcctgatgcaagatccttgtttgtcaccatgttccttattatcgcgccagcatcaatcttctgtgcattcgttgcgaagggattgatggataggttctcttatgccctgggattgccggttatgattgcagcagttctattcacagcatatgatctgagtcttctgcttctaacttctgggagagatccggggatcatacctcgcaatgcacatcctccagaacctgaaggttttgatggcaatgcagaggttggggctaaccagactccacctgtgcgtttgccccgagtgaaggatgttgttgtcaatgggatcactgtgaagacaaaatactgtgacacttgcatgttgtacaggcctcctcgctgctctcattgctctatctgcaacaactgtgtggagcgttttgaccatcactgtccatgggttggacaatgcataggacttaggaattacaggttcttctatatgtttgtattctcaacaactctgctctgcctgtatgtctttgggttctgctgggtgctcattgttaagatcagaaatgcagagcagattacaatttggaaggcaatggcaaagacccctgcatctattgctttagtcatctacacattcattgcggtttggtttgttggtggcctctctgtgttccatttgtatctcatgagcacaaatcagacaacatatgagaacttcaggtatcgctatgatcaacgagccaacccatacaacaagggaatcatagaaaacatcaaagagatcttctttacaacaatccctccttccaagaacaacttctgtggtagggtccacaggagcatggtctgaggcctcgtccacaaatggtttcatgagtccaaacatggggagagctgttggcgacattgagatgggtagaaaaccagtggcatgggatgagcctaggatggcagctgagattggtgatttaggagcaggtctgagcaacttgttggaggacaaggatggcaggtttcgtagcgcatctccagatctcagccgtgacgcccttgcagttggaggaggcttagaagagcaaggctcctcggcgatgaaccctgggcgttcaagctggggagttgaagcaggtcgatgatggcattgaccatgtaagcgactgtagtgagatgctcagggtggttagtgccagttcgtcgctaatttgttgttttgtttgggatttgtggtcactaatgttattagactcatgacctgtatggcggttgtttctggactttcttttcttctttctcttaatttgcgatgtctttcatgtctattttttgaagcagttggtttgtgatgtctccagtttggcactgtcaggtttcgtctgtatataatcggagcagtaagcctaaaataggtttcagttgcttggatttggatggtattcgttgtgaacaatgttgaatctttgcattgcagtaaatgaacatcgcatgatctgagtgcccatgttaagattta

SEQ ID NO: 2124 - DNA, 503 bp, Festuca arundinacea
ggcacgaggcctcgtgcccttgtatctcatgagtactaatcagacaacatatgagaacttcaggtatcgctatgaccaacggaccaacccatacaacaggggagtcgtggagaacatcaaggagatcttcttcacaccaatccctgtttccaggaacaacttcggtgccagagttccgcaggagcagggcctgaggcctcgctcgatgaacggcttcatgagtccaaacatggggagagctgtcggcgacattgagatgggcagaaagccagtagcatgggatgagccaaggatggcagctgagataggcgatctgggaggcctgggcaacttgctggaggacaaggatggcaggttctgcaacgcgtcccccgatctaagccgtgatgccctcgcagttggaggcttagacgagcagggctcctctgccatgaaccccccgcggacgagctggggagtcgaagcaggcaaatgatggtaattggctgattggccgtgtacgc

SEQ ID NO: 2125 - DNA, 666 bp, Zea mays
aggaattacaggttcttctatatgtttgtattctcaacaactttcctctgcttgtatgtctttgggttctgctgggttcattattaagatcagaaatgccgagcagataacaatttggaaggcaatgacaaagacccctgcatctattgccttaatcatctacacattcattgcagtttggtttgttggtggcctctctgtgttccatctgtatctcatgagcacaaatcagacaacatatgagaacttcaggtatcgctatgatcagcgagacaacccatacaaaagggagtcatggaaaacatcaaagagatcttctttacaacgatccctccttccaagaacaacttctgtggtagggtcgatcaggagcatggtctgagaccccgtccaacgaatggtttcatgagtccaaacatggggagagctgttggcgacattgagatgggtagaaaaccagtggcttgggatgagcctaggatggcggctgaaattggtgatttaggagcaggtctgagcaacctgttggaggacaaggatggcaggtttcgtaccacatctccagatctcagctgcgacacccttgcggttggaggaggcttagaagagcacggatcctcggcaatgaaccctgggcgctcaagctggggagttgaagctggtcga

SEQ ID NO: 2126 - DNA, 899 bp, Setaria italica
ggcaaagacccctgcatctattgctctaatcatctatacattcattgctgtttggtttgttggtggcctctctgtgttccacttgtatctcatgagcacaaatcagacaacatatgagaacttcagatatcgctatgatcaacgagccaacccatacaacaggggagttgtagaaaacatcaaggagatcttctttacacccatccctccttccaagaacaacttccgtggcagggtcctacaggagcatggtctacggcctcgtgcgacaaatggtttcatgagtccaaacatggggagagctgtcggcgacattgagatgggtagaaaaccagtggcttgggatgagccaaggatggcagctgagattggtgatttaggagcaggtctgagcaacttgttggaggacaaggatgggaggtttcgtagtgcatctccagatctcagccgtgacgccctcgctgttggaggaggcttagaagagcaaggctcctcggcaatgaaccctgggcggacaagctggggagtcgaagcaggtcgatgatggcagtgaccatgtaagcggctgtagtgagagactcagggttgttagtgccagttcactgctaatttcttgtttggtttgagatttgaggccactaatgttatagacccatgacttgtacggcggttgtttccggatttaagtttctcctttctcttagtttgagacgtctttcctgtatgttgtttgaagcagttggtttgtgacgtctccagtttggcaccgtctgctttcgtctgtatatattggtgcggtggacctgaaacagtttgagttgcttggctttggatgttaatggttgtgaacagtatttgaccttcgcagttaatgaacatcgctctatctgagcaaccca

SEQ ID NO: 2127 - DNA, 3152 bp, Brachypodium distachyon
atggaggcggcaacgcggcggcgagctctgctgctccttgtgctggtggcgagcagcgtgccggcggggctctgcgccaccaacgcgcaagatgtttcggcgctccggtcgctgatgggccagtggagcaacgtcccgtcgagctggtcggcgacggccggcgacccctgcggcgccgcctgggacgggctcatgtgcgacgccaacggcagggtcacctcgctgaggctgtcgagcgtcaaccttcagggcaccctcagcaacagcatcggccagcttagccagctcatgttcctggatctttccttcaacattggtcttgaaggcacgatgcccgcttcggtcgggaaccttgcgcagcttacgacactgattttggcaggttgcagcttcaccggaagcattcctcaagaactaggcaacctgcagaagatgacgttcttggcactgaattcgaacaaattttcgggcggaataccggcttcacttggccttctctcaaaactattttggctagacctggctgacaatcagctcacaggacctgtcccaatatcaacagcaacgacaccaggacttaacctgcttaccggaacaaagcacttccatttcaacaagaatcagttatctggaacgcttacaggcctgtttaactctaatatgactctcatacacatattgttcgacagcaatcaattctcaggctcgattccagctgagattggaagcattagctcgctccaagtactgcgattggataggaacaagttggtgggagcagttcctaacatcaccaacttggtcaaactaaatgagctgaacttggcaaccaacaggttaactggactactgccagatctcagcaccatgagcgtattaaatgttgtggatttaagcaagaatgcatttgatgctcaagtagccccgaattggttcacaactctaacaagtcttacttcagtatcaatatcttctgggaaactctctggcgtggtccccaaggccctcttcacattgccccagttgcaggaagttgtacttgacaacaaccagttcaacggcacgcttgagatatcaggcagcatcagcaaacaactgcaaactgttgatctgcgatttaacagcatatttgataccgccactacaagctacaaaaaggcactggtgcttctaggtaatccggtgtgcgccgatgcagctttttccggtcaaccattctgcagcatccagcaagagaacacgatagcgtacacaactagcacgtccaaatgttccttgacaagtacgtgccgcagtgatcagagtatgaatcccgcaaactgcggctgcgcctactcgtacaatggcaagatggtcttcagagctccgttcttcaaggacttgacgaatagtgatacattccagcaattagagacgagcctctggacgcaactgaagctgcgggacggtgcggtttccttgtcgaaaatccacttcaacagcgacaactacctccaagttcaagtgaatttgttcccgtcatccggggcgctcttcaacgtatccgaactcatcagcatcggctttgatctcagcaaccagacctacaagccaccggcaaattttgggccttattacttcattgcagatccatatgtccccttggcagttgctgttgatggtggcaaaaaatcaaagttcagtactggtgctatagctggaattgcagcagccggtgggcttcttgtgattgccctcatttttgtgggattgttcgctttgcgacagaagagaagagccaaggaactggcagaaagaacagacccttttgcttcatggggcgctgcccagaaagacagtggcggagctccacagctgaaaggagcgaggtttttctcattcgaggagctgaaaagctgcaccgacaatttctcggatagccaggagataggggcaggaggctacggaaaggtgtacaaggggacgctggtggatggaatgcgggtggcgataaagcgggcgcagtccggttcgatgcaaggcgcgccggagttcaagaacgagatcgagctgctgtcccgggtccaccaccggaacctggtgagcctgatcgggttctgctacgagcaaaaggagcagatgctggtgtacgagttcgtctccaacggcaccctcagagagaacctcgtggtgagaggatcatacctggactggaagaagaggctgaggatcgcgctcgggtcggctcgagggctggcgtacctccacgagctcgccgacccgcccatcatccaccgcgatgtcaagtccaccaacatcctcctcgacgacaacctcaaggccaaggtcgccgatttcggcctctccaagctcgtcgccgacaccgagaagggccacgtctccacccaagtcaaaggaacactgggttacttggacccggagtactacatgacgcagcagctgtcggagaagagcgacgtgtacagcttcggcgtggtgatgctggagctggtgagcgggaggcagccgatcgagaaggggaagtacatcgtgcgggaggtgaggcaggccatcgacccggcggaccgggaccactacgggctgcgggctatcgtcgacccggcgatcagggatgccgcgcgcaccgccgggttcaggcggttcgtgcagctggcgatgcagtgcgtggacgagtcggcggcggcgaggcccgccatgggcaccgtcgtcaaggaggtggaggcgatgctgctcaacgagccagcaggggacggcggggtcagctcggcggggtcgtcggccacggagttcgagggcgctggcaggggcgcgcccgcgcacccctacagcgacgtggagatcaccaggggctcctacggcggcggcggcgacaccgcgtcggattacatgccctacttcgaggtcaagcccaaatagaatttgtacattttttgttctctgctcgttttcaggttgtgatggaattgtacattgattttgggcgtacatgtgttgcagagtgttgtggtgcgtcatatattagtagattctttgttcatatgtaagttcgtatcatggtcatggctagcatatgtgttaacactttgctctgatcatccaaatgagtccattattcattgcagccagaggaatacaaatgtttaattcagtca

SEQ ID NO: 2128 - DNA, 1427 bp, Avena sativa
agttgatggtggcaaaaactcaaagttcagtacaggtgctatagctggaatcgcagcaggcggtggggttccggtgattgccctcattttggtggcattattcgctttgcgacaaaagagaaagaaccaggaactaaaagtacaggccaacccttttgcttcatggggcactatgcagaaagacagcggaggagctccacagctgaagggagcgaggttcttctcgttcgaggagctgaaagcctgcaccgagaatttctcagatagctatgagataggtgcaggaggctatggaaaggtgtacaagggaacactggtggatggaatacgggtggcgataaagcgggcgcaatccgggtcgatgcaaggtgcgccggagttcaagaacgagatcgagctgctgtcccgggttcaccataggaacctggtgagcctgatcggtttctgcttcgagcaaggggagcagatgctggtgtacgagtacgtcgctggtgggacactgagggagaacctagttgtgagaggatcttaccttgactggaagaagaggctcaggatcactctcggctcggcgagggggctggcatatctccatgagctcgctgacccgccgatcatccatcgggacatcaagtccaccaatatcctcctcgacgagaacctcaaggccaaggtcgccgacttcggcctctccaagctcctcgccgacaccgagaagggccacgtctccacccaagtcaaaggaacactgggttacttggatccggagtactacatgacgcagcagctgtcggagaagagcgacgtgtacagcttcggtgtggtgatgctggagatggtgagcgggaggcagccgatcgagaaggggaagtacatcgtgcgggaggtgaggcaggtgctcgacccggccgaccgcgactactacggcctgcgcgccatcgtcgacccggcgatccgggacgccgcgcgaaccgccgggttcaggcggtacgtgcagctggcgatgcagtgcgtggacgagtcggcggcggcgcggccggccatgggcaccgtggtgaaggaggtggaggccatgctgctgaacgagcccgacggggacggggccaactcggccgggtcgtcggccaccgagttcgacggcgctggcaggggggcgcccccgcacccgtacagcgacgtggagatcaccgggtcgtcctacgccggcggggagggcgcgtcggattacatgccctacttcgaggtcaagcccaaataggatttgtacattcattttggagttgtttcaatgggttttttctttctcttcttttttcccttttcagcctgtgatcgaattgtacattaattttgtatgtgttgttgtgatgcatcgtatatactggattcttgcacagttatcagaatacctatactaagattgccaa

SEQ ID NO: 2129 - DNA, 3326 bp, Oryza sativa
ctgatcatccatccgcggggggatgacctcttcccggcggcgcggcgagagaagggaagacttcaacccggccgcggttggtggcgccatcactccccggcccccgcgcccaccatatacaccgaggcgtcgtcgcctccccgcaccttgcgcggactcttctcctcttcttcctccacctcctcctccacgatctccggtcaagcagagcacaagcgtgtgctagctctcccggtggcttgcctcgccggcgacggcgcggcgcaggatggagccgcgggtgttgatggctcttgcgctggtggtggtggcggcgggcgtgccggcggtgttgtgccagaccaacgcccaggacgctgcggcgctcgaggggctgaagagccaatggacgaactacccgttgagctggaactccggcgacccctgcggcggcggatgggacggcatcatgtgcaccaacggcagggtgacgacgctgaggctgtcaagcgtcagcctgcagggaacactgagcagcagcatcggccagctcggccagctcacgtacctggatctttccttcaacatcaatctcggtggtccgctgccagctgagattgggaaccttggggagcttacgacactgatcttagctggttgcagcttcactggaaacattccaatagcaataggcaacctgcggaaacttgggttcttggccttgaattcaaacaagtttagtggtggaataccgtcttcgattggcgtactcacaaacctcttatggctagacctggctgataatcaactcactggatctgtccccatctcaacatcaacatcaccaggcctggaccaacttgtcaaaacgcagcacttccatttcaacaagaaccagttaactggaacgcttactggacttttcaactccaatatgactctcatacacattttgtttgatagcaacaaattctcaggctcaatcccagctgaggttgggactgttagtacactcgaagttctccgattggataggaatggttttacgggagcaatacctgctacaattggcagtttggtcaaactgaatgagctgaacttagcaaacaacaagctaactggatcagtgccagatctcagcaacatgaccaacttgaatgttgtggatttgagcaacaacacatttgatccttcagtggcccccagctggttcacatctttaacatctcttgcttctgtttcaatagtttctggaagtctttctggccaggtcccaaaggggctcttcacattgcccacactgcagcaagttgtgctgagcaacaaccaattcaacgggacacttgaaattacaggcaacatcagcagctcactgcagacagtaaatctcatggacaaccgaatagtttctaccgatactgcaagctacaagaaaactctactcctggcaggtaatccgttttgcgccgagcaagatcccaacaacagagccttctgcagcaggcagctacagaacgcgagcccatacagtaccagtatggaaaaatgcggctcagctcagtgcagtgatggtcagaacgtgaaccctgcaagctgcggctgtgctttctcatacaacggcaagatggttttcagggcacccttcttcgtcgacttggtgagcagtacgccgttccagctgctggagtcgaccatggcggcaaagctgaacctgctccctggctcggtcgctctctcagacatccacttcaacagtgacaactacctccaagttcaagtgaagctgttcccaacatccggggtgaccttcaacctgtcagaattgacaaggattggttcttctctcagtaaccagatttacaaaccaccagcaaattttggaccttatttcttcattgcagacccatatgcccccttggcagttgctcttggtggcaaaaaatccaagatgagcacaggtgccatagctggaattgcagtagccggtggggtccttgttatcgccctcattttcatgtcattgtttgctctccgacagaagagaagggctaaggaactcaaggaaagagcagacccttttgcttcatgggctgctggccagaaggacagtggaggggctccacagctgaagggagcaaggttcttctcctttgacgagctcaagatctgcaccaacaacttctctgacaaccacgagatcgggtcaggaggctacgggaaggtgtacagagggattctcggtgacggaacccgtgtcgccatcaagcgtgcagaccgcaactcaatgcagggcgctgtggagttcaagaacgagatcgagctgctgtccagggtgcaccaccgcaacctggtcagcctcattggcttctgctacgagcaaggtgaacagatgctcgtctacgagtacatctccaatggcacactcagagagaacttgacgggaagtgggatgtacttggactggaagaagaggctgaggatcgcgcttggctcggccagagggcttgcctacctgcacgagctcgctgacccaccgatcatccaccgcgacatcaagtccaccaacatcctcctcgacaacaacctcaaggccaaggttgccgacttcgggctctccaagctcgtggccgacactgagaagggccatgtctccacccaagtcaagggaacactgggctacctggacccggagtactacatgacgcagcagctgtcggagaagagcgacgtgtacagcttcggggtggtgatgctggagctggtgagcgggaggcagccgatcgagaaggggcggtacgtggtgcgggaggtgcggctggccatcgacccggccgaccacgaccaccactacggcctccgcgggatcgtcgacccggccatccgcgacgccgcgcgcaccccggtgttccggcggttcgtgcagctggcgatgcggtgcgtcgacgagtcggcggcggcgcgcccggccatgggcgccgtggtgaaggagatcgaggccatgctgcagaacgagcccgacgacgccggcgccggggagggggacagctccgccgacccgtccgccaacgagttcgaccgccaccgcggcggtggcggcccgccggcgcacccctacagcgacgtggagatcagccggggatcgtacgccggcgatggcgcgtcggattacatgccctattttgaggtcaagcccaagtagtcatcattagattgtaaattgatgagggtgttgtttgtttcagtttttttttcctttgttctttctccttttcagcttgtgatgaattgtaaattttgtatgtgttgcgagttgcgacagattaatatatactgctacagattctttc

SEQ ID NO: 2130 - DNA, 3235 bp, Zea mays
cctagccttgccagtttccacgacagagagagagagagcgagaggaggaaagaagagtcatcgcagacagaagagggtgctccagcgtgcatctcgtcgcccgccgtcggcgtgattgcttggcagcaggatggaggaggccacgcggcgccgtatcacgccgacgacgacgctgctgctggccctggcggtgctggcggcgagcgttcccgccggcttctgcgccatcaaccctcaggacgcttctgctctcaacgccatccagagccaatggacgaacgcccccttgagctggtcctcggcgagcgacccctgcgacgggggctgggacggaatcatgtgcagcaacggcagggtcacgtcgctgcggctgtcaagtgtcaacatccagggcacgctcagcgacagcgtcggacagctcacccagctcatgtacctggacgtttccttcaacctcggtctcaacggccgaatgcccgctacaatcgggaacctggcgcagctcaccacgctgatcctggcaggctgtagcttcaccggagccatcccacagcaactcggcaacctgcagcagctctcgttcctggcgttgaattcgaacaagtttaccggcacaataccccctacgctgggtctactctcgaacctcttctggctggatctggctgacaatcagctcactggatctatcccggtctccacagcaacaacgccggggctcgaccaacttacccacacgaagcacttccacttcaacaagaaccagctgtctggaacactcacaggcctcttcaactccaacatgagcctgatccacatactgttcgacagcaatcaactgactggcccgataccagaggagctagggggcatttcatcgctccaagttctccgactagataggaacagccttaagggaacgattcctcctaacatcagcaacttggtcaatctgaacgagctgaacttggccagcaaccagctcactggaccgttgccagatctaagcagcatgaccaaattgaatgtcgtggatttaagcaacaactccttcgccgtttcagcagccccaaactggttcacaactttaacatctctaacctccgtatcaatatcttctggaaagctttctggcgctgtccctaagggtctcttcaggttgccccagctgcagcaagttgtgctgagcaacaacgagttcaacgggacacttgaggtcacaggcaacatcagcagtcagcttcaggctatcaatctcatgaataacggcattgctgctgccaatgtcaccccaagctacaacaagactctagtgctactagggaacccgggctgcgtggacccagagttgaaagtcttctgcagcctcaagcaggagagaatgatagcgtacaacaccagcctggccaagtgctcctctacggcctcgtgttccagtgaccagcgcctgaaccctgcaaactgcggctgcgcatacccctacgccgggaagatggtattcagagcgccgctcttcacggacctgacgaacagcgccacctttcagcagctggaggcgagcttcacgacgcagttgtctctccgcgatggctccgtgttcctctccgacatccacttcaatagcgacaactacctccagattcaggtggcgcttttcccgtcgtctggggtgtccttcagcgtggcggatctgatacggataggcttcgatctgagcaaccagacttacaaaccaccgtcgaattttggaccctattacttcattgcagatccatacgctcttttggcaggtgcttcttctcgtggcagtaaaaaatcacatatcagcactggcgctatcgctggaattgcggtagccggtggaattcttgtgattgccctcattggcatggtattatttgcgttgcgacagaaaagaagggtcaaggaagtgacaggacgaaccgaccctttcgtttcatggggagtttcccagaaagacagtggaggggctccacagcttaaaggagcaaggttgttctctctgaatgagctgaagaactgcaccaacaatttttcggacacccatgagataggctcaggaggctatggaaaggtgtacaagggaacactcgttgatggaacgcgggttgccataaagagagcagagcgcggatcaatgcaaggtgtggtggagttcaagaacgagatcgagctgctgtccagggttcatcacaggaacctggtgagcctgattggcttctgctacgaacaaggggagcagatgctggtgtacgagtacgtctccagcggaacgctgagagagaacttactagtgagaggaacgtacctggactggaagaagaggctcaggatcgcgctcgggtcagcgaggggacttgcgtaccttcacgagctcgccgatccgcctatcatccaccgggacgtcaagtccaccaatatcctcctcgacgaccacctcaaagccaaggtcgccgacttcggcctctccaagctcgtcgcggacacccagaagggccacgtctccacgcaagtgaaaggaacgctgggttacttggatccggagtactacatgacgcagcagctgtcggagaagagcgacgtgtacagcttcggggtggtgatgctggagctggtgagcgggcggcagccgatcgagagcggcaagtacatcgtgcgcgaggtcaagctggccatcgaccccaacgaccgcgaccactacgggctgcggggcctcctggacccggcgatccgggacaacgcgcgcaccgccgggttcaggcggttcgtgcagctggcgatgctgtgcgtggacgagtcggcggcggcgcggccggccatgggcgaggtggtgaaggacatcgaggccatgctgcagaacgaggtctccgggcccgacggggccaccagctccgccggctcctccgccaacgacttcgacggcgccggcggcggagcgaggtcgcacccgtacagcgacgtcgagatcacgagaggctcgtacggggacaacgcgtcggactacatgccgtacttcgaggtcaagcctaagtagaccttccagtttcagacttgtatagcttgtgagatacattgtatagatttgtattatatttcacgtttatattctttggtttctcgagcttaatttttatcatgctacttccgatctatcatgacgcaaactgtacattcctcgaaattttccaagataagttgttctgttcttatttag

SEQ ID NO: 2131 - DNA, 3157 bp, Zea mays
cctagccttgccagtttccacgacagagagagagagagcgagaggaggaaagaagagtcatcgcagacagaagagggtgctccagcgtgcatctcgtcgcccgccgtcggcgtgattgcttggcagcaggatggaggaggccacgcggcgccgtatcacgccgacgacgacgctgctgctggccctggcggtgctggcggcgagcgttcccgccggcttctgcgccatcaaccctcaggacgcttctgctctcaacgccatccagagccaatggacgaacgcccccttgagctggtcctcggcgagcgacccctgcgacgggggctgggacggaatcatgtgcagcaacggcagggtcacgtcgctgcggctgtcaagtgtcaacatccagggcacgctcagcgacagcgtcggacagctcacccagctcatgtacctggacgtttccttcaacctcggtctcaacggccgaatgcccgctacaatcgggaacctggcgcagctcaccacgctgatcctggcaggctgtagcttcaccggagccatcccacagcaactcggcaacctgcagcagctctcgttcctggcgttgaattcgaacaagtttaccggcacaataccccctacgctgggtctactctcgaacctcttctggctggatctggctgacaatcagctcactggatctatcccggtctccacagcaacaacgccggggctcgaccaacttacccacacgaagcacttccacttcaacaagaaccagctgtctggaacactcacaggcctcttcaactccaacatgagcctgatccacatactgttcgacagcaatcaactgactggcccgataccagaggagctagggggcatttcatcgctccaagttctccgactagataggaacagccttaagggaacgattcctcctaacatcagcaacttggtcaatctgaacgagctgaacttggccagcaaccagctcactggaccgttgccagatctaagcagcatgaccaaattgaatgtcgtggatttaagcaacaactccttcgccgtttcagcagccccaaactggttcacaactttaacatctctaacctccgttgtgctgagcaacaacgagttcaacgggacacttgaggtcacaggcaacatcagcagtcagcttcaggctatcaatctcatgaataacggcattgctgctgccaatgtcaccccaagctacaacaagactctagtgctactagggaacccgggctgcgtggacccagagttgaaagtcttctgcagcctcaagcaggagagaatgatagcgtacaacaccagcctggccaagtgctcctctacggcctcgtgttccagtgaccagcgcctgaaccctgcaaactgcggctgcgcatacccctacgccgggaagatggtattcagagcgccgctcttcacggacctgacgaacagcgccacctttcagcagctggaggcgagcttcacgacgcagttgtctctccgcgatggctccgtgttcctctccgacatccacttcaatagcgacaactacctccagattcaggtggcgcttttcccgtcgtctggggtgtccttcagcgtggcggatctgatacggataggcttcgatctgagcaaccagacttacaaaccaccgtcgaattttggaccctattacttcattgcagatccatacgctcttttggcaggtgcttcttctcgtggcagtaagaaatcacatatcagcactggcgctatcgctggaattgcggtagccggtggaattcttgtgattgccctcattggcatggtattatttgcgttgcgacagaaaagaagggtcaaggaagtgacaggacgaaccgaccctttcgtttcatggggagtttcccagaaagacagtggaggggctccacagcttaaaggagcaaggttgttctctctgaatgagctgaagaactgcaccaacaatttttcggacacccatgagataggctcaggaggctatggaaaggtgtacaagggaacactcgttgatggaacgcgggttgccataaagagagcagagcgcggatcaatgcaaggtgtggtggagttcaagaacgagatcgagctgctgtccagggttcatcacaggaacctggtgagcctgattggcttctgctacgaacaaggggagcagatgctggtgtacgagtacgtctccagcggaacgctgagagagaacttactagtgagaggaacgtacctggactggaagaagaggctcaggatcgcgctcgggtcagcgaggggacttgcgtaccttcacgagctcgccgatccgcctatcatccaccgggacgtcaagtccaccaatatcctcctcgacgaccacctcaaagccaaggtcgccgacttcggcctctccaagctcgtcgcggacacccagaagggccacgtctccacgcaagtgaaaggaacgctgggttacttggatccggagtactacatgacgcagcagctgtcggagaagagcgacgtgtacagcttcggggtggtgatgctggagctggtgagcgggcggcagccgatcgagagcggcaagtacatcgtgcgcgaggtcaagctggccatcgaccccaacgaccgcgaccactacgggctgcggggcctcctggacccggcgatccgggacaacgcgcgcaccgccgggttcaggcggttcgtgcagctggcgatgctgtgcgtggacgagtcggcggcggcgcggccggccatgggcgaggtggtgaaggacatcgaggccatgctgcagaacgaggtctccgggcccgacgggaccaccagctccgccggctcctccgccaacgacttcgacggcgccggcggcggagcgaggtcgcacccgtacagcgacgtcgagatcacgagaggctcgtacggggacaacgcgtcggactacatgccctacttcgaggtcaagcctaagtagaccttccagtttcagacttgtatagcttgtgagatacattgtatagatttgtattatatttcacgtttatattctttggtttctcgagcttaatttttatcatgctacttccgatctatcatgacgcaaactgtacattcctcgaaattttccaagataagttgttctgttctt

SEQ ID NO: 2132 - DNA, 3318 bp, Sorghum bicolor
acggcagagagagagagacacagctctgtcttccttaatagctagtcttgccacgacagagagagaggaggaggagagtcgtctccccggccagagagaagaaagaggccgggtgctccggcgtacgtacgtgcacctctctcatcgcccgccgtcggtggttaattagcaggatggaggaggcaacgcggcggcgggtcacgtcgacggcgctgctgttggcgttggtggtgctggcggcgagcgctcctgccggcttctgcgccatcaactcacaagatggttctgctctcaacgcgctcaagagccaatggacgaacgccccgtcgagctggtcctcggcgagcgacccctgcgacgggggttgggacggcgtcatgtgcaacaacggcagggtcacatcgctgcggctgtcaagtgtcaacatccagggaacgctcagtgacagcatcggacagctcacccagctcgtctacctggatgtttccttcaacatcggtctgaatggtcgaatgcctgctacaatcgggaaccttgcagagcttaccacactgatcctggcaggctgtagcttcacaggaagcattccaccggaactcggcaacctacagaagctcacattcctggcgctgaattcaaacaagtttacaggcacaataccccctcaacttggtttactctcaagtctcttctggttggatctggctgataatcagctcactggatctatcccggtcacaacagcaaatacaccagggcttgaccaacttatccacacgaagcactttcatttcaacaagaaccagttgtctggaacacttacaggcctcttcaactccaatatgagtttgattcacgtattgttcgatagcaatcaattaactggctcaataccagaggagctagggggcgtttcaacactccaagtcctccgactagataggaacagtcttcggggagcaattcctcctaacatcagcaacttggtcaatctaaatgagctgaacttggccagcaaccagctcactggatcactgccagatctaagcagcatgacccaattaaatgtcgtggatttaagcaacaactcctttgccgtttcagtagccccaaactggttctcaactttaacatcgctaacctcagtgtcaatatcttctggacgactctctggcgtggtccccaagggtctcttcacgttgccccagctgcagcaagttgtactgaacaacaacgcgttcaacggaacccttgaggtcacgggcaacatcaacaaacaactgcagactattaatctcatgaataacaatattgtcgctgccaatgtcaccccaagctacaacaagactctagtgctagtcgggaatccaggctgccaggacccagatttaaaatccttctgcagcctcaagcaggagagcatgattgcatacaacaccagcctgagcaaatgttcctctacagattcatgttccagtgaccagagtctgaaccctgcaaactgcggctgcgcctatccctacgccgggaagatggtcttcagagcgcccttgttcacggacctgacaaacagcgccacttttcagcagctggagacaagcctcacgcagcagttatctctacgtgatggctctgtatccctctcagacattcacttcaacagtgacaactacctccagattcaggtggcgctttttccatcgactgctgcatccttcagcgtgccggatctgatacggataggctttgatctgagcaaccagacttacaaaccaccaccaaattttggaccttattacttcattgcagacacatacgctcttttggcaggtgctgcttctagtggtagtaagaaatcacagatcagtactggcgctatcgctggaattgcggtagccggtggacttcttgtgattgccctcattggcatggtattatttgcattgcgacagaaaagaagggttaaggaagtgacaggacgaactgaccctttcgcttcatggggagtttctcacaaagacagtggaggggctccacagctcaaaggagcaaggttgttctctctgaatgaactgaagacctgcaccaacaatttctcagacacccatgagataggctcaggaggctatggaaaggtgtataagggaacactagttgatggaacgcgggtcgccataaagagagcggagcgcggatcaatgcaaggtgtggtggagttcaagaacgagatcgagctgctgtccagggttcaccacaggaacctggtgagcctgataggcttttgctacgaacaaggggagcagatgctggtgtatgagtacgtctccaacggaacgctgagagagaacctgttagtgagaggaacgtacctggactggaagaagaggctcaggatcgcgctcggatcagcgaggggacttgcgtaccttcacgagctcgccgacccgcctatcatccaccgggacgtcaagtccaccaacatcctcctcgacgaccacctcaaagccaaggtcgccgacttcggcctctccaagctcgtcgccgacacccagaagggccacgtctccactcaagtgaaaggaacgctgggttacctagatccggagtactatatgacgcagcagctatcggagaagagcgacgtgtacagcttcggggtggtgatgctggagctggtgagcgggcggcagccgatcgagagcggcaagtacatcgtgcgcgaggtgaggatggccatcgacgccaacgaccgcgaccactacgggctgcggggcctcctcgacccggcgatccgggacaacgcgcgcaccgccgggtttcggcggttcgtgcagctggcgatgcggtgcgtggacgagtcggcggcggcgcggccggccatgggcgaggtggtgaaggagatcgaggccatgctgcagaacgaggtcgccggcgccgacggcggcggggccaccagctccgccaactcctccgccaacgagttcgacggcgcgggcggcggcgcgcggtcgcacccgtacagcgacaccgagatcaccagaggctcgtacggggacaacgcgtcggactacatgccctacttcgaggtgaagcccaagtagtagtagtagacttccagttccagacttcagttgttgttgcataatcaagtaggttgcgagatgcattgtagatttgtataattttgtatgtcatcacgtcacgtgtatattcattggtttaattccttgagcttaattttaccatgctacttccaatgtatcatgatacgacgaattgtacatgcctagaaatttgttctgtttttttggtcctttt

SEQ ID NO: 2133 - DNA, 2476 bp, Zea mays
agagctctctttcaaaaactagcaaagatggtacaatgtactcaacctcctccccagttaaagctcccagagagtaagatcacagaaccgacagatgatgagaaccaagatttgccaccaaaacctgagaaaaggactaggatgcaccacattgagaggcacagatcttgtgttgtgaccttatctgacatagaacttaatggtctgcaacctcgtcatctgcaccaacccattgagatcagcccaggaggatcacagtgttcgctccatgaagaaacacctacagatactaatgcatcacacaggcatgcaattgcagatgctgcttgggaagccctcaaaaggtcaatggtttacttcagaggccaaccaattggaactgttgccgcaatagacaagtctcagggggcagcactgaactatgaccaggttttcatgagggatttcattcctagcgcattggcttttcttatgaaaggagagcacttgattgtgaagaactttctggtagaaactgcacgccttcagtcaagggagaagatggttgaccttttcaagcttggtcagggtgtgatgcctgcaagctttaaggtgcatcatcgcaaccctactcagaagacagaaagcttactggctgattttggtgaaactgccattgggagggttgctcctgtagattctggcttatggtggattattctccttcgtgcttacaccaaatggacaggggacaattctctggctgaaagtactaactgccaaagggccatgcaccttattctcaggttgtgtctctcagaggggtgtgatacttctccagccttgctttgtgctgatggatgctccatgatagaccgaagaatgggcatatatggctacccaattgaaatccaggctctctttttcatggctatgagatgcgccctgagtctgttgaaacaagagtccgatgctgacttcgtgaaccacatcacaaaaagaatccaagctctgagctaccacttgcacagttactactggttggacttccagagacttaatgacatataccgctacaagaccgaagagtactcacagacagctctgaacaagttcaacgtgatgcccgaatcgatacctgactggatatttgacttcatgcctagccgtggtgggtacttcattggcaacgttagtcccgcgaggatggatttccgctggttctgcctaggcaacttcatcgcgattctgtcgtcgttggctaccggagagcaggctgaagcgatactggatcttgtggaggagcgctggcaagaactcatcggtgagatgccgctcaagatctgttaccctgcgatggaaaatcaggaatggcagatagtcactggatgcgacccgaagaacaccaggtggagctatcacaacggaggctcgtggccagtgctgctgtggctgctggtggcggtgagcgtgaagctggggcggccgcacctggcgcggagagccgtggagctgatggagcagcggctggccaaggacgacttccccgagtactacgacggcaaggccgggcggtaccccctgcgggcacgcgccaagcccgccggcctccagctccacctcctccccttcccgcgcctccgcgtcgcctgcgccaccgccgccggggaggcgccgcccgttgagcagcgggacgaggtggagccggcctctgccgcggcatccaacgggactgccgttaaggtcgaggcgtccgccgcgaagcccgagtccccgcccgcgcccgcgccggtcccggccttccgcgacgccaggtgggtcaacggcacctgggacctcaccaagttcgacaagggcggcggcgtcgactgggacgccgtcatcgacgccgaggccaggagaaggaaatggctcgaagactacccggaggcgacgagcacagacgatgccgtcgtcttcgacacctccattatcccgtggtgggcatggatgaagcggttccaccttcctgaagccgagaagctaaacggtcgggccgccatggttggcttcttcatggcctacttcgtggacagcttgacgggcgtgggcctcgtcgaccagatgggcaacttcttctgcaagacgctgctgttcgtcgccgtcgccggcgtgctgctggtcaggaagaacgaggacgtggagtcgctcaagaagctcatcgacgagactacgttctacgacaggcagtggcaggctacctggcaagatgacccaaccgaggggccaaagaattagttcggcgttgggggtgcaaacgcagaatgctcgcttcttgtggtgtgtctttgcctctttcttcggcccctttttgtttcaccgtttagtcaggcttggaggaactttttgatgaacgtcataatctatctacgtgatcttgtgcaaaaacaaaaggtatgggagtactttctgtgctagagataataatcatgttgcagtttcactggtttatgctttc

SEQ ID NO: 2134 - DNA, 1565 bp, Triticum aestivum
  misc_feature (1556)..(1556): n is a, c, g, or t
catgtcctggaaccgcgccttctccttcaccgacaccaccaccatcagtgcccagcaaacccaagaagagcttctggaaaaggatcaggacaggtgttctaattgcaattgctgctgcaggaggggtattgttgcttctcttgattcttgtagtctgtatatgtattttcaagagaaagaaacacgcagaaccaaccgcagcttcgtcatccaaaggaaaagctattgcaggtggaaggacagacacccctaaggaagattacagcagtagtgttcaggaggcagagagaaacaaactggttttcttcgagggttcttcatataactttgacctggaggatttgctgagagcttcggctgaagtacttggaaaaggaagctttggaactacctacaaggctgttcttgaggatagcaccacagttgtggtcaagagattaaaggagatggtggtggggaagaaagactttgaacagcagatggagatagttggcaggattggccagcatcagaatattgttccgctgcgtgcttattattactccaaagatgagaagctactggtgtatgactatgtcccagctggtagccttgctgctgttttgcatgggaacaaagctactggaagagctgcactggactgggagacgagagtaaagatatctctcggcatggctcgtggactcgctcatcttcacgctgaggggagcgggaagttcatccacggcaacctgaaatcgtcgaacatccttctgtcacagaacctggacggctgcgtctccgaattcggcctggcacagctcatgaccaccctacctgcccctgcgcggctcatcggataccgtgcgccggaggtcctggagacgaagaagccgacccagaagtccgacgtctacagcttcggcgtgctgctcctggaaatgctgaccggaaaggcccccctgaggtcccccggccgcgaggactccgttgagcacctgccgcggtgggtgcagtccgtggtccgggaggagtggaccgcggaggtgttcgacgtggacctgctgcggcaccccaacatcgaggacgagatggtgcagctgctccaggtggccatggcgtgcgtggccgtcgcgccggaccagcggccgaagatggacgaggtgatcaggcggatcgccgagatccggaactcgtactcggggccggcgagcccgccggaggagaccggcgcccaggcgccatgagggcgtggagataaaaaagagtcccattgtgtttagcatgcagaggtagctagctaagctaagctaggttgcatagttacttcttacttggttatatatatagctttgagcgaaagttgatagccgcttgcttggttgattagtggagtgcggtttctgttgatccctgattctttcttgtttcgggtaatttttctgtgccgttttcggagtagtgactggtgaggctactgatctggatatctgatggtactgctggtgtttgtgttgccctgtagtttggcatgcctttttttccccagaatgtgattaatgggattcattgagtcnaaaaaaaaa

SEQ ID NO: 2135 - DNA, 1244 bp, Setaria italica
gttcaggaagcagagaggaataagttggttttcttcgagggcagttcatataattttgacttggaagatttactgagagcttctgctgaagttcttgggaaaggaagttatggaaccacctacaaagctgttcttgaggatggcaccacagttgtggtcaagagactgaaggaagtggtggtgagcaagaaggactttgaacagcagatggagataattggcagggttggccaacaccaaaatgtcgttccattgcgtgcttactattactccaaggatgagaagctattggtgtttgactatgtcccgtctggtagcctcgctgctgttttgcatggtaacaaatctgctggaagagctccattggactgggagacaagagtcaagatatcgcttgatgtagcccgtggtattgctcatcttcatgctgagggaggtggcaagttcatccatggcaacatcaaagcatcgaacgtccttctatcacagaaccaggacggttgtgtatctgagtttggcttggcacagctcatgaccactccacaggctgccccacgtcttgttggataccgggcaccggaagtccttgagaccaagaaatcaactcagaagtccgacgtctacagcttcggtgtcttgctccttgaaatgctaactggaaaagcccctctcagatctcccggccgtgaggattccatcgagcaccttccaagatgggtgcagtctgtggttcgtgaggaatggaccgctgaggtcttcgatgtggacttgttaaggcatcccaacgttgaggacgagatggttcagatgcttcagatcgcaatggcgtgcgtggccgctgtccccgaccagcggcccaagatggaggaggtgataaggaggatcacggagatccggaactcctactcttcggggacaaggacgcccttggaggacaagccggagactgcccaagcaccatgaggggtacagcatagtttagccagagacggtaactaggttgcatagtgagttgcttatagagcttcagcaaagttgatagcgtcctgcgtagcgcagtttctgttcgatccccggttgtttccagtaaatctgttgtgcattttttttccttattctgattgataatccgtgccattgtatcgttcagttaaatcagtagctcttctgattttcataggataatgttgctctgtaatttgacataatatctgcagcgtgattaatgaattgaatttcccttc

SEQ ID NO: 2136 - DNA, 1820 bp, Pennisetum glaucum
cttgctggaaaagaattggattcagaactactatacaagctttcccatcagaacttcaatcctcttcggcaagcagaaaaatcaagaaacggccgcctcccactccccaaattgagacatttgaatttgagcaacaataacctcagcgggccaataccacctaccttgcagaaatttccagcaagttccttcttggggaatgcttttctgtgtggatatcctttggatccatgttcaggaacggcaccttctccttctccagtatcacccccagcacccagtaagaccaagaagagctcatggaaaaagatcaaaactattgtgataattgcaattgctgccattggaggagtattgttgcttattttgattctcatgctcttgatatgtattttcaagagaaagaagcacactgaacctaccacagcttcgtccaaaggaaaggctgttgcaggtggtagggcagaaaatcctaaggaagactacagcagtggtgttcaggaagcagagaggaataaattggttttctcgagggaagttcatataattttgacttggaagatttactgagagcttctgctgaagttcttgggaaaggaagttatggaaccacctacaaagctgttcttgaggatggcaccacagttgtggtcaagagactgaaggaagtggtggtgagcaagaaggactttgaacagcagatggagataattggcagggttggccaacaccaaaatgtcgttccattgcgtgcttactattactccaaggatgagaagctattagtgtttgactatgtcccatctggtagcctcgctgctgttttgcatggtaacaaatctgctggaagagctccactggactgggagacaagagtcaagatatcgcttgatgtagcccgtggtattgctcatcttcatgccgagggaggtggcaagttcatccatggcaacatcaaagcatcgaacgtccttctatcacagaaccaggatggttgtgtgtctgagtttggcttggcacagctcatgaccaccccacaggctgccccacggcttgttggataccgagcaccggaagttcttgagaccaaaaaatcaactcagaaatccgacgtctacagcttcggtgtcttgctcctcgaaatgctaactggaaaagccccgcttagatctcccagccgtgaggattccatcgatcaccttccaagatgggtgcagtcagtggttcgtgaggaatggaccgctgaggtcttcgatgtggatttgttaaggcatccaaacgtcgaggacgagatggttcagatgctccagatcgcaatggcgtgcgtggccgctgtcccggaccagcggcccaaaatggaggaggtgataaggaggatcacggagatccggaactcctactcgtcggggacaaggacgcccttggaggacaaaccggagactgcccaagcaccatgaggggtacagcatagtttagccagagacggtaactagattgcatagtgagttgcttatagagcttcagcaaagttgatagcggcctgcgtagcgcagtttctgttcaatccccggttgcttccagtaaatctgtcgtgcatccattttttccttctcattgtagcgatctgattgataatcttttgccgttgtatcgttcagttaaatcagtagctctcctgatttttcataggataatgttgctatgtaatttgatataatatctgcagcgtgattaatgaattgaatttcccttctactatatgtttctgcctactccttgtgctcggatattgcggcgcttctataatgaaattgaagttg

SEQ ID NO: 2137 - DNA, 2190 bp, Pennisetum glaucum
caactctgacaagcaggctctcttgcatttgctgcatcactgcccatggcaagaagctcaactggagctccacaacacctgtctgtaccacctgggtgggggtgacatgcacaccagataagagccgtgtacatacactacgtctacctgctgcaggactcttcggtccaataccatcggacactcttggaaagcttgatgccttggaggtgttgagccttaggtccaatcgccttactgttgacctccctcctgatgtaggatctattcctgccctccattccctctatcttcagcataataacctgtctggaatcataccaacttccctctcttccagtttaacattcttagacctgtcatacaacacttttgatggagaaattccattgaaagtacaaaatcttactcaacttactgcattacttctccagaataactcactttctggacccattcctgacctccaactccccaaattgagacatttgaatttgagcaacaataacctcagcgggccaataccacctaccttgcagaaatttccagcaagttccttcttgggaatgcttttctgtgtggatatcctttggatccatgttcaggaacggcaccttctccttccccagtatcaccccccagcaccccagtaagaccaagaagagctcatggaaaaaagatcaaaaactattgtgataattgcaattgctgccattggaggagtattgttgcttatttgattctcatgctcttgatatgtattttcaagagaaagaagcacactgaacctaccacagcttcgtccaaaggaaaggctgttgcaggtggtagggcagaaaatcctaaggaagactacagcagtggtgttcaggaagcagagaggaataaattggttttctcgagggaagttcatataattttgacttggaagatttactgagagcttctgctgaagttcttgggaaaggaagttatggaaccacctacaaagctgttcttgaggatggcaccacagttgtggtcaagagactgaaggaagtggtggtgagcaagaaggactttgaacagcagatggagataattggcagggttggccaacaccaaaatgtcgttccattgcgtgcttactattactccaaggatgagaagctattagtgtttgactatgtcccatctggtagcctcgctgctgttttgcatggtaacaaatctgctggaagagctccactggactgggagacaagagtcaagatatcgcttgatgtagcccgtggtattgctcatcttcatgccgagggaggtggcaagttcatccatggcaacatcaaagcatcgaacgtccttctatcacagaaccaggatggttgtgtgtctgagtttggcttggcacagctcatgaccaccccacaggctgccccacggcttgttggataccgagcaccggaagttcttgagaccaaaaaatcaactcagaaatccgacgtctacagcttcggtgtcttgctcctcgaaatgctaactggaaaagccccgcttagatctcccagccgtgaggattccatcgatcaccttccaagatgggtgcagtcagtggttcgtgaggaatggaccgctgaggtcttcgatgtggatttgttaaggcatccaaacgtcgaggacgagatggttcagatgctccagatcgcaatggcgtgcgtggccgctgtcccggaccagcggcccaaaatggaggaggtgataaggaggatcacggagatccggaactcctactcgtcggggacaaggacgcccttggaggacaaaccggagactgcccaagcaccatgaggggtacagcatagtttagccagagacggtaactagattgcatagtgagttgcttatagagcttcagcaagttgatagcggcctgcgtagcgcagcttctgttcaatccccggttgcttccagtaaaatctgtcgtgcatccattttttccttctcattgtagcgatctgattgataatcttttgccgttgtatcgttcagttaaatcagtagctctcctgattttcataggataatgttgctatgtaatttgatataatatcttgcagcgtgattaatgaattgaatttcccttctactatatgtttctgcctactccttgtgctcggatattgcggcgcttctataatgaaattgaagttg

SEQ ID NO: 2138 - DNA, 2535 bp, Sorghum bicolor
tcttggtgacgccgcgagaaggtcggaaattctctccttcccggcgtcgtcatccccgttggtttccctttaactccgccctgggtcgccggtcgacgccgagccgagcggaggcgcgcgccgcgggagggaaccaaagctcgcctccgcctccgggattccaacctgggatggctttcttgcaacttgcgaggagtgatgcacatgcactgatgaggactgttggattataactggtttcttcttccagcccatcccaacaaatgtggcatctcaagctgatagcttttctttatggctctcttttctttatgcaccttccatatgctagaggttctgacctaaacaccgataagcaggcccttcttgcatttgctgcatcactgcctcatggcagaaaggtcaactggacctccacaacccaagtctgcacatcctgggttggcattacatgcacactggatgggacacgtgtgcgggaagtccgactacctgcaatagggctttttggtcctatcccatcgggcacacttggcaagcttgatgccttggaggtgttgagccttaggtcaaaccgtcttactattaatctccctcctgatgtaccatctattccctcgttgcgttctctttatcttcaacacaataacctgtccggaattataccaagttcactatcttccagtctaacattcttagacctgtcctataactcattcaatggagaaataccatcggaggtgcaagccatcactgaactgacagcattgcttctccagaacaactctctttctggacccatccctgaccttcgcctccccaagttgagacatttggatttgagcaacaataacctgagtggacctataccaccctccctgcagaagttcccagctacttcttttctgggaaatgcctttctgtgtggatttccattggaaccatgtccagggacaccagctccttctccgtcgcctccatcgccccaaaatggcaaaagaagcttctggaaaaaactcagccgtggtgtcaaaattgcaatagctgctggaggaggggctgtattattaattttgatcctcatcctcttggtatgcatcttcaaaagaaagagagatgcagagcatggcgcagcatcatcttcatccaaaggaaagtctattgcaggtggaaggggagaaaaatccaagggggaatacagcagtggtgttcaagaagcggagagaaacaaactgtttttctttgagggatgttcatataattttgacttggaggatctgttgagggcttcggctgaagttcttggaaaaggaagttatgggactacctacaaagctgttctggaggatggaacaacagtggtggtcaagaggttgaaggaagtggtggcgggaaagagggaatttgaacaacagatggagctaattggcaaggtttgccagcatcagaacactgtcccattgcgtgcttactactactccaaggacgagaagctcttggtgtatgactatgtcccattaggtagcctttgtgctgctttgcatgggaataaagctgctggaagaaccccattggactgggagacccgagtgaaaatagctctgggcgctgcacgcgggatggcttatcttcacgctgagggtggcgggaagttcattcacgggaacatcaagtcaagtaacatccttatctcacaggaactcagcgcctgcgtcactgagttcggccttgcccagctcatggccacgccccacgtccacccacggctcatcgggtaccgctcacccgaggtcctcgagacgaggaaaccgacgcagaaatccgacgtctacagcttcggcgtcctcctcctcgagatgctcacgggtaaagcccctctcaggtcccccgggcgtgatgattccatcgagcacctccccaggtgggtgcagtccgtggtccgggaagagtggacgtcggaggttttcgacgtcgacttgctaaggcacccgaacgtcgaggacgagatggtccagatgctccatgtcgcgatggcatgcgttgcagttgtccccgacgagcggcctcggatggaggaggtggtcagcaggatcgaggagatccggagctcctactcggagacgaagacgtccccggaggacaatcccagggagggcgctttctaaatcactgatgagtagcaagcagcacatcagtaacaatccattgccatctacagaaagtagttttgacagctctgtgttcagtgtgtgtccagtgaagctttgcagtcagttgtttcctgatcattctttggtaatctttttttcctgttcttggttccatgatgctagccctggaaccctggtgggggtctcatttcattaattagctctgctgattatcgtagggtgttatttgtcgatcgtgccaggcagcccaataactctttcaagtttgatttattgaatgggcatatgtttttgccactttcctgtgccttatatacaccctaattgttgaatcatgagtcatgattatgctattcactttccg

SEQ ID NO: 2139 - DNA, 697 bp, Triticum aestivum
ctggtcttcaacacctacctctggtggtgcaccgggctgcgcttcagggtcatgaacgggccgatcgcggaggccagggaggaggacgcggtgtgggtgtcgaccgaggaggcctacggcatggcgttccgcgacatgctgcagtgggtgagggacaagatggacttcaacaccaccagggtcttcttcaccagcatgtcgcccacccacggcaagagccaggactggggggacgcgccggggggcaactgctacaacgagacggcgatgatcgaggacgccgggtactggggcacggacgggcggcggagcgtgatgcgggtgatcagggagatcctcgacggcgacggcgccgacgtgccgctcacgttcctcaacgtgacgcagctgtccatgtaccgcaaggacgcgcacacctccatctacaagaagcagtggaacccgctgacgccggagcaggtcgccgaccccaggacctacgccgactgcgtccactggtgcctcccggggctccaggacacgtggaacgaactcctctactccaagctcttctacccttgatcacatttagtgtttacttactaggttgtgataaccatgccaaagtagttgagtaggcctcccgagtagtacaaacctggtgtttgaattggtggcaactatcatgcgttttgattccatagccttaaaaaaaaaa

SEQ ID NO: 2140 - DNA, 866 bp, Triticum aestivum
  misc_feature (690)..(690): n is a, c, g, or t
  misc_feature (811)..(811): n is a, c, g, or t
  misc_feature (844)..(844): n is a, c, g, or t
  misc_feature (866)..(866): n is a, c, g, or t
ctggtcttcaacacctacctctggtggtgcaccgggctgcgcttcagggtcatgaacgggccgatcgcggaggccagggaggaggacgcggtgtgggtgtcgaccgaggaggcctacggcatggcgttccgcgacatgctgcagtgggtgagggacaagatggacttcaacaccaccagggtcttcttcaccagcatgtcgcccacccacggcaagagccaggactggggggacgcgccggggggcaactgctacaacgagacggcgatgatcgaggacgccgggtactggggcacggacgggcggcggagcgtgatgcgggtgatcagggagatcctcgacggcgacggcgccgacgtgccgctcacgttcctcaacgtgacgcagctgtccatgtaccgcaaggacgcgcacacctccatctacaagaagcagtggaacccgctgacgccggagcaggtcgccgaccccaggacctacgccgactgcgtccactggtgcctcccggggctccaggacacgtggaacgaactcctctactccaagctcttctacccttgatcacatttagtgtttacttactaggttgtgataaccatgccaaagtagttgagtaggcctcccgagtagtacaaacctggtgtttgaattggtggcaactatcatgcgttttgattccatagccttaanacgctgccaaacagaataggcgatcttcttcttcctttccgtgagccgaagcgaggcaatcaggtgcagctgttaaacctgctaaagggaaagaacatgcaagagccgaccggaaaaacangattatcataaccataagataattgtgcgattnaagcaaatccaacccacgtccn

SEQ ID NO: 2141 - DNA, 1461 bp, Brachypodium distachyon
atgaaggcacctctgcacccctcctcaccggcctccgccgccttcttgtgcaagaaggcgcggttgtcgccgttgctcctggtgtctctgctcttcatgctcctcttctccttcctctacggagaagagctcacggcgctcatcagccagcaagctcgagcttggccacgcctcaacatccacaacgacgacagtgatcatcagcccgtggcaccaccgccgccggcccgtcacaacgacgacagtgatcatctacggaagaagaagtgggaggggaggctgccgttcgcggtgaacgatgaggacgaggacgaagagtgcgaattgttctcggggagctgggtgtgggacgaggaggcgcacccactgtaccgggaggaggactgcccttacatccagccgcagctcgcctgccaggcgcatggccgcccggacaaggcctaccggtcctggcgctggcagccgcacgactgcacactcccagtgttcaacgcgacgctgatgctggagacccttcgggacaagcggatgatgttcgtgggcgactcgctgaaccgcgggcagttcacgtccatggtgtgcctcctgcagtcggccatcccgtccgccgacgccaagtccttcgagatgtcccccgaccagcagcacaccgtgttcaccgccagggcctacaacgccacggtggagttctactgggcgcccttcctgctgcagtccaacgccgacgacgccgtcgtgcaccggatctccgaccgcaccgtgcgcaacggctccatcgcccaccacggccgccactggaagggcgcacacgtcctcgtcttcaacacttacctctggtggtgctccggcctccgcttccggatcatgaacgggccgatcgaggaggcggcgaacacggagtcgacggtgtgggtatcgacggaggaggcgtacggcatggcgttccgggacatgctgcagtggacgagggacaacatggacttcaacaagacaagagtcttcttcaccagcatgtcgcccacccacggcaagagccaggactggggcggcgcggcagggggcaactgctacaacgagacggcgatggtccaggacgcggaatactggggcacggacagtcgccgtagcgtgatgcgggtgatcggggacatcctcgacggcgacggcgccgacgtgccgctcacgttcctcaacatcacccagctgtccatgtaccgcaaggacgcgcacacctccatctacaagaagcagtggaacccgctgacggccgagcagctcgctgaccccaagagctacgccgactgcgtccactggtgcctcccgggcctccaggacacgtggaacgagctcctctacaccaagctcttctacccttgataatcactactaggttgcactactagctagttaccattcgagatcgaccttcaggtagaaagaaactgtcaagagagtagttca

SEQ ID NO: 2142 - DNA, 1593 bp, Sorghum bicolor
atgaaggcaccactcagctcttcatccaccgtttcttcaattgcaaagaaggcgcgctcttcgccattgctattggcattggcgctctgcctactttgcttctccttcctctacggcgaggacctcaaggagctcctcgctcgccatggcgaggaagcatcacgcctcatcgccaacacctacagcaccaacatttttgagcacgagcaatcgacagcaccaccaccctccgaggttgccgcgacgacgaagaggaagtggaaggggaggcttgcgttcgcgctgaacgacgaggacgaggacgaggagtgcgacgtgttctcgggaacctgggtgcgtgacgacgccgagcacccgctgtaccgcgaggaggcgtgtccctacatccatccgcagctgacctgccaggcgcgggggcggccggacacggcgtaccagcggtggcggtggcagccggacgactgcacgctgccggcgttcgacgccgtccggatgctggaggcgctgcgcgacaagcggatgctgtacgtgggcgactcgctggggcgtggccagttcgcgtccatggtgtgcctgctgcagtccgccatccccgacgccggcgccggcgccaggtcgtcgttcgagatgtcggcggaccagcagcacaccgtgttcaccgccagggagtacaacgcgacggtggagttctactgggcgccgttcctgctggagtccaactccgacaacgccgccgtccaccggatctccgagcgcatggtgcggcgcggttccatcggctaccatggccgccactgggagggcgtccacgtcatcgtcttcaacacctacctgtggtggtgcaccggcctgcgcttcaggatattgaacgggccgtgggaggacgccggcaaggagacggcgtgggagtgggtgtcgacggaggaagcgtacggcatggcgttccgggacatgctgcagtgggtcagggacaacatggacttcaacagcaccagggtcttcttcaccagcatgtcacccacgcaccagaagagtcaggactggggcgacgcgccgggcggcaactgctacaacgagacgacgatgatcgaggaccgcgggtactggggctcggacggccgccggagcgtgatgcaggtgatccgggagatcctggacggcgacggcgccgacgtgccgctcacgttcctcaacatcacgcagatgtccatgtaccgcaaggacgcgcacacctccatctacaagaagcagtggagccaacccacggcggcgcagctggcggaccccaagacgtacgccgactgcgtccactggtgcctcccgggcctccaggacacgtggaacgagctcctctactccaagctcttctacccttaggcgtcgttcgtaccatattcccaacctagttaggccaggtagtgctattcaaaatactgaagaaatgacgggacagggcaggatcggtgataaccgaacgaggtcttagttttgttacatacatagtgcaaaacaaaagtccatgagatgttggtacagagacacacggacatcaatcttttctccttcaaatttcgaatcaaatgagttttgggc

SEQ ID NO: 2143 - DNA, 2004 bp, Oryza sativa
aagcttgaacgccaagatcgagatcgccggagatgaaggcgccgccgccgccgtcgccggtggccaagagggcgcgcgtctcgccgttcgtcttcctgctcgtgctcttcctcctcctcttctccttcctctacggcgaagacctcaaggagctcctcggcagccaagctcaagcgcggccgagcctccacttcaatgccgccgccgccggtgatgggatcgagctgccggccgccacggcggcgacgaccgaggggaggacgacgacgaggaggtggcgggggcggctgccgttcgcggcgaacggcgacggcgaggaggaggaggaggagtgtgacgtgttctcggggaggtgggtgcgcgacgaggcggcgcggccgctgtaccgggaggcggactgcccctacatcccggcgcagctggcgtgcgaggcgcacgggcggccggagacggcgtaccagcggtggcggtggcagccgcgcggctgcgccctcccggcgttcgacgcggcggcgatgctggacaggctgcgcgggaagcgcgtgatgttcgtcggcgactcgctggggcgcgggcagttcacgtcgctggtgtgcctcctcctcgccgccgtccccgaccccgccgcgaggtcgttcgccacgtcgcccgaccagcagcgctcggtgttcaccgccgcggcgtacaacgccaccgtggagttctactgggcgccgttcctcctccagtccaacgccgacaacgccgccgtccaccgcatctccgaccgcatggtccgccgcggcagcatcggccaccacggccgccactgggagggcgccgacgtcatcgtcttcaacacctacctctggtggtgcaccggcctccagttccgaatcctggaggacgggccgttcgacgccggcggcaactcgtcgacgacgacgtgggtgtcgacggaggaggcgtacgcgatggcgttccgggagatgctgcagtgggcgagggagcacatggacttcgcgacgacgcgagtcttcttcacgagcatgtcgccgacgcacggcaagagccaggactggggcggcggcgagccggggggcaactgctacggcgagacggagatgatcggcgacgccgcgtactggggctccgacagccggcgcggggtgatgcgggcgatcggcgaggtgctcgacggcgatggcgccgacgtgccggtgacgttcctgaacgtgacgcagctgtcgctgtaccgcaaggacgcgcacacgtcggtgtacaagaagcagtggacgccgccgacgccggagcagctcgccgaccccaagacctacgccgactgcgtccactggtgcctccccggcctgcaggacacgtggaacgagctcctctacaccaagctcttctacccttgaaaataattaaaaaaacaactagaagcttctagaacaatccatgtaggagtattatgtaatgtatgcatgcaggcatgcagctaggccgcggcatctagctaacatggttcaatatttcggaaagaaaaaaaaaggtaaaaaaatccttccatgaatctagagaacacctttgacttcaccaactctccctttctttggtcgaagtaaaaacattttaggggacaaaaatttcagaaatttcaatctaaaattttaaaattgaacaaaatctaactgagttcgaccaagattgttctagatttttttttaaaaaaaatcattttttaagaggaagaaacatcctatagctagctataagaaaacataagaaacaagaagtgcacattctagtagctcttttagtggcaaattaaaatgttgtgatttgttttccttttgttttggtcaattaccatatgtgtcaattgctgtgcagcaatgtagccttgatatgctgctaaaaaaggagaaagcagttagcattttatagtttttctagcctttttagatgctctaatgagatggcttacttgataaaacattacagtaaaccacactttgctccacc

SEQ ID NO: 2144 - DNA, 1125 bp, Hordeum vulgare
agtaccccctgcttatcccctcccgagtccgtcgcctcctcggcattccgtcgaacaccatgacgagcgtggcggcggcggtcgccctcctccgcctccctctcgcccgcctctcctcccacctccggtccctccctgcccctcccgtcccgtccgctcgcctccgcctctccgccccccaccgccctctctgctccctcctcaccggccacggcctcgccgtagcggccgtgtccgaggcggtggccgcggcggacgaagaagagttcgaagcgacggaggagcagcaggaggaggaggcgcccccctccttcgtgctcccgcggctgccgcggccgaagctcgacgtgaaggagcggaaggagctcgcctcgtacgcgcacggcctcggcaagaagctcaagtcgcagcaggtcgggaagggcggcgtgacgcccaacctcgtcaccgccttcacggacaaccttgagtccaacgagctcctcaagctaaaaattcatgggaattgccctggagaactacctgatgtgatacgacaacttgaggagtcaaccggatccattgctgtcgaccaaattggccgctcagttattctatataggcctagctccagcaagatgaaaaagagggaagaagttgctagaaacagggaagagtatgcaagaaacaatccgaggtttggaaaatctgaaaatgcatttgaagaacgtcctaggaacaacagcgcaggcaggaggttcgtaaaatctgggtcgacatttaggactcaacagaagcgaagaccggtagcatccaaggggtcgtcatacagccgagggtagcagcattgaaaataacagattgtttttcttattgtttggaggaatcatgtaaattttagaccaactagtagttgtataatggacattagtgtttagtttgtgctagtaaaccatgattccaagtctcatcagccacaaagacaggctaacactaacaccacttcaatttgttgtgattccctttcattcggttggaagttcgtacgatctactccctctgtaaaaaataaatataagagcgtttagatcattactttaatgatttaaaccttcttatatttctttattgaaggagtacctgaat

SEQ ID NO: 2145 - DNA, 1125 bp, Hordeum vulgare
agtaccccctgcttatcccctcccgagtccgtcgcctcctcggcattccgtcgaacaccatgacgagcgtggcggcggcggtcgccctcctccgcctccctctcgcccgcctctcctcccacctccggtccctccctgcccctcccgtcccgtccgctcgcctccgcctctccgccccccaccgccctctctgctccctcctcaccggccacggcctcgccgtagcggccgtgtccgaggcggtggccgcggcggacgaagaagagttcgaagcgacggaggagcagcaggaggaggaggcgcccccctccttcgtgctcccgcggctgccgcggccgaagctcgacgtgaaggagcggaaggagctcgcctcgtacgcgcacggcctcggcaagaagctcaagtcgcagcaggtcgggaagggcggcgtgacgcccaacctcgtcaccgccttcacggacaaccttgagtccaacgagctcctcaagctaaaaattcatgggaattgccctggagaactacctgatgtgatacgacaacttgaggagtcaaccggatccattgctgtcgaccaaattggccgctcagttattctatataggcctagctccagcaagatgaaaaagagggaagaagttgctagaaacagggaagagtatgcaagaaacaatccgaggtttggaaaatctgaaaatgcatttgaagaacgtcctaggaacaacagcgcaggcaggagattcgtaaaatctgggtcgacatttaggactcaacagaagcgaagaccggtagcatccaaggggtcgtcatacagccgagggtagcagcattgaaaataacagattgtttttcttattgtttggaggaatcatgtaaattttagaccaactagtagttgtataatggacattagtgtttagtttgtgctagtaaaccatgattccaagtctcatcagccacaaagacaggctaacactaacaccacttcaatttgttgtgattccctttcattcggttggaagttcgtacgatctactccctctgtaaaaaataaatataagagcgtttagatcattactttaatgatttaaaccttcttatatttctttattgaaggagtacctgaat

SEQ ID NO: 2146 - DNA, 996 bp, Hordeum vulgare
gtcgtcgacctctgcgccggcggggacctcctctcgctcctctccgcccgcggcggccgcatccccgagcgcgaggccgcgggctggccgcgcagctcgcgtccgtgctcgccgcctgccaccgccgcggggtcgcgcaccgcgacgtcaagcccgacaacctcctcttcgagccgccacgggcgcgctcaagctcgccgacttcggctccgcggagtggttcggggacgggcggcccatgtcgggcctcgtcggcacgccatactacgtggcgcccgaggtggtcgcctggagggagtacggggagaaggtggacgtgtggagcgccggggtggtgctttacatgatgctctcgggggccgtgcccttctacggcgccaccgcgcccgagatcttcgaggccgtgctccgcggcaacctgcgcttcccgccgcgcgccttcgccggcgtctcgcccgaggccaaggacctgatgcgccgcatgctctgcaaggacgtctcccgcaggttctccaccgaacaagtcctgaggcatccgtggatcgcgagctgcggcggggatgcggtcgcaggctgaagagatcgatggaccaacataatctccacgcgctccatcctcctatagatagaagatcttctccgcaaacaacgatggctcggtctctgcggctctgctctgtttctccggcaaatcggcgatgggccgaagcagcggtggtgccggagttgagttcagtaagtagatcctttactctaggtctagaggtctctggtgaagctgggactgcagaagctttcacccgagttagcctgaatgtgtgtttgttcgttgtgtttgttatgtgaatctctgtacatgcagttttgttcagtcgtagttgaagaagagagagggttagtagtacctcgtggaacttggtaggcaagctttgttaaagaagaatgaaaatggagcaaaaaatatgtgcatgttcttgtacaaatggagcaaaaaaa

SEQ ID NO: 2147 - DNA, 1671 bp, Setaria italica
ctcagcacacatcagggtattcatgatccatccaatccaaggttcagatataggaagcacagagattcgctagcaaaatggaaggaacacgcaactgaactgtacataagttttcccaatttttggggggtccattctctgccgaacaagtctagttctctcttcttgagccagaacgaagacgactgtacacgggttacaaaaacaaagagcaagcgagacgaacattgacagacaaactcaggaagccccccaaattcctgcttcacgagtgctcgcctaggctagattactgctaccggcactactgtccatcgacgattgccagaaacgaagcaaaaatccactgcaaaaggtcgctccctactcctcttcgacgaacgccattatcttatctacactgcggacggatgaagcggagcatctgatgatctgaatcagcaggtcacgccgcactcccccctcgggtcacgatccatgggtgccttaggacttgctcggcggagaaccttcgggagacgtccttgcagagcatgcggcgcatgaggtccttggcctccggcgagacccccgcgaaggcgcgcggcgggaagcgcaggttgccccggagcacggcctcgaagatctctcccgcggtggcgccgccgaagggcacggtcccggagagcatgacgtagagcaccaccccggcgctccacacgtccaccttctctgtgtactccctcccggccaccacctcgggcgccacgtagtagggcgtcccaacgagccccgtcatggggcggccgtccccgaaccaccccgcggacccgaagtcgccgagcctgagcgcgccgccggcgtcgaagaagaggttgtccggcttgacgtcgcggtgcgcgaccccgcggcggtggcatcccgcgagcgcgtcggcgagctgcgccgcgaggtcggccgcctcgggctccgggagcgggccccgcgcggagacgagggagaagaggtccccgccctcgcagaggtcgagcacgaggtggacggcgtcggcgtcctcgaaggcggcgtggagcgcgacgacgtggcggctggcgggcggcggcgcggacacgaggaggtgcaccttgggctcctgctccgcgagggccaggtccagcgggtccgcctccagctcccgcagcggctccttgggcgtggacttgagcgcgaagggcgcacccgtggcggcggcgtagcagcggcggaccgtgccgaagcggccgcgcccgatctcgtcgccgatgacgtactcccgccgcagcgcctcctcgccgccgctcatgctcctgctgctgggtggtggtgttggtggttgggttggtcggcgttggtgtggtggtgcgtgcgttgtgtgccctatccgctggcagtgttgcacatgcaatggagcccatcatcacgtgttctgtgccaataaggacggactctgtatgctctgccagattgtacatatacattgtggtgatatgtttacaaggcttgatatgcttgctaagatctcgtaagctaatttggtttgcagatttctcgtccaagcttcggttcaggctcagaatgatgaattgttgtttgtcattgatttgaccatcacagctttttggattgaatttgataatgcactatttgatttaacctatgagtattacatgaatg

SEQ ID NO: 2148 - DNA, 1143 bp, Panicum virgatum
  misc_feature (60)..(60): n is a, c, g, or t
  misc_feature (205)..(205): n is a, c, g, or t
  misc_feature (246)..(246): n is a, c, g, or t
  misc_feature (465)..(465): n is a, c, g, or t
ttcgggaccgtccgccgctgccacgccgccgccacgggggcgcccttcgcgctcaagtcnacgcccaaggcgccgctgcgggcgctcgaggctgacccgctcgacctcgcgctcgcggagcaggagcccaaggtccacctcctcgtgtccgcgccgccgcccgccagccgccacctcgtcgcgctccacgccgccttcgaggacnccgacgccgtccacctcgtgctcgacctctgcgagggcggngacctcttctccctcgtctccgcgcggggcccgctcccggagcccgaggcggccgacctcgccgcccagctcgccgacgcgctcgcgggctgccaccgccgcggggtcgcgcaccgcgacgtcaagcccgacaacctcttcttcgacgccagcggcgcgctcaggctcggcgacttcggctccgcggcgtggttcggggacggccgccccatgaccggnctcgtcgggacgccctactacgtggcgcccgaggttgtggccgggaccgagtacaccgagaaggtggacgtgtggagcgccggggtggtgctctacgtcatgctctccgggaccgtgcccttctacggcgccaccgcgggggagatcttcgaggccgtgctccgcggcaacctgcgattcccgccgcgcgccttcgcgggggtctcgccggaggccaaggacctcatgcgccgcatgctctccaaggacgtctcccgcaggttctccgccgagcaagtcctaaggcacccatggatcgtgtcccgcgggggaagtgcggcggtggcctgctgattcagaattcagatgccccgtttcatccatctgcagtgtagatagatagtggcgttcgtccaagaggagtggagccaccttttgcagttgatttttgcttcgtttctggcaatcgtcgatggacacttgtgccgtagtttgctagtaattagcagcagtagcagtaatctaccataggcgagggctcacactcatgaagcaggtcctgagtttgttaatgccgttcgtcttgtttgctctctgtaacccatgtacagtcttcttcctgctgaagaagagagaactagacttgttctggagaaaatagaccccaaaaaaccggaaaaaaaaacttatgtacagtac

SEQ ID NO: 2149 - DNA, 1304 bp, Pennisetum glaucum
gacgcactgctagcaaaggaatcagccttatgtaaccctctaccactgggacctcccccaggtcctggaagataggtacaacgggtggcttgacaggcagataatccacgatttgctgcctacgccgagatatgtttcaaggctttcggagaccgtgtgaagcactggatcactatcaacgagccacacacggttgccgtccaaggctatgacgacgggcttcaagcgcctgggcgctgttctttgctgctccatctgtactgcaaggcagggaattcaggcaccgaaccctacattgtcgcccacaactttatcttagcccatgcgacggcttcagacatttacagaaggaattacaaggctactcagaatggggaacttgggatagcatttgacgtcatgtggttcgaaccgatgacgaataccacaattgatattgaggctgccaaaagagggcaagagtttcagctaggatggtttgcggatccattcttcttcggtgattacccggcgtcgatgagatcacgggttggggacaggctccccaagttcacaccagaagaggctgcccttgtgaagggagcgctggactttgtgggcataaaccactacaccacttactacaccaggcataatagcaccaatatcattgggcgcctgctgcataacactttggcagacaccggaaccatcagcctcccattcaggaacgggaaggcgattggtgacagggccaattcgatatggctgtacattgtgcccagcgggatgaggagcctgatgaactacgttaaggaaaggtacaacagcccaccaatctacataactgaaaacgggatggatgatggcaacagccctttcacctccatcaaggatgcactcaaggacagcaagaggatcaagtaccacaacgactacctcacaaacctcgccgcctccataaaggaggacgggtgcgacgtgcgtgggtacttcgcgtggtcgctgctggacaactgggagtggacggccgggtactcctcaagattcgggctctacttcgtggactacaaggacaacctcaagagataccccaagagctcggtgcagtggttcaagacccttctcagctccagctgagggattagatgcctggatgtacattgttttgtctcccataggccatagtcccattgccatttcttgttcaggccaggccatcaagtcatgtatacaataacgccatggtgtgcccaagtccatgtgttagaagttaaaaccatccatggttaagcctttaaattcagtgatgaaatacacagaat

SEQ ID NO: 2150 - DNA, 1210 bp, Pennisetum glaucum
tcggggggacctacctcaggccctggaagaccggtacaagggatggctggacaggcagatagttaatgattttgcggcctacgctgagacatgcttcaaggcatttggggatcgtgtgaagcactggatcacgatcaacgagccccataccgttgccgttcagggctatgacgctgggcttcacgcgccaggacgttgttcagtgctgatgcatttgtactgcaggtcagggaattcagccactgagccctacattgttgctcacaacttcatcttagctcatgccaccgtttcagacatttacaggaggaaatacaaggcaaatcagaatggccaggttgggattgcatttgacgtcatctggtacgaaccgatgacaaatagcacaattgacattgaagccaccaaaagggcacaagagtttcagctaggatggttcgcggatccgttcttctttggtgattacccagcgacgatgagaacccgggttgcagaaagactgcccaagttcacggcggaggagtctgcccttgtcaagggggctctggactttgtgggcataaaccactacaccactttctacacgaggcataacgatactaacatcatcggattactgctgaataacaccttggctgacactggaaccatcagccttccattcgacaagaacgggaagccgatcggagatagggccaattcgatctggctgtacattgtacccagcgggatgaggaagctgatgaactacgtgaaggagaggtacaataccccaacggtttacatcactgaaaatgggatggatgacggcaacagccctttcacgtccatcaaggacgcgctcaaggacagcaagaggatcaagtaccacaacgactacctcaccaaccttgctgcctccatcaaggaggacgggtgcgacgtgcgcgggtacttcgcgtggtcgctgctggacaactgggagtgggctgccggatacacctcgagattcgggctccacttcgtggactacaaggataacctcaagagataccccaagaactcggtgcagtggttcaaatcccttctcagctccagttagttgaagacggcaccatatacaggatatcgtaattggcctggcctacctgattccatgtatacttagctgttgtgttaaacatgcacaaaggattaaaaaaaagaagaaagagcgtcaagcttcactgcc

SEQ ID NO: 2151 - DNA, 3148 bp, Sorghum bicolor
atgggcgcgctccgggcgatgctcctccgccgcttggcgctgctcgccgtggccgtggccgtgcccacggtcacggcggcggcggcgccgcccagcgaggtggccgtgggcgcgctcttcacctacgactccaccattggccgcgccgcgcgtctcgccatggagctcgccgtcgacgacgtcaacgccgaccgcaccgtcctcgcgggcacacacctcagcttgctgttccaggacaccaactgcagcggctttcttggcaccatcgaagcattgcagctaatggaaagaaatgtggttgctgttattggcccgcaatcctctgggataggccatgtcatctcccatgttgttaatgagctacatgtacctcttctatcatttgcggctacagatccaactctttctgcatcagagtatccgtacttcatcaggacaaccataagtgactacttccaaatgaatgccgttgctagcattgttgattactatcagtggaaagaggtgactgctatattcgttgatgatgattatgggcgaggtggtgtgtccgcccttggtgatgcgcttgcagcaaagagggcaaggatttcatataaagcagccattcctccaaattcaaatacagatgtgatcaacgatgtactgtttaaagcaaatatgatggaatcaagggtcatggttgtgcatgtcaatcctgacacagggatgagaatattttctgttgctaacaagctccaaatgatggccagtggctatgtctggatagtaactgattggctagctgctgtcttggattcctcaatgcctagagatcgtaaagatatgagtcatcttcagggactaattgttcttcgccagcacactcctgaatctgatgccaagaaaaagttcatatctaaatggaataatgcagctcgtaatagaagtattacttatggcttgaactcttatggtttttatgcttatgactcagtttgggctgttgctcgtggtatcgatcaatttctcaatagtgggcagcagatcaacttttctccagatccaatgttgcatgattctaatggcagcactttgcatctatcaactctcaagatatttgatggtggtgagcagatgctacagcaacttctgctcacaaattttacaggcctaactggtccagtccaatttaattcagatcgcaatttggtacacccagcatatgacatcctaaacctcggtggttctgaatcccggttgattggctattggtccaattactcaggcctctctgttgctcctcctgaaattttgtatcagaagccaccaaatacttcttcacttgtccagcggctccacaatgtggtttggcccggtgattccaccactactcctaaggggtgggttttcccgaacaatggccagcctctaagggttggtgtcccaatcaaaccaagctttaaggaattagtggcaggtggaaagggccctgataatgtgactggttattgcattgatatattcaatgcagcagttaaattgcttccttacccagttccatgccaattcataacagttggggatggcagaaagaatcctaactatgatgccattattaatatggttgccgccaattcccttgatgcagctgtaggcgactttgctattgtgagaaacagaacaaagattgcagaattcacacagccttatattgagtcagggcttgtgatagtagcaccagtgaaacaagcaacttcaagtgcctgggctttccttaaaccgttcacgttggagatgtggtgtgtaacaggtgctctttttatttttgtggggatagttgtttggattcttgaacatcggagtaatgaggagtttcgaggctctccacgacgacaacttataacaatattttggtttagcttctcaacaatgttcttttcacacagacagaacactgtaagtgcgctagggcggtttgtgttgatcatatggttgttcgttgtgctgatcatcaactcaagttatactgctagcttgacgtcaatcctcacagtccaacagctcgcaacaggaataactggaatcgacagtttggtttcaagtggtttacctattggatatcaggatggaaaatttaccaaaaattacctgattgatgagctcaacattcctgagtatcgattggtaccactaaatacaatccaggagtatgctgatgcccttaaacgtggaccaaaagacggcggtgttgctgcaattgttgatgagatgccatatgttgagatcttcctgtcataccactgcaatttcagaatagtaggacaggagttcaccaaggagggatggggctttgcattcaagagagactccccccttgctgcagacttgtcgacagccatccttcaactctcagagagtggccagcttcagagaatacacgacgagtggttcacagggcctagttgctcctctgatgacagcgaagtgggagcaaccaggcttggcctcggaagcttttggggccttttcctcgcgtgtgccctgatatgtctcttggctctggtagtgtttttcatacggatatgctggcagtataacaagtactccaattctgaagccgctggtgagcccagtgcagcagcaacagctgcagctgctgcagcagccgcagatgttgctgctgctgctgctgctgccactgatgctgtggaaagacagcggaagccatcacgccttggcagcttcaaagagattatacagtttgtcgacaagaaggaggaggaaattaagagaacgatgaaacgaagattaagcgagaaagataaccaagctgcaggatcctcagataaagataaccaagctgcaggatcctcagatgctcatgcagtggcttcagcatagagcatactttccaacttcagtccttcagaaggcaaagcattgaagcacatatacagataacatactgaattaggttctctctcctcaaaacatatatagtatgataatctaactagcttcaaacaaaaaggatttgttgttgcagtaggatgatctacgaaaccattttttatcagggtgattagaatttcgtctcagatatacacggtttctatactaaacaattgtccatggcaattaaattctttttcaagctgtgcatagt

SEQ ID NO: 2152 - DNA, 4349 bp, Solanum phureja
ttggttgtgttaaaaaaatggagggtggtgaaaatattttgagagtgagtagtgcacgtttgagtggttcaaatgtatggagaaatagtgctatggatgtgttttcaaggtcttcttcaagagaagattatgatgatgaagaggcgttaagatgggctgctcttgaaaaacttccaacttatcgtcgtataaggagaggccttctcttagaagaagaagaaggacaatctagagaagtcgatataacaaagcttgatttgattgaaaggaggaatcttttagacaggcttgtcaaaattgctgatgaagataatgagaagttgttgatgaagctcaaacaacgcattgatagagttggtctggatcttcctacaattgaagtccggtttgagcatttaaatatagacgcagaagctcgtgtaggtagtagagctttaccaacaatattcaacttcacagttaacatcttagaggatttcttgaattatcttcatatccttccaagtaggaagaaaccattgccaatccttcatggggtcggtggaatcatcaagccaggaagaatgacactgcttttaggaccaccaagttcgggaaaaacaacgctgctgttagctttggctgggaaacttgataacgatctcaaagtttcagggagagttacatataatgggcatgggatggatgagtttgtaccacaaagaacatctgcttatataagccaaaacgatcttcatattggagaaatgacagtcagggaaacactggcattttctgctagatgtcaaggagttggaaccaaatatgaaattttggcagagttatcaaggagagaaaaggaagcaaatattaagccagaccctgatattgatatcttcatgaagtcagcgtggaatgaaggacaagaggctaatgttataacagattatactctcaagatattgggacttgaaatttgtgctgatacccttgttggagacgaaatgattcgaggaatttcgggggggcagagaaagagactaacaacaggggagatgatggttgggccagcaagagcactttttatggatgagatatcgactggtttagacagttcaacgacctatcagattgtcaattcaattaggcagtcaatccacattcttcaaggaactgctgtaatatcacttctgcagcctgcaccagaaacttatgacttgtttgatgatattattctcttatcagatgggcagattgtgtaccaaggtccccgggagaatgtactcgagttctttgagtacttaggcttcaaatgcccccagaggaaaggagttgctgatttcttacaagaagtgacatcaaggaaggatcaagagcaatactggtcacgtcgtgatgaaccttataggtttatcacagcgtgtgaattttctgatgtatttcaatcatttgatgttggacggaagcttggtgatgagcttgctgtaccctttgacaaatccaagagccaccctgctgctctaaccaccaagaggtatggtattagcaagaaagaactcttgaaagcctgcacagctagagaataccttcttatgaagaggaattcgtttgtctatatattcaagatggtacagctaacattgatggcgtctatagcaatgacactcttcctacgaactgagatgcacagagatacaacaatagatggtgcaatatacttaggtgcactgttctacgcagttatcacgattatgttcaatggtttctcagagcttgccctcagtattatgaagcttccttccttctacaaacaacgtgattttcttttctttcctgcttgggcatatgctctgcctacttggatcctcaaaattccgatcacactcgtagaaattgctatttgggtgtgtatgacttattatgttattggatttgaggcagacgttgggaggttcttcaaacagatatttctgctcatatgtcttagccagatggcctcgggtctgtttcgattcttagcagctcttggaaggaatatcattgttgcaaatacatttggatcatgtgcactactcatagttcttgtaatgggtggattcattctgtcaagagatgatgtgaaacaatggttgatatggggttactggatttcccctatgatgtatgcacagaatgctatagctgtgaacgaatttctagggaagagttgggcacatgttcctcctaactccacgggcacggatacattaggagtgtcatttttgaaatcacgtggaatctttccagaagcaagatggtattggattggagcaggagctctttttggatatgttttgctcttcaatttcctgttcacagtggccttagcttatctcaaccgtaagaatctgcctactattatgcaatctaatctcatttccatctatagcatgatcctaacatatcaacaagaaagaggaaatgatgttccggtaagtacatcttccaggtctctgtctacaagagtaggcaacataactgagggtgatttaaacaagagaaagggaatgattcttccttttgagcccctttcaattacttttgatgatataagatatgcagtagatatgccacaggaaatgaaaactcaaggttttattgaggaccgacttgaactcttgaaaggggtaagtggtgcttttagaccaggagttttgacagctctaatgggtgttagtggagctggaaagaccacacttatggatgtcttagctggtaggaaaaccggtggatacgttgaaggaaccatcagtatatcaggatacccaaagcagcaagaaacgtttgctcggatatcaggatactgtgagcaaactgacattcattcacctcatgttacagtatacgaatcattactgtattctgcttggcttcgactgcctcgtgaagttgacaccgaaacccgaaagagtttcattgaggaggtcatggaacttgtagagctaacccctctaagagaagcacttgttggattgcctggagtaaatggtctttcaactgaacaacgaaaacgacttacagttgcagttgaacttgttgccaatccttctataatattcatggatgagccaacctctggattagatgctagagcagctgcaatagtgatgagaacagttagaaacactgtagatacaggtcgaacggtagtatgcaccattcatcagcctagcattgacatatttgatgctttcgatgagctcctactcctgaaacgaggaggcgaagaaatatttgtcggcccattaggacgccattcttctcaccttattaagtattttgagggaatcgatggagttctgaaaatcagagatggttataatccagcaacatggatgttggaggtaacttcattagctcaagaagcagttcttggaattgactttacagaattgtacaaaaactctgaattatacaggagaaacaaagctttaatccaggaactaagtgtgccagcctcaggttcaaaagacctctactttgaaactaagtactcccagtctttcttcacccaatgcatggcttgcttatggaaacaacactggtcatactggcgaaatcctccttacacagcagtcaggctcatgtttacattcttcgtttctctcatgcttggaacaatattctggggtcttggctccaaaaggggaaagcaacaagatattttgaatgcaattggttcaatgtatgctgctatcttgtttcttggtataataaacgctagttcagtacagccagttgttgccattgagcggactgtcttctacagggaaagagcagctggaatgtattcagctctgccttatgcttttggacaggttatgattgagctcccgcacctttttctgcagacgatcatatatggtgttatagtctatgctatgatcggatttgaatggacagttaccaagttcttttggtatctgttcttcatgtatttcaccttgttatacttcacattatacgggatgatgacagtagctgttactcctaatcacaccattgcatccatcgtttcatctgcattttacacaatatggaaccttttctgtggattcgtcgttccaaaaacaaggatgccagtgtggtggagatggtactattacatttgccccctttcgtggacattatacggactcattgcctcacaatttggagacttacaagatagattggacacaaaggaaacagtggaagaattcttagagaatttcttcgattacaaacacgattttgtgggatatgttgcagtcattctagttggaatatcagttgtttttctcttcatatttgcttactcaatcaaatcatttaacttccagaaaagatag

SEQ ID NO: 2153 - DNA, 1409 bp, Solanum tuberosum
tttaaacaagagaaagggaatgattcttccttttgagcccttttcaatcacttttgacgatatcagatatgcagtagatatgccacaggaaatgaaagctcaaggttttatcgaggaccgacttgaactcttgaaaggggtgagtggtgcttttaggccaggagttttgacagctctaatgggtgttagtggagctggtaagaccacacttatggatgtcttagctggtaggaaaaccggtggatacataagaaggaaccatcagtatatcaggatacccaaagcagcaagaaacgtttgctcggatagctggatactgtgagcaaactgacattcattcacctcatgttacggtctacgaatcattgcagtattctgcttggcttcgactgcctcgtgaagttgacactgaaacccgaaagaggttcatagaggaggtcatggaactagtagagctaaaacctctaagagaagcacttgttggattgcctggcgtgaatggtctttcaactgaacaacgaaaacgacttacagttgcagttgaactagttgccaatccttctataatattcatggatgagccaacctctggattagatgctagagcagctgcaatagtgatgagaacagtcagaaacactgtagatacaggtcgaacagtagtatgcaccattcatcaacctagcattgacatatttgacgctttcgatgagctcctactcctgaaacgaggaggcgaagaaatatttgtcggcccattaggacgccattcttctcaccttattatgtatttgagggaatcgatggagtcccgaaaatcagagatggttacaatccagcaacatggatgttggacataacttcagtagcacaagaagcagcccttggagttgactttactgaattgtacaggacctcagaattgtataggagaaacaaagctttaatccaggaactaagtgtgccagccccaggttcaaaagacctctactttcaaactaagtattctcagtctttcttcacccaatccatggcttgcttctggaaacagcactggtcgtactggcgaaatcctccttacacagcagtcaggatcttgtttacattcttcattgctctcatgtttggaacaatattttgggatcttggctccaaaaggagaaggcaacaagatattttcgaatgccataggttcaatgtatgcttctgtcttgtttcttggggtacaaaatgctacttcagtgcagccagtcggtgctattgaggaggacagttttctacagggaaagagctggtggaatgtattcagcctcttgcctttatgcttttgtggacagattaatgaatggagctgcataccattttcatccaagacaaatccatatatggtggtatagtctatgccatga

SEQ ID NO: 2154 - DNA, 4349 bp, Mimulus guttatus
atgaagatgaaaactaaacgaggacggaggaatatcttttcgaataaaacaaaacatggccaagaggaaaagaacaaagagaaattaattagagttagcagcgcgcgtttaggcagctcgagtatatggcggaacaccggcatggaatctttttcgcggtccgaaaaagatgccgaagacgacgaagaagcattgaagtgggccgccctcgagaaacttccgacgtatctccgtataaggagaggcatgcttgtcgaagacgagggtaaaacacgagaagtcgatataaagaatctcggattatccgaacgaaggaatctcgtcgagaggctacttaagattgccgaggaaggcaatgagaagtttttgctcaagctcaaggaacgaattcaaagggtaggtcttgattttccgacgatcgaagtccggttcgagaacttgaacgttgatgcggatgcatatgcggggggtcgagctttacctaccatattcaactttactgtcaatatattggagggtttcttgagttatcttcgtattcttccgaacagaaagaaaccgttgccgattctgcatgatgtaagtgggatcataaaaccaggaaggatgacgttgcttttgggcccaccgagctctggaaaaacgacgttgctactagctttagctgggaagctcgatccggagttgaaaatatcggggagagtgacgtacaacggtcatgagatgaacgagtttgtaccgcaaaggacgtcggcttacataagccagcacgatttgcacattggagaactgacggttagagaaacgctcgctttctccgccagatgtcaaggagttggcgctcgttacgaaatgctgaccgagttgtcgaggagagagaaggaagcaaacattaaaccggaccctgatctcgatatttacatgaaggcatcgtcgattggagggcaggaagcaagtgtggtaacggattacatcatcaagattttaggacttgaagtgtgtgccgatacgttagtaggcgacgaaatgttccgaggaatatccggaggacaaagaaagagactcacgacaggcgaaatgatggtcggaccggcaagagcactattcatggacgagatatcgaccggtttggatagttcgacaactttccaaatcgtgaactcgatacgacaatcgatccacattttgcagggaactactataatctcactcctacagcctgcaccggaaacgtacgatttattcgacgacatcattcttctatccgatggtcagatcgtataccaaggtccccgagaaaacgtactagaattcttcgagcacatggggtttcgatgccccgagagaaaaggagtagccgatttcttgcaggaagtgacgtcgaagaaagatcaagaacagtaccggatacaaaaagacgaaacttacgagtacgtttctgtccaagagttttccgaagcattccggtcgttccgtatcggtcaagagctcggcgatgagctggcggttccgttcgacaaggaaaagagccaccctactgcactaaccaccgataaatacggcgtcagcaaaaaagagcttctgaaagcgtgcgtggctcgagaatatctgttgatgaagcggaattcgttcgtctacatattcaagatgctacaacttatcattgtagctagcatttcattgacgttgtttctgcgcacggaaatgccgaagaataacgtgacggacggcggaatatacttgggtgctctgtttttcgcgcttattatgattatgttcaacggattctcggagctcgcactcagtattatgaaactcccggtttttttcaagcaacgggatcttttgttttttcctccgtgggcatatactttgccttcgtggattctcaagattccgatcacactcgtcgaagttgctatttgggtgggtatgacttactatgccacgggatacgattctgacgccggaaggtttttcagacaactgcttctgcttatatgtgtgaatcaaatggcttcggcgctgttccgtttgatgggggcgctaggacgaaacctcatcgttgcgaatacgtttggttcgtgcgcattgctcacggttttcgtcttgggtggtttcattttatcacgagatgatatcaaaaaatggtggatatggggtttctggacttcgcctttgatgtacgggcagaacgccatcgcggtgaacgagtttctcggaaagagttggagtcataaatgttcgttttttacagctcgagggcttttttcggaagcacgatggtattggattggtgtcggagcgattatcggatacgtgttcctattcaatttcctagttaccgttgctctgacttatttgaacccgttcgggaaaccacaagcgattctaccggaagaagcagtagcggagaggaatgcgggacgaggagacgatgttcggagaagttcgtcgtcgggatccatgtcatcaagagtcggcacggttatcggtaatgccgatccaaaccggaagagaggaatgattttaccgttcgagcctctttcgatcacattttgcgatatccgttacgcagtagatatgccacaggaaatgaaagctcaaggaattcaagaaaaccgactcgagctgctgaaaggcgtgagcggtgctttccggcccggagttttgacggcgctgatgggcattagtggggccggtaaaaccactttaatggatgtattagcgggtcggaaaaccggtggttatataaacgggacaatcactatatcgggttacccgaaaaagcaagaaacgttcgcacgtattgcaggatactgcgagcaaaccgacattcactcacctcacgtcacggtccacgagtccttacaattttccgcgtggatgcgcttgcctcccgaagtcgacactgcaacgagaaagatgtttattgaagaggtgatggagctagtcgagcttacaccgctgagagaagcgctcgtgggcttgcccggagtgaacggactttcgaccgagcagagaaagaggctaacgattgcggtcgaactcgttgcgaatccatcgatcatatttatggacgagccgacttcgggcctcgacgcaagagctgctgcaattgtaatgagaaccgttagaaacacagtcgatacaggtcgaacggttgtttgcactatccatcaaccgagcatcgacattttcgatgcctttgacgagctattactactcaaacgaggaggcgaagaaatatacgtgggccctttaggccgacattcttctcagctaattaaatactttgaggaaatcgacggaatcagtaaaatcaaagacggttataatccagctacgtggatgctcgatataacctcgacggcacaagaagcagctctcggcgtcgattttgccgaactatataagaactccgaactttgcaggaaaaacaaagcgctgatcgaggagctaactgtaccgatcccgggttcgaaagatttgtacttctcgaaacggtactcgcaatctttctcgactcaatgcatggcttgcctgtggaagcagcactggtcgtattggagaaaccctccgtacacggcagtaaggctgctatttacgacgttcatcgcgttacttttcgggactattttttggggtattgggtccaaacgggagcgacagcaagacgtgttcaacgcaatgggttcgatgtacgttgccgttctatttctcggcatacaaaatgctacgtcggttcaaccggttgttgcgattgagagaacggtcttctacagagagagagctgctggaatgtactcggctttgccgtatgcgtttggacaggctgtaattgaattgccttaccttctgattcaaacactcatatacggtgtgattgtgtatgcgatgatcgggttcgaatggacggtcgtgaaattcttttggtacattttcttcatgtatttcacgctgatgtacttcacgttttacgggatgatgacggtggcggtgacgccaaaccacaacatagccgccattgtttcgtcggcattctacgggttatggaatctcttctccggattcatcattccaaaaacaagaatcccggtgtggtggagatggtactactacgcttgcccaatagcttggacgctgtacggattggttgcttcgcaattcggtgacgtgcaagataggctcgacactgatgaaacagttgcagaattcgtgcacagttatttcggatttcaacacgattttgtgggatacgttgcgataatcatcactggattagctgtgctcttcggcttcatttttgccttctcgatcagagctttcaacttccagaaaagatagat

SEQ ID NO: 2155 - DNA, 1483 bp, Pennisetum glaucum
gtgcggatggtggctaccgagtgcgagaccggtggccgtgttgtgaggaaccgcatggcggctcagcgcgctgagcctggccgcttcgtgctgtggcagatggccccggagatgtggtacattgagctggccgtcggtgggagcaaggtgcatgccggctgcaacggcaagcttgtgtggcgccatacaccatggcttggtgcacatgccgccaaggggcctgttcgtccactccgccgtgctcttcagggcttggatccgttgactgcagcaagcatgtttgctggtgcaaggtgcattggtgagaggaaggtgaatggggaggattgcttcattctgaagctgtgtgctgatcctgagacgctgagagcgcgtagcgaggggcttgcagagattattcgtcatgtcctttttgggtacttcagccagaagaccgggcttcttgtccatcttgaggactcacacctcaccagaatccagtcaacaacaggaggagatgcagtttactgggagactaccatcaactccttcattgaggactaccgtccagttgagggtattatgattgcacattctgggcgctcagccgtgaccctgttccgttttggggaggcggccatgagccacaccaagactcgtatggaggaggcatggagtatcgaggaggttgcgttcaatgtccctggcctctccatggattgtttcatcccgcccaccgatatcaagtctggatctgtcagtgagactgttgagcttccgcagggtgagaagagcaaggtcggtcttcttccatgccatcgtgctaaggttgcggctctagagaaggcagatgataacgttgcgtggagtggagccctacagctagattgcaagtgattggtagccagtccgtgcgcttcttgcattccaactcactgattttgatggatgtagggtagaaacaaagagctaaggaggatttggagctttaccattccaaatgtcctctgtaaataggaagcttaaggcgctcacatggccttccatatccgagaggaggccttgtgtgaagaatcctggctgatctcatcctgagatttggtagtaggtagtcttgtctgtaacttgtgtctttcttctgtcggtacctcatggatgaagaaccatgggtgttctccatctaaccacatgatacggatcatggcggtggtgcttctttctgtcatagtcacactaatcatcggaggccagcgaggaagaaggatttcttcgcgggcaattgagagtgatttcatcgtcgttgttgagtctaattagcagcagtccagtacggttgggttggtgatagtctgtggtcaaactaacttttagggggggaattatgtaagctgtgggtggtcctgatgggggtcaggctgtgtacccttttccttcacatctcttatttagtatgagatggtggttgtattctacagaagtttgatgtaagccaaaacttctatga

SEQ ID NO: 2156 - DNA, 1317 bp, Pennisetum glaucum
aagcttgtgtggcgccatacaccatggcttggtgcacatgccgccaaggggcctgttcgtccactccgccgtgctcttcagggcttggatccgttgactgcagcaagcatgtttgctggtgcaaggtgcattggtgagaggaaggtgaatgggggaggattgcttcattctgaagctgtgtgctgatcctgagacgctgagagcgcgtagcgaggggcttgcagagattattcgtcatgtcctttttgggtacttcagccagaagaccgggcttcttgtccatcttgaggactcacacctcaccagaatccagtcaacaacaggaggagatgcagtttactgggagactaccatcaactccttcattgaggactaccgtccagttgagggtattatgattgcacattctgggcgctcagccgtgaccctgtccgttttggggaggcggccatgagccacaccaagactcgtatggaggaggcatggagtatcgaggaggttgcgttcaatgtccctggcctctccatggattgtttcatcccgcccaccgatatcaagtctggatctgtcagtgagactgttgagcttccgcagggtgagaagagcaaggtcggtcttcttccatgccatcgtgctaaggttgcggctctagagaaggcagatgataacgttgcgtggagtggagccctacagctagattgcaagtgattggtagccagtccgtgcgcttcttgcattccaactcactgattttgatggatgtagggtagaaacaaagagctaaggaggatttggagctttaccattccaaatgtcctctgtaaataggaagcttaaggcgctcacatggccttccatatccgagaggaggccttgtgtgaagaatcctggctgatctcatcctgagatttggtagtaggtagtcttgtctgtaacttgtgtctttcttctgtcggtacctcatggatgaagaaccatgggtgttctccatctaaccacatgatacggatcatggcggtggtgcttctttctgtcatagtcacactaatcatcggaggccagcgaggaagaaggatttcttcgcgggcaattgagagtgatttcatcgtcgttgttgagtctaattagcagcagtccagtacggttgggttggtgatagtctgtggtcaaactaacttttaggggggggaattatgtaagctgtgggtggtcctgatggggggtcaggctgtgtacccttttccttcacatctcttatttagtatgagatggtggttgtattctacagaagtttgatgtaagccaaaacttctatga

SEQ ID NO: 2157 - DNA, 2094 bp, Sorghum bicolor
tccaccaattcaccaacaggtccctgccatccccagcccggccatggacaccaagaagcagggcttcttctccgcgctacgggaggaggtggcgcgcgggctgtcgccgggccgcgcgcggcggcggtcggcgtccaacgccgcggaggtggcggcggcgctgcgccgctcatggagggcccggatccggaggcgtgccccggcgcgaactgcggcggcgccggcgcgcggagggaggggtgggggcagtgggtgcgtggccagctccagctcgcgcgcgcgccggcgggggcgggggcggacgccggggccggggccgggcccgccgccgccgccaggcggaacgacctcaggctcctgctcggcgtcatgggcgcgccgctcgcgcccgtgcacgtctgcgccgccgagccgctgccgcacctcagcatcaaggacacccccattgagacctcgtcggcgcagtacatcctccagcagtacctggctgcctccggcgggcagaggctgctttcctctatccggaactcgtatgctatgggcaaggtgaggatggtggctaccgagttcgagaccggtggccgcgtcgtgaggaaccgcatggcggcgcagcgcgccgagcctgggcgcttcgtgctgtggcagatggcaccggagatgtggtacattgagctggctgtcggtgggagcaaggtgcacgccggctgcaatggcaagctcgtgtggcgccacaccccgtggcttggcgcacattctgccaagggccctgttcgcccacttcgccgtgctcttcagggtctagatccattgactgcagcaagcatgtttgctggtgcaaggtgcattggcgagagaaaggtgaacggggaggattgcttcatcctgaagctttgtgctgatcctgagacgctgagagcacgcagtgaggggcttgcggagatcatccggcatgtcctctttgggtacttcagccagaagactgggcttcttgttcatcttgaggactcacacctcacccgaatccagtcaacaaccggcggagatgcagtttactgggagactaccatcaattcattcatcgaggactaccgtccggtggagggtattatgattgcacattctgggcgctcagctgtgaccctcttccggttcggggaggcggccatgagccacaccaagacccgaatggaggaggcatggagcatcgaggaggtcgcgttcaatgtccctggcctctccatggattgtttcatcccgcccactgatatcaagtctggatctatcagtgagaccgttgagcttccacagggtgagaagagcaaggtcggtcttctcctctgtcatcgtgctaaggttgcagctctagagaaggcagatgataacgtcgcgtggagcggagccctacagctagattgcaagtgattggtagcccactgatactcgcgccttcttgcattccaactgactgattttgatggatgtagggtagagagacaagagagctaaggaggatttggagctttataccatcccaaatttcctctgtaaataggaagctgcttaaggcactcacatggccttccatatcccagaggaggccctgtgtgaagaatcctgtctgatctcatccggaggatttggtagtaggtagtcttgtctgtaactttgtgtctttcttctgtcggtacctcatggacggaagaaccaatgtaggtgttcttccccgtccagccacatgatatggatcattgtgggcggtgcttcttgctgtcataggcaaaactaatcatcggaggccagcgaggaagaaggatttctttgcgggcaattgagagtgatttcatttcaccgtcgtcgttgttgagtctgattagcagcagtccagtatgctttggttggtgattagtctgtggtcaaactaacttttagggggaggcaaattatgtaagctgtgggtggtcctgatcctgggggtcaggctgtgtaccctttttccttcacatctctcttatttagtatgagatggtggttgtattctacagaagtttgatgtaagccaaaacttctatgaatatcatggcttgaatttttttt

SEQ ID NO: 2158 - DNA, 1607 bp, Saccharum officinarum
acatcctgcagcagtacctggctgcctccggcgggcagaggctgctttcctccatccggaactcgtatgccatgggcaaggtgaggatggtggctaccgagttcgagaccggtggccgcgtcgtgaggaaccgcatggcggcgcagcgcgccgagcctggccgcttcgtgctgtggcagatggcgccggagatgtggtacattgagctggctgtcggtgggagcaaggtgcacgccggctgcaatggcaagcttgtgtggcgccacaccccgtggctcggcgcacattccgccaagggccctgttcgcccactccgccgagctcttcagggtctggatccattgactgcagcaagcatgtttgctggtgcaaggtgcattggcgagaggaaggtgaatggagaggattgcttcattctgaagctttgtgccgatcctgagacgctgagatcccgcagcgaggggcttgcggagatcatccggcacgtcctctttgggtacttcagccagaagactgggcttcttgtccatcttgaggactcacacctcacccgaatccagtcaacaaccggcggagatgcagtttactgggagactaccatcaattcgttcatcgaggactaccgtccggtggagggtattatgattgcgcattctgggcgctcagctgtgaccctcttccgtttcggggaggcggctatgagccacaccaagacccgaatggaggaggcatggagcatcgaggaggttgcgttcaatgtccccggcctctccatggattgcttcattccgcccactgatatcaagtctggatctatcagtgagaccgttgagcttccacaaggtgagaagagcaaggtcggccttctcccatgtcatcgtgctaaggttgcggctctagagaaggcagatgataacgtcgcgtggagcggagccctacagctagattgcaagtgattggtagcccgctcatactcagccttcttgcattccaactgactgattttgatggatgtagggtagagacacaagagagctaaggaggatttggagctttaccattccaaatttcctctgtaaataggaagctaaggcactcacatggccttccatatcccagaggaggccctgtgtgaagaatcctatctgatctcatccggagatttggtagtaggtagtcttgtctgtaattttgtgtctttcttctgtcggtacctcatggacggaagaaccagagggtggcgttcttctccgtccagccacatgatatggatcatggtgggcggtgcttctttctgtcacagccaaaactaatcatcggaggccagcgaggaagaaggatttctttgcgggcaattgagagtgatttttcaccgttgtcgtcatcgtcgttgagtctaattattagcagcagtccagtatgctttggttggtgattagtctgtggtcaaactaacttttagggggaggcaaattatgtaacttgtgggtggtcctgaccggggtcggtcaggctgtgtaacttgtggctgcagtccagtatgagatggtgggtgtattctacagaagtttgatgtaaagccaaaacttctatgaatatcatggctt

SEQ ID NO: 2159 - DNA, 1410 bp, Avena sativa
ggctgttggtgggagcaaggtgcatgctggaagcaatggtaagctcgtctggcgccacaccccatggcttggcgctcattctgccaagggacctgtacgccctctccgccgcgcacttcagggcctggatcctttgactacagcgagcatgtttgctggtgcacgctgcatcggcgagaggaaggtgaatggggacgattgcttcattctgaagctgtgtgctgaccctgagacgctaagagcacgcagcgaggggcttgcggagatcatccggcatgttctctttgggtacttcagccagaagaccgggcttctcgtccacctggaggattcacacctcacccgaatccagtccaccactggaggggatgcagtttactgggaaactaccatcaattcgttcatcgaggactaccggccagtggatgggataatgattgcacattctggacgctcggcggtgacccttttccggttcggagaggtcgccatgagccacacgaaaactcgcatggaggaggcatggagcatcgaggaggtcgcgttcaatgtcgcaggtctatccatggactgcttcatcccacccactgatatcaagtctggatccatcagcgagactgttgagctcccgcacagtgggaagagcaaggccggtcttctcccgtgccatggtgccaaggttgccgcggcggatggtaacgttgcgtggagcggagcctggagcgagattgcaagtgatactatggtctgttcatactgctccttgcagtgctactgactcattttgatggatgtagggtacaaagaaagggctaaaggaggatttggatctttggaattccaagtgtcccctgtaaatagggaaggctgagcaaccacatggccttccacatccctgaggagaggccttgtgtgaagaatcctttctgatctcattcagagatatggtgtagtagattactttctgttttgttttcgttagtacttgtggaagaagaaccaggggcgttctcctcctccatccaaccacatgataagtaaggatcatggtggtggtgctgctcctttcttggtagcaattacactaattatcagaggccagcgaggaagaaggatttcttcgcgggcaaatcgagagtgatttgatcttctaattagcagtccagtgtgctttggttgtgacaagtctccggtcaaactaacttttaggggaaactgggaaggtccagggtggttgttgctctctttttttaagtgttccatatcatgggtctagctgttttccccctttgtccttgacgccatctctcttatttagtcagaagagatggttggtggttgtgttctacagaagctgagatgtaatccaaaaacttctatgaatgccatggatcgaggtgttgtgcactt

SEQ ID NO: 2160 - DNA, 2150 bp, Setaria italica
gtcctccccgccctgtccatggaaaggcttcttcgctgccctgcgggaggaggtggcgcgcgggctgtcgccggcccgggcgcgccgcaagtccgaggcggcggacctcgccgccgcgttcaggttcgccggcggcggtgggggtggtggcgagatgctggcgccgctcatggaggggcccgatccggagtccggcgacggggagggctgcggcgcggcggcggcagaggagcgcgcgggaggaaggaagggtgggggcactgggtgcgcggccagctcgcgcgcgccccgtcctcagtggccgcggcggccgccggcgccggcgcgacgcgcaacgacctcaggatgctcctcggcgtcatgggcgcgccgctcgcgcccgttcaggtctgcaccgccgagccgctcccacacctcagcgtcaaggacactcccctcgagacctcgtcggcacactacatcctgcaacagtacctcgcggcctccggagggcacaagcttctggcgtccgtgcgcaacgcctacaccatgggcaaggtgcgcatggtggccactgaacacgagaccgccggccgcctcaccaagaaccgcaatgctggacgcggcggcgagcccggccgcttcgtgctgtggcagatgcaccagagatgtggtacatcgagctggctgtcggtgggagcaaggtgcacgcagggtgcaatggcaagcttgtgtggcgccacaccccatggcttggtgcccatgctgccaagggccctgttcgccagcttcgccgtacccttcagggcttggatccactgatcacggcaagcatgtttgctggtgcacggtgcattggggagaagaaggtgaatggggaggattgcttcatcctgaagctgagcacagacgctgagaccctcaaggcacgcagcgaaggctttgcagagatgatcaggcatgtcatgttcgggtacttcagccagaggactggtcttcttgtccacatcgaggattcacatctgacccggattcagtcaaacactggaggggatgcaatctactgggagactaccatcagctcgttcatggaggattaccgtccagtggatggtataatgattgcacattctgggcgctcggttgtgacccttttccggtttggtgaggtggccatgagccacaccaagactcggatggaggaggtgtggagcattgaggaggtcgcgttcaacgttcctgggctgtccatggactgtttcatcccacccactgatatcaagtctggatctgttgacgagactatggagcttactaatggagagaggagcagggccggtcctcccccaggccaccgtgctaaagttgctgcgcttgagaaggcagaagaagataaagtggcatggggaggtggaaccatacttgaaaaccacaactgatctgcagtctgttcatacttggttctcacagtgcagctgctgactctgttgcatctagtgtaggagaaacaagtgaaatgggaggatttggaagtttagtaaatccaaatgcctcccgtgtataggaagaagcatgagattttcacaaggtcttgcacatggtggaagcggatctgtgtgaagtatcctttttctgatctcatccagagatatggtagtaggtagccctatttgctgcttcaggcttttttttgtcagtgcctcctagctgtgttctccatcccgaccacatgagaaggatcattgtggttggttctcttttagctatactaattggtcactgccgtcagcggggaagaaggatttcctcttcctgcaatcggcagtgacttagctgtcattgcatccgattggtggtggttcagtgtgcttctcttggcgatggattcaggtcaagctaacctctcagagagaaaaaaaaaattgaacatctgaatggttgttacttgtgtttttgtactgagtagaacctgttagatggttgttaccagtgtttctaagttttttttttggttcctgaacccccccttggcatctcactatattttaccatgagatgaaaggatttagtgttaaacagaagttcgatgcatgtaatcccaaacatgtttattattctgagtgtcatggattgagctagctgtggctgtgactgtccttaggaggaaatga

SEQ ID NO: 2161 - DNA, 2295 bp, Zea mays
tctcggccacaacactgcgcgctccgcagacgcccaccaagcttccgctattcgccaaaaggtccccttctgccctccgccctatctatccatggaaaggcggcacggcttcttcgcggcgctgcgggaggaggtggcgcgcgggctgtcgccggcgcgggcgcgccgcaagccggacgccacggacctggccgccgcgctcagcttcaccggagtggcaggcgccggcgagatgctggcgccgctcatggaggggcccgatccggagcccagcgacgacggggacggcagcggccgccgaggtgccgcgcgcgggaggaaggaaggctggggccactgggtgcgcgtgcagttcgcgcgggccccgtcctcggcggtcgcgctgcgcagcgacatcaggatgctcctcggcgttatggctgcgccgctcgcgccggtccgcgtctgcgccgccgagccactcccgcacctcagcgtcaaggacactcccatcgaaacctcgtccgcgcagtacatcctgcagcagtacctcgcggcttccggagggcacaagctcctggcctccctgcgcagcacctacgccatgggcaaggtacgcatggtggccaccgagttcgagaccgccggccgtctcactaagaaccgcagcgctggacgcggcggcgagcctggccgcttcgtgctgtggcagatggcccctgagatgtggtacatcgagctggctgtccgcgggagcaaggtgcacgcgggatgcaacggcaagctcgtgtggcggcacacaccatggctcggtgcccattctgccaagggccctgttcgtccgcttcgccgtgcccttcagggcctggatccgctgacggcggcaagcatgtttgctcgtgcgcggtgcatcggcgagaggaaggtgaacggggaggattgcttcatcctgaagctgagcacggatcctgagatcctcaaggcacgcagcgagggccatgcagagattatcaggcacgtcacgttcgggtacttcagccagaggactggtcttcttgtccacattgaggattcacatctgacccgaattcagtcggccgcgggaggggacgcggtctactgggagaccaccatcagctcgtccatggaggactaccgcccagtggacggtatagtggtggcgcattctgggcgctcggccgtgaccctgttccggtttggtgaggttgccatgagccacaccaagacccggatggaggaggtgtggagcattgaagaggtagcattcaacgttcctgggctgtccatggactgtttcatcccgcccaccgacatcaagtctggatctgttggcgaggccatggagcttgctcatggcgagagaagccgggccggtcctcctccccctcccccaggctgccgcgctaaagttgccgcgctggggaaggcagaagaaggtaaagtggcatggggcggtggaaccgtactcgagaatcaaaactgatccgcagactgtccataaacttggttctcacagccgcgcggctgctgaccctgtttggagtctagtgtaggagagaaacaaacgagtgaaggctgagagaggatttggaagtttggtaaatccaaatgcctcctctgtataggaagaagcatgggggcattcacatggtcttgcatatgattgaagcggatctgtgtgaaacatcctctctctctctctctctctgatcccatccagagagacatggtatggtagtaggtaggtagccttgtttcctgcttcaggcttttctttcttctttgtctgttcctagtgaaaggaaacttagggcatgtttctgcactccagccgcatgagaaagtcgttgtggttggttctcttttagcttatactcctaatttggtcgctgccaccagcgaggaagaagggtttcctcaccagcaaggcaggtgttttggccgtcatggctgggcatccgattggcggcgttcagtgtgtttggcttgctgacggattgagccgaagctaacctctcagtgaagagagagagagagagagagagagagagagagagagagagagagagagagagagagagtagaacatctgaatggtttttacttgtgttttagtactgggtagaacctgttagatgtttgttagtaattagcagtgtttttatttagcaagttgttttttttgttcctgaacctcctttgcatctctctatattttaatcatgagatgaaggatgtactgttattaaacagatggtggatgtaatctaatccaagacatcttttttgagcgtc

SEQ ID NO: 2162 - DNA, 2254 bp, Zea mays
caagcttccgctattcgccaaaaggtccccttctgccctccgccctatctatccatggaaaggcggcacggcttcttcgcggcgctgcgggaggaggtggcgcgcgggctgtcgccggcgcgggcgcgccgcaagccggacgccacggacctggccgccgcgctcagcttcaccggagtggcaggcgccggcgagatgctggcgccgctcatggaggggcccgatccggagcccagcgacgacggggacggcagcggccgccgaggtgccgcgcgcgggaggaaggaaggctggggccactgggtgcgcgtgcagttcgcgcgggccccgtcctcggcggtcgcgctgcgcagcgacatcaggatgctcctcggcgttatggctgcgccgctcgcgccggtccgcgtctgcgccgccgagccactcccgcacctcagcgtcaaggacactcccatcgaaacctcgtccgcgcagtacatcctgcagcagtacctcgcggcttccggagggcacaagctcctggcctccctgcgcagcacctacgccatgggcaaggtacgcatggtggccaccgagttcgagaccgccggccgtctcactaagaaccgcagcgctggacgcggcggcgagcctggccgcttcgtgctgtggcagatggcccctgagatgtggtacatcgagctggctgtccgcgggagcaaggtgcacgcgggatgcaacggcaagctcgtgtggcggcacacaccatggctcggtgcccattctgccaagggccctgttcgtccgcttcgccgtgcccttcagggcctggatccgctgacggcggcaagcatgtttgctcgtgcgcggtgcatcggcgagaggaaggtgaacggggaggattgcttcatcctgaagctgagcacggatcctgagatcctcaaggcacgcagcgagggccatgcagagattatcaggcacgtcacgttcgggtacttcagccagaggactggtcttcttgtccacattgaggattcacatctgacccgaattcagtcggccgcgggaggggacgcggtctactgggagaccaccatcagctcgtccatggaggactaccgcccagtggacggtatagtggtggcgcattccgggcgctcggccgtgaccctgttccggtttggtgaggttgccatgagccacaccaagacccggatggaggaggtgtggagcattgaagaggtagcattcaacgttcctgggctgtccatggactgtttcatcccgcccaccgacatcaagtctggatctgttggcgaggccatggagcttgctcatggcgagagaagccgggccggtcctcctccccctcccccaggctgccgcgctaaagttgccgcgctggggaaggcagaagaaggtaaagtggcatggggcggtggaaccgtactcgagaatcaaaactgatccgcagactgtccataaacttggttctcacagccgcgcggctgctgaccctgtttggagtctagtgtaggagagaaacaaacgagtgaaggctgagagaggatttggaagtttggtaaatccaaatgcctcctctgtataggaagaagcatgggggcattcacatggtcttgcatatgattgaagcggatctgtgtgaaacatcctctctctctctctctctctgatcccatccagagagacatggtatggtagtaggtaggtagccttgtttcctgcttcaggcttttctttcttctttgtctgttcctagtgaaaggaaacttagggcaagtttctgcactccagccgcatgagaaggtcgttgtggttggttctcttttagcttatactcctaatttggtcgctgccaccagcgaggaagaagggtttcctcaccagcaaggcaggtgttttggccgtcatggctgggcatccgattggcggcgttcagtgtgtttggcttgctgacggattgagccgaagctaacctctcagtgaagagagaaagagagagagagagagagagagagagagagagagagagagagagagtagaacatctgaatggtttttacttgtgttttagtactgggtagaacctgttagatgtttgttagtaattagcagtgtttttatttagcaagttgttttttttgttcctgaacctcctttgcatctctctatattttaatcatgagatgaaggatgtactgttattaaacagatggtggatgtaatctaatccaagacatcttttttgagcgtc

SEQ ID NO: 2163 - DNA, 1478 bp, Panicum virgatum
  misc_feature (474)..(474): n is a, c, g, or t
  misc_feature (559)..(559): n is a, c, g, or t
  misc_feature (611)..(611): n is a, c, g, or t
  misc_feature (631)..(631): n is a, c, g, or t
  misc_feature (636)..(636): n is a, c, g, or t
  misc_feature (642)..(642): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (672)..(672): n is a, c, g, or t
cctccattctgctcccctccctccctgtccttttccgctcagccccctctccttcccatatattcgcgccccgctccacgccccccgctccttgtctcacaccgcaaccgcaagtgccttgggccccttctccaggggagctcgaggtttcctctatttgcgaacaggtccctaccccggcgcttccatcctcccgccatggacaccaagaaacaaggcttcttctccgcgctgcgggaggaggtggcacgcgggctgtcgccggcgcgggcgcggaggcgctcggcgtccaacgcggccgaggtggcggcggcgctgcgcgtggccggaggggcgggggaggcgctcgcgccgctcatggagggcccggatccggaggcggccccgggcgccggcggcggcgcgcggcgggaggggtggggccagtgggtgcgcggccagctccagctcgcgcgcgcgccggcgtccgcggcngcggcggacgcgggcgccgcgcggcggaacgacctgaggctgctgctcggcgtcatgggcgcgccgctcgcgcccgtgcacgtcngcgccgccgagccgctgccgcacctcagcatcaaggacacccccattgaganctcgtcggcgcagtacatcntgcancagtanctggctgcctcnggnggncagaggctgctntcctccatccggaacgcctatgccatgggcaaggtgaggatggtcgctactgagttcgagaccggtggccgtgttgtgaggaaccgtatggcggcgcagcgcgccgagcctggccgcttcgtgctgtggcagatggtcccagagatgtggtacattgagctggccgtcggtgggagcaaggtgcacgcaggctgcaatggcaagcttgtgtggcgccacacaccatggcttggcgcgcatgccgcgaagggccctgtccgcccactccgtcgtgctcttcagggcttggatccattgactgcagcaagcatgtttgctggtgcaaggtgcattggcgagaggaaggtgaatggggaggattgcttcatcctgaagctgtgtgctgatcctgagacgctcagagcacgcagtgaggggcttgcagagatcatccggcatgtgctctttgggtacttcagccagaagaccgggcttcttgtccatatggaggactcacacctcacccgaatccagtcaacaacgggaggcgatgcagtttactgggagactactatcaattcctttattgaggactaccgtcccgtggagggtattatgattgcacactctgggcgctcagctgtgaccctattccgttttggggaggcggctatgagccacaccaagactcgtatggaggaggcatggagtattgaggaggttgcattcaacgtgcctgggcctctccatggattgtttcatcccgcccactgatatcaagtctggatctgtcagtgagactgttgagcttccgcaaggtgagagag

SEQ ID NO: 2164 - DNA, 772 bp, Pseudoroegneria spicata
ggcgtgtcgtgaggaaccgcatggcggcgcgctgtgctgagcctggccggtttgtgctgtggcagatggctccggagatgtggtacattgagctggctgttggtgggagcaaggtgcacgccggatgcaacggcaagctcgtctggcgccacactccatggcttggtgcacattctgccaaggggcctgtccgccctctccgccgctcgcttcagggcctggatcctttgaccacggcgagcatgtttgctggtgcacgctgcattggagagaggaaggtgaatggggacgattgcttcattctgaagctgtgtgctgatcctgagacgctaagagcacgcagcgaggggctcgcggagatcatccggcatgtcctctttgggtactttagccagaagaccgggcttcttgtccacctcgaagattctcacctcactcgtattcagtccacaaccggaggtgatgcggtttactgggagactaccatcaattcgttcatcgaggactaccggccagtggaggggattatgattgcacattccgggcgctccgcggtgaccctcttccgtttcggagaggtggccatgagccacacgaagactcgcatggaggaggcatggagcatcgaggaggtcgcgttcaacgttcccggtctctccatggactgcttcatcccacccaccgatatcaagtctggatccatcagtgagactgtcgagcttccgcagagtgggaagagcaaggtcggcggtcttctcccatgccatggcgc

SEQ ID NO: 2165 - DNA, 775 bp, Festuca arundinacea
  misc_feature (415)..(415): n is a, c, g, or t
  misc_feature (418)..(418): n is a, c, g, or t
  misc_feature (469)..(469): n is a, c, g, or t
  misc_feature (517)..(517): n is a, c, g, or t
  misc_feature (532)..(532): n is a, c, g, or t
  misc_feature (564)..(565): n is a, c, g, or t
ggcacgaggccgccctctccgccgcgcacttcagggtctggatcctttgaccacagccagcatgtttgctggtgcacgctgcattggcgagaggaaggtgaatggggatgattgcttcattctgaagctgtgtgctgatcctgagacgctaagagcacgcagcgaggggcttgcagagatcatccggcatgttctcttcggctactttagccagaagaccgggcttcttgtccaccttgaggattctcacctcacccgaatccagtccacggctggaggggatgcagtttactgggagactaccatcaattcattcatcgaggactaccggccagtggagggcataatgattgcacattccgggcgctcggccgtgacccttttccgtttcggagaggtcgccatgagccacacnaanactcgcatggaggaggcatggagcatcgaggaggtcgcgttcaatgttccnggtctctccatggactgcttcatcccacccactgatatcaagtctggntccatcagcgagacngtcgagcttccgcacagtgggaagagcaaggnnggtcttctcccatgccatggtgctaaggttgctgctttagagaaggctgacggtaacgttgcgtggagcggagccctgcagcgagattgcaagtgatttacggtctgttcatactgctccttgcagggatactgactcattttgatggatgtagggttagaaagaatgggctaaaggaggatttggatctttggaattccaaatgtcccc

SEQ ID NO: 2166 - DNA, 1637 bp, Phaseolus coccineus
  misc_feature (148)..(149): n is a, c, g, or t
  misc_feature (213)..(213): n is a, c, g, or t
  misc_feature (1164)..(1164): n is a, c, g, or t
  misc_feature (1166)..(1166): n is a, c, g, or t
  misc_feature (1191)..(1191): n is a, c, g, or t
cacagaaaatactcagacacccacgttcacacctcgcacacaccatccctccttgtttcttcttcctcatcccttcttcttcttcttctcttccttttttcccttcttcatggaatgatggaacacaacatcatcggcaacaccaacnncgggatcgcaccgtttgtcattaaaacctacaacatggttaacgatcccaccaccgataaactnatcacgtggggccctgccaacaacagcttcatcgtcctcgatcccctcgacttctcccactctctgctccctgctttcttcaagcacaacaacttctccagcttcgttcgccaactcaacacctacgttagtatcactcacctcactctctaacccaaccaacaaattcaattcttacacttctttttcaacagttctttgctcttaatttatgcttccccacaatgtaaacttttcataaaaaacatggattactcatttcaattttgcagtatcattgaagtcttaagtttaatacaaatctttcctaaatatatagctttaaatttcgaagaaaaggttagttttaataatcgaatttatatgtgagttatgggcaacgtataaattacccatgtaaagaatatgaattttttttgagttttgttcaatttggactgaacccagtttcagaaagttagatttttctttctgggtatctcttgttttttctaaattcgggagctttaatatgttttaatttatgttggttaggctttcagaaaggtggacccggatcggtgggaattcgcgaacgagtggttcctgcgggggcagaagcatttgttgaggaacatcgtgcggcggaagcacggcggagggaggagcaacaattcgcaatcgcatttgcatgccctgaagtttgaggagttggacgacgatgccatggtgatggagatagcgaggttgaaggaggagcagaaagctttggaggaagagcttcaaggaatgaacaagaggttagagacaacggaaaaacgaccgcaacaaatgatggcttttctgtcgaaggttgtggaagacccgcaggttctctctcggattctccgagaaagagaaaaaaaacacctcggcgagaaaaagcgacgcctcctcattcctccgccttcgacggcggcgacctcctcctcntnctcctccggcatcaagacggagttngaagaagacgaaggtaacatcatgtcttcatcgccggagacgggtttggaaatcgataataataataatattatttgttcgccggtgacggcggggtattggggggaacaagggtgttatgggtataattgcggcggagtaacgacgccgttgacggtggtgacgccggctgcgccggcgatgggtggaggatatttggggcgtgggagtttgtttggggaaatggcggcggaggggagtgcgctgccgccttatccgttttcgctgttggaaggtgggttttagatttagtttttattttttaggttatgatatgaatgaattatttctgccacaagattttatcttggattctgtcctttgttttgaaagttctatccttttgtgcgttgattctgtgtaaagaaaaggggaaaagaaagaagaaaaatatctatttttgttag

SEQ ID NO: 2167 - DNA, 1303 bp, Vigna unguiculata
ctctcttacacacacacacactttctctctctttcactcactctcactctctgtcacggacagagaaaaactcagacacccacgttcacacttcgcacacaccatccctccttgtttcttcttcttcatcttcctcttgttctgttccttttctcttttttcttcatggaatgatggaacacaacatcatcagcaacaccaacaacatcaacaacgtgatcgcaccgtttgtcataaaaacctacaacatggttaacgatcccaccaccgataaactcatcacgtggggcccagccaacaacagcttcatcgtcctcgaccccctcgacttctctcactcactcctccctgctttcttcaagcacaacaacttctccagcttcgttcgccaactcaacacctacggtttcagaaaggtggatccggatcggtgggaattcgcgaacgagtggttcctgcgggggcagaagcatttgttgaggaacatcgtgcggcggaagcatggcggaggtaggagcagcaatttgcatttgcataccctgaagctggaggagttggacgacgaggccatggtgctggagatagcgaagttgaaggaggagcagaaagcgttggaggaagagcttcaaggaatgaacaagaggttagagacaacggaaaaacgaccgcagcaaatgatggcttttctgtcaaaggttgtggaggacccgcaggttctctctcggattctccgagaaagagaaagaaaacacctcggcgagaaaaagcgacgcctcattcctccgccctcgacggcggcgacctcctcctcttcctcgtccggcatcaagacggagttcgaagaggacgaaggtaacaacatcatgtcttcgtcgccggagacgggtttggaaatcgataataacagtaataatattatttgttcgccggcgacggcggggtattggggggaacaggggtgctatgggtataattgcggcggagtaacgacgccgttgacggtggtgacgccggcggcgccggcgatgggaggtgggtattttgggcgtgggagttattttggggaaatggcggcggaggggagtgctctgccgccttatccgttttcgctgttggaaggtgggttttagatttagtttttttaggttatgatctgaatgaattattactgccacaagattttatcttggattctgtctttttgttttgaaagttctatcttttgtgcgtcgattctgtgtaaagaaaaggggaaaagaaaggagaaaaagatttatttttgttaaaaaaaaaaggaaaaaaa

SEQ ID NO: 2168 - DNA, 845 bp, Glycyrrhiza uralensis
ggcgagtcggccttgttggcagaaagaaagaccactacacacactctctctatctctatctgtgactctcactgtcacggacagagagaagcacagactcccacgttcacaccttcacacaactcattcaatccacacctctctctctctctctctttctgtgactctctctgagtggttattacttttttcttcttcttcttcttgtgttcttcttaatgggataatatgatggagcagaacaacaacaacgtgatcgcaccgttcgttgtgaagacttaccacatggtgaacgatccaaccaccgataacctcataaagtggggcccagcaaacaacagcttcatcgtcctcgaccccctcgacttctccatctccctcctccctgctttcttcaagcacaacaacttctccagcttcgttcgccaactcaacacctatggtttcagaaaggtggatccggatcggtgggagtttgcaaacgagtggttcctacgagggcagaagcacttattgaagaacatcgttagaaaaaagcacgttggaggagttggtgggaggaataatcatgattataataattgtaatcttttttatcaacaggggaataaggtggttgaggatttggacgacgacgaggctatggtgacggaaatagcgaagctaaaagaggaacagaaagctttggaggaagagattcaagggatgaataagaggcttgagacaacagagaaacgaccacaacaaatgatggctttcctctgcaatgtcgtcgaggacccacaggttctgtctaggatactcctcgagagggagaaaaagcagcaataccaccacctcgcggt

SEQ ID NO: 2169 - DNA, 519 bp, Lotus japonicus
actgggaaaagaaaagaaaatctcacactactcactgtaaactcatccatattatcaatatccaccctctctttctgtgtagtttcatcttctccttcttgttttcttaatgggatgctgatggaccagaacaacaacaccaaccttaacactaccaacaacaacaccaacaacgatgtgatcatcgcaccgttcataatgaagacttaccacatggtgaacgatcccaccaccgataacctcatcaagtggggcccagctaacaacagcttcatcgtcctcgaccctcttgatttctctcactctctcctccctgctttcttcaagcacaataatttctcaagcttcgttcgccagctcaacacctatggtttcagaaaggtggatcctgatcggtgggagtttgcaaacgagtggttccttcgtgggcagaagcatttgttgaagaatatcacacggcggaagcacggtggtggcggtggtggcggtggcggtggaaggaatggtcatggtcatggc

SEQ ID NO: 2170 - DNA, 432 bp, Arachis hypogaea
aaaccatcactataacaataataaccataaccgcccttctctctccgcatcttcttctctttgtggtggttattgatggtgtcgattaatgggatggagcagaacaacgtgatcgcaccgttcgttataaagacatatcacatggtcaacgatccgagcaccgattaccttatagcatggggcccagcgaacaacagcttcatcgtcgtcgaccctctcgacttctctcagtctctactccctgccttcttcaagcacaacaacttctccagcttcgttcgccaactcaacacctatggtttcagaaaggtggatcccgataagtgggagtttgcaaacgagtggtttctgagagggcagaagcacttgctgaagaatatagttaggagaaagcacgggacgaggagctataattctttgcatttcaacaac

SEQ ID NO: 2171 - DNA, 1107 bp, Prunus persica
gaagaaaaaagaaaagtcgattccgataaggctctgaaaatacacacgagacagagagagttgcagagagtgagagtgtgtgtgtgagaaacagaaagagaaagagaaggagaaagcgaaggaaaaggggaaaaagacaatccgtatgggatgatgatggaggagaacaacaacgtcatcgcgccgttcgttatgaagacttaccagatggtcaacgatccgacgacggacaagttaatcacttggggccgagccaacaacagcttcatcgtcgtcgaccctttagacttctctcagaggctcttacccgcttacttcaagcacaacaatttctccagctttgttcgccagctcaacacatatggatttcgtaaggtcgatccagataggtgggaatttgcgaacgagtgttttctgcggggccaaacgcatttgctgaggaacgtggtgaggagaaagcacatgggtaagaattcgtattcgaattcgaattcgaattcgaccacgtgcttattacaggggaagcacgaggagctagacgacgaagagatagtgatggagattgcgaggttgaagcaggagcagaaggcgttggaagaagaaatggagaacatgaacaagagattggaggcaactgagagacgaccccagcaaatgatggcttttctgcacaaagatcgtacgttcagggcgcagttgggggagaagaagcggcgggttatgatgataacctcaacgtcgtcgtcttcgtcgggcatgggggccaccaactccgtcaagaccgaagatgaggatgacggaaccgtaggggtaatttcgtcatctcccgaaccgggttttgagatggagagtttttattccacgtctccagagacgtcgacggcgcgagagtgggggacgcagaggcgggtcgtggatcgggttcgggctgtgcaagacccgtataatatgaacccgacggtgtcgggtcatgtgatcgggaatagtagtaattccgggtacgggtatgggaatagaaatgttggtgcgggagtgggttatctcacagaggaacctatccctgcaccaccgccttatccattctcgttgttagagggtggcttttag

SEQ ID NO: 2172 - DNA, 662 bp, Prunus persica
tcgattccgataaggctctgaaaatacacacgagacagagagagttgcagagagtgagagtgtgtgtgtgagaaacagaaagagaaagagaaggagaaagcgaaggaaaaggggaaaaagacaatccgtatgggatgatgatggaggagaacaacaacgtcatcgcgccgttcgttatgaagacttaccagatggtcaacgatccgacgacggacaagttaatcacttggggccgagccaacaacagcttcatcgtcgtcgaccctttagacttctctcagaggctcttacccgcttacttcaagcacaacaatttctccagctttgttcgccagctcaacacatatggatttcgtaaggtcgatccagataggtgggaatttgcgaacgagtgttttctgcggggccaaacgcatttgctgaggaacgtggtgaggagaaagcacatgggtaagaattcgtattcgaattcgaattcgaattcgaccacgtgcttattacaggggaagcacgaggagctagacgacgaagagatagtgatggagattgcgaggttgaagcaggagcagaaggcgttggaagaagtatggagaactgacaagagattggaggaactgagagacgaccccagcaaatgatggcttttctgcacaagtcgcgga

SEQ ID NO: 2173 - DNA, 806 bp, Malus domestica
agaaaacagagagttgcagagaatagttatatgggatgatgatggaggagagcaacaacgtcatcgcaccgttcgttttgaagacttaccagatggttaacgatccaacgacggacaatctaatcacatggggaagagccaacaacagcttcatcgtcgtcgaccctctggtcttctctcagagactgttacccgcttacttcaagcacaacaatttctccagcttcgtccgccagctcaacacctatgtgagcaattaatcatgaaattagtaaattaattaatgggttttgttaattaagtagggaattgaaaaacccagttcgtaattttgattgattttgcagggatttcgaaaggtcgatccagataagtgggagttcgcgaacgagtggtttctacgaggacagacgcatttgctgagaaacgtggcgaggagaaaacaaatgggcaagagttctaacttgaattcgcttttttcgaattcgaattcgaatttcttaccaacgaagcacgaggagctcaacgacgaagatgtaatcatggagatttcgcggttgaagcaggagcagaaggcgctggaggaagaaatcgggaatatgaaccggcggctggagacgacggagcgacggccgcagcaaatgatggcgtttctacacaaagtggcggaggacccggagattctgccacgtatgatgctcgagaaggaccgcgcgacgacggcgcagttgggggagaagaaacggcgggttatgatgatagcatcgacgtcgtcgtcgtcatcggggatgggggccaccacttcc

SEQ ID NO: 2174 - DNA, 576 bp, Trifolium pratense
tttaatattaaatggggatggagcaaaacaacgtgatcgcaccgttcattatgaagacatatcacatggttaacgaaccaaacacagataaccttatcaagtggggtccatcaaacaacagtttcatcgtccttgatccactccaattctctcactcccttctccctgttttcttcaaacacaacaatttctctagctttgttcgtcaactcaacacctacggttttagaaaagtggatccggatagatgggaatttgcgaatgagtattttctaagaggacaaaaacaattattgaagaacatagttaggaagaagcacgttggtggagttggaaatggaaggaacaataataattattttaatgaggtgaaatttgaagatttagaagaagatgaagttatgatgaaggaaatattgaagctaaaagaagaacaaagaattttagatgaagagcttcaaggaatgaacaaaagattagaaacaacagagaaaagaccacaacaaatgatggcttttctttgcaatgtcgttgaagatcctcaaattctatcaagaatactaaatgagagagaaa

SEQ ID NO: 2175 - DNA, 427 bp, Tropaeolum majus
cggccggggacggaataaaaagaagcctaaaagggaaaggagctttcaagtttagaaaagacacaaatccatggaggctaacaacaacgtaatcccaccgtttgttatgaagacttatcagatggtcaacgatccgaccactgattggttgattacctggggaaaagccaataatagcttcatcgtaatcgaccctttagatttctctcatcggatgttacctgtttatttcaaacacaacaacttctctagctttgttcgtcagctaaatacctatggtttcaggaaggtggatcccgacgtatgggagttcgcacacgagtgtttccttcgagggcaaagcagttactgaagaacatagtgagaagaaagcactcgaaaaattcctgtagaggagatatagaggacgaagagatcgtgatggaga

SEQ ID NO: 2176 - DNA, 939 bp, Petunia hybrida
ataatcttttctcttttaaaatacaactaccactatcagtctatcaccaccaatttccgccttattcttccgtaaatagaaagaacttctatatgtgatggaggctaataacaataatattattgcaccatttgttatgaaaacttatcaaatggtcaacgatccaaagattgatggacttatcacttggggaagtgccaacaatagtttcatcgtcattgaccctttagatttctctcaaaaacttttgcctacttatttcaagcacaataatttctcaagctttgttcgtcagctcaacacttatggatttagaaaggtggatccagataaatgggaatttgctaacgaatggtttctaagaggacagacacatttattgaagaacatagtgaggaagaagcatagtaggaataatccatattttcacaagcacgaagaggatgaagaggaagggatgtttacagaaataggcaggttaaagcaagaacagaaattgttagagcaacaacttgaaaacatgacaagaaggttagagacaacagagaaaaggccacaccaaatgatggctttcttgtgtaaagtcgttgaagaccctgaaatattacctaggattatgcttgagaaggaaaataagtcaaagaagctgacttttgaaaatggtgaaaagaaaagaaagcttattatgatgactgaaccttgtaatgccaacacgtgtcctgctacttctagttctttgtcgtcaggttcgtcggagagtggtggttttacgatggctccgctattggataatttctcgaggtatgattacggtggagcaggaattgtggctacggaggaagctagtccaccgccttatccattttctatgttaggaggtggtttttagttttgtcacaagataaccaaaccagcaaacctactgtgattattgctagt

SEQ ID NO: 2177 - DNA, 1453 bp, Citrus clementina
agcgaatgcgccaattcaaacacactaaacaaacggaacgcagcacagcacagcacagcacgcaccctttgttcctccccaccgtctcactctctccttctcttttgagtcttttttcctctgtatgggatggagcccaacaacaccaacaacgtgatcgctccgttcgttatgaagacttatcagatggtcaacgatccaacgaccgattcgctaatctcctggggtaaagccaataacagcttcatcgttgtcgaccctttagatttctcccaaaggatcctgcccgcctacttcaagcacaacaacttctctagctttgttcgtcaactcaacacctacggttttagaaaagttgatccggacaaatgggaatttgcgaacgagtggtttctgcgagggcagaagcacttgctgaagaacatcgtaaggagaaagcacagcagtaacagaagcgctcatcacatgatgatgagaggcggtgccggcgaccaagatttagatgatgaagaaatagtgatggagatagcgaggttgaggcaagagcagaagtctttagatgaagagcttcagggcatgaacaagagactggaagcaacagagaggcgccctgaacaaatgatggcgtttctttacaaagtcgttgaagatcccgacttgcttcctcgcatcatcatggaaaaagaaagcaccaccaacaggaataattattatcttggggacaaaaagagacgcttgatgatctcgtcgtcatcgcagcagcagcaacagccttctaattcttcttcttcgggcatggcagcttcgagctcgataaaatctgaagaagaagaagtgggcaacataggggtgatttcatcttcttccccagattctgggttcgataatagtaataataacaacagtaacaacttttgtcagtcatctccgtcaccagatagtaataataataacaataattacagtgtttcaagttctggctggttattagggcaaagcaggcaagtgatgaatagttatggctgcgccgccattcctagtccggtatcggcgattccggcgacggcgaggaatagtactagtagtggtactagtactaatgggcaaatgggttattttggagaaatggtaacgggggtagagtctcgtccgccaatgccaccttatccattttcattgctaggaggcggtttttagtttgcttatcacaagatttatcttggattctatctttgtattaattttttttttcttttcgctttttggtaattaatatttttttatgttttattattactattattttttttggccgaacagaaagagagagagtgaataaatatgtttttatgtataagttttatttgttgtatatttcacacataatacatgaaatttatgctgcgactttggaggatatgaaattcaatttttgtacataaaagtaagattt

SEQ ID NO: 2178 - DNA, 1317 bp, Quercus alba
cgcaaccatttttgttagcacttaaacttagcccccactccaaacttttgtctacgcctcttctctcaaccaaaaaggataagtgatagagaaagttggagagagagtgtgtgtgtatatgtaatggagggttacaacgtcatcgcgccgttcattatgaaaacttatcagatggtaaatgatccgacgactgacagtctaatcacttgggggagagccaacaacagcttcatcgtcgtcgatcccttagacttctcacagaggattttacctgcctacttcaagcacaacaatttctctagctttgttcgtcagctcaacacctatggattcagaaaggtcgatcctgacaaatgggaattcgcgaacgagtggtttcttcgtggccagaagcacttgttggtgaacatcgtacgtaaaaagcacaatcggagctcgtacacgcagggcaagaacgaagaactagtggaagacgaggacttagtcatggagatagcgaggttaaagaaagaacagaaggacatggaggatgagcttgagggcatgaagaaacgattggaagctacagagaaacggccacagcaaatgatggcgttcctgcacaaagtagctgaagacccagatatcttacccaatttgatgcttcagagagaacgaactaggcagctaataagcgagaagaagcggcggctaatgatatcttctacttcttcgtcttcttcaggcactgtagcagcgacaacaacaacgacaacgagttcaataaagacagaggacgaagatgagggtgcaatcggagtagtaatctcttcgtctccaaatacaggttttaaaatcgaaaacttttgtgaacagtcgtcaccgtcgccggaaactcagacgccggcgtggttgatccaaagtgaggtgatgggtcggtctcagattggccaagagccttttggttgctctgctatgaatggaattggaagtactatggcggtgtcgccgctggaaagcggtgttttgggttatgggaatagtggtgggcaaataagctattttgcagaaatggcggctgggatggaggtgagtccaccaacgccttatccgttttctctattaggaggtggcttttagggctgtagatgcttcacctgatttatctttggattctatatcttttgtattagtttcttttctttttatttatttaattttgttttttgcttcatgttttctcaccctttttttcttctaattttatgtttttgtggtttatgtaaagaaaaataaaagattctaaattatttgttaaagcccgatctctccatcgga

SEQ ID NO: 2179 - DNA, 1455 bp, Citrus sinensis
agcgaatgcgccaattcaaacacactaaacaaacgcaacgcagcaaagcacagcacagcacgcaccctttgttcctccccaccgtctcactctctccttctcttttgagtcttttttcctctgtatgggatggagcccaacaacaccaacaacgtgatcgctccgttcgttatgaagacttatcagatggtcaacgatccaacgaccgattcgctaatctcctggggtaaagccaataacagcttcatcgttgtcgaccctttagatttctcccaaaggatcctgcccgcctacttcaagcacaacaacttctctagctttgttcgtcaactcaacacctacggttttagaaaagttgatccggacaaatgggaatttgcgaacgagtggtttctgcgagggcagaagcacttgctgaagaacatcgtaaggagaaagcacagcagtaacagaagcgctcatcacatgatgatgagaggcggtgccggcgaccaagatttagatgatgaagaaatagtgatggagatagcgaggttgaggcaagagcagaagtctttagatgaagagcttcagggcatgaacaagagactggaagcaacagagaggcgccctgaacaaatgatggcgtttctttacaaagtcgttgaagatcccgacttgcttcctcgcatcatcatggaaaaagaaagcaccaccaacaggaataattattatcttggggacaaaaagagacgcttgatgatctcgtcgtcatcacagcagcagcagcagccttctaattcttcttcttcgggcatggcagcttcgagctcgataaaatctgaagaagaagaagtgggcaacataggggtgatttcatcttcttccccagattctgggttcgataatagtaataataacaacagtaacaacttttgtcagtcatctccgtcaccagatagtaataataataacaataattacagtgtttcaagttctggctggttattagggcaaagcaggcaagtgatgaatagttatggctgcgccgccattcctagtccggtatcggcgattccggcgacggcgaggaatagtactagtagtggtactagtactaatgggcaaatgggttattttggagaaatggtaacgggggtagagtctcgtccgccaacgccaccttatccattttcattgctaggaggcggtttttagtttgcttatcacaagatttatcttggattctatctttgtattaattttttttttcttttcgctttttggtaattaatatttttttatgttttattattactattattttttttggccgaacagaaagagagagagagtgaataaatatgtttttatgtataagttttatttgctgtatatttcatacataatacatggaatttatgctgcgactttggaggatatgaaattcaatttttgtacataaaagtaagattt

SEQ ID NO: 2180 - DNA, 1188 bp, Brassica napus
atagaaagcgataaaagaaaaagagaggagaggaaaaagaaatggaggacgacaataataataacaccaacacaaacgtgatcgcaccttttgttgtgaagacatatcagatggtcaacgacccttcgaccgattggctcatcacttgggggcctgcacacaacagcttcatcgtcgttgatcctctcgacttctctcaacgaatcttgcctgcgtatttcaaacacaacaatttcagcagctttgttcgtcaactcaacacctatgggtttaggaaagtggatccagaccggtgggagtttgcgaacgagcattttctcagaggacagaagcacctgctcaagaacatagcgcgtaggaaacacgcgcgtgggatggtatacggccaggagatggaggacggtgagatcgtgagggagatcgaacggttgaaagatgagcagagagatcttgagtcagagattcagaggatgaaccaaaggatcgaggcgacggagaagcggccggagcagatgatggcgtttctgtacaaggtcgttgaggatcccgacctcctcccgaggatgatgctcgagaaagagcggacaaagctagtctccgacaagaagaagcgtcgtgtcacggtgaagtcagaggacgaggaagaaaacggaagggtctttgggattatttcaccgacaccgtctccgccggagaatctttaccggactcagtcgccggagaattctatgggatgggttgttccgatgcagaagccgggcaactttggtagttacaacgagactggtctgatttccacttcgtcgacgtcatcatcgttaacgtcgacgctgtcgctgccggagagcgtaaacggaggcggcggaggatgtgggagtattcagggagaaacaagagacaaagaagcggcgacgtttggaggagtggtagagtcaaatccacaaacaccgccttatccgttttctttgtttcgaggtggcttttagtcttttagcttcacatgatatatgatctttgtttcttatctattattttttgtttttttgtttttttgtttttcttacctaataatgtataaccaccagaaaaggtagatcgattgttgttagtgacagggagacagagtcagtagtcatatcgttttatagaaagttgacagtatatattttctgattatattgttaaaag

SEQ ID NO: 2181 - DNA, 1461 bp, Ricinus communis
tggttacagtgcgtgtgtccactgattctttcttcaaatcctcatctcctcttcttcttcttcttcttggccttgctccctccatttctgaaacacgcacacacagagagaagaagaaacatactttcctgtcctttttttttttttttatgggatggagagtactaatagtagcaacctcatagcaccgttcgttatgaagacttatcagattgtgaacgatccaacgactgatacactaatcacttggggcaaagctaacaatagcttcatcgtggttgaccctttagatttctctcaaagaatcttgcctgcttatttcaaacacaacaacttctctagcttcgttcgccaacttaacacttacggtttcagaaaagttgatccagatatatgggaatttgcaaacgagtggtttcttagagggcaaaagcagttcttgaagaatatagttcgtaggaaacacagcaaaagctcatgtaagattgaagattttgacaatgaagaactggtaatggaaatagcaaggttaaagcaagaacagagagttttagacgaagaacttgaaggcatgaataagcgtttagaagcaacagaaagacgtcctcaacaaatgatggctttcctttacaaagtggttgaagaccccgatattcttcctcgtatgatgctacaaaaggaacagactaagcaattaaatagtgacaagaagcgtcgtctaatgatttcttcttcctcctcttcctctggcggtgctgctgtttctagctcagtcaagtctgaagaggaagaagaaggtaatattggtgcaatatcctccccagaaagtgggttcggtattgataacaacaataattataataatctttatcagtcttcgccgtccccggagacaaattttatagggtggttaggagatgggaactatggttgcgcggaggtggcgccggcaccaataactggagggattgggaatagtgtgaaactggcggtgtctcctccaccgcagatgccagtgaatggtataatatgttatggtggtggcagtggtggaaatggtggtgatagaggcagtcaaacaagctattttggagaattggcaacggcggtggaggctaaaccaccgccgcctccttatccattttcactcttgggtggtgacttttagtttaattagttgttattcaaagggtttatcttgattcctaccttcctgtgttttttttttctttttccttttttggtatattggtttatccatcttctaatattttgttgtaaaaaagaaaaaagattacttatatgtggttaatatacagtttatattgaaatatttatatttatatgaacatctcattattttttataataaaattatttaaatataaaatatattttttaaaaaatttaatagattatttttatattttgctatatatcaaattctattctgataaaaag

SEQ ID NO: 2182 - DNA, 1432 bp, Citrus sinensis
  misc_feature (14)..(14): n is a, c, g, or t
  misc_feature (1390)..(1390): n is a, c, g, or t
tgcgccaattcaancacactaaacaaacggaacgcagcacagcacagcacagcacgcaccctttgttcctccccaccgtctcactctctccttctcttttgagtcttttttcctctgtatgggatggagcccaacaacaccaacaacgtgatcgctccgttcgttatgaagacttatcagatggtcaacgatccaacgaccgattcgctaatctcctggggtaaagccaataacagcttcatcgttgtcgaccctttagatttctcccaaaggatcctgcccgcctacttcaagcacaacaacttctctagctttgttcgtcaactcaacacctacggttttagaaaagttgatccggacaaatgggaatttgcgaacgagtggtttctgcgagggcagaagcacttgctgaagaacatcgtaaggagaaagcacagcagtaacagaagcgctcatcacatgatgatgagaggcggtgccggcgaccaagatttagatgatgaagaaatagtgatggagatagcgaggttgaggcaagagcagaagtctttagatgaagagcttcagggcatgaacaagagactggaagcaacagagaggcgccctgaacaaatgatggcgtttctttacaaagtcgttgaagatcccgacttgcttcctcgcatcatcatggaaaaagaaagcaccaccaacaggaataattattatcttggggacaaaaagagacgcttgatgatctcgtcgtcatcacagcagcagcaacagccttctaattcttcttcttcgggcatggcagcttcgagctcgataaaatctgaagaagaagaagtgggcaacatagggggtgatttcatcttcttccccagattctgggttcgataatagtaataataacaacagtaacaacttttgtcagtcatctccgtcaccagatagtaataataataacaataattacagtgtttcaagttctggctggttattagggcaaagcaggcaagtgatgaatagttatggctgcgccgccattcctagtccggtatcggcgattccggcgacggcgaggaatagtactagtagtggtactagtactaatgggcaaatgggttattttggagaaatggtaacgggggtagagtctcgtccgccaacgccaccttatccattttcattgctaggaggcggtttttagtttgcttatcacaagatttatcttggattctatctttgtattaattttttttttcttttcgctttttggtaattaatatttttttatgttttattattactattattttttttggccgaacagaaagagagagagagtgaataaatatgtttttatgtataagttttatttgctgtatatttcatacataatacatgnaatttatgctgcgactttggaggatatgaaattcaatttttg

SEQ ID NO: 2183 - DNA, 913 bp, Cucumis sativus
caacacacaccttttatgggatggaacccaactccggtaacaacgacattgttgctccttttgttctcaaaacttatcaaatggtcaacgatcccctcaccgaccctttcatctcttggggctctgctaacaacagcttcatcgttcttgaccctctccatttctcacatactctcttacctgcttttttcaaacataataatttctccagcttcgttcgtcaactcaatacttacgggtttcggaaggtagatccagatagatgggaatttgcaaacgaatggtttctacgaggtcaatttcagttactgaaaaacattgtgaggagaaaacagagttgtaataagtatttggttggggatcagatgggggatgaggaattagtcactgaaattggtagactgagaaaagaacagagggctctggaagaacaacttgaagggatgaagaaacgtcttgaaacaactgagaaacggccacaacagatgatggcttttcttcataaagtggtggaagaccctgaaattcttccaaggatcatgcttcataaagatccaactcggcttcaatttgcagagaagaaacggcggttgatgatttcgtcttcttcctcttccccttccaccactacgctgacggaaggagatgaaatagaagaggacagtaataatcagcaggatttcgggcctaatttatcgtcgccggaggtttgtgggccttggtttataggggaggcggagggtaatttggggattccgattcctacggtgcaggcgattgatatagggataagtagtaacggcggagagagaaagtatttgacggaaatgacagtggaggagacttatccaccaccaccgccttatccattttctcttttcgggtgtggcttttagtaattaattaccttcac

SEQ ID NO: 2184 - DNA, 608 bp, Thellungiella halophila
gaacagcaaacatataaagcgaaagaaaaaagagagagagagagaaaaaaaaaagaaaagagaaaaatggaggacgacaacaataataataacacaagcaacacaaacgtgatcgcaccttttgttgtgaaaacgtaccagatggtcaacgatccttctaccgattggctcatcacttggggacctgcacacaacagcttcatcgtcgttgaccctctcgacttctctcaacggatcttgcctgcttatttcaaacacaacaattttagcagcttcgttcgtcagctcaacacttatgggtttaggaaagtggatccggacaggtgggagtttgcaaacgagcatttcttgagaggccagaagcacctgctcaagaacatagcgcgtaggagaccaatttagatgcgaagatgtgtaagatccgctaaaagacttcttctcaagggtttacttggtttccgataatcagaggaattacaaggaaaataaaaaggaaaggtgagatctgaaggaagaagaagggggaagcagataacatgtctgcgattgtttgcggtaagagatctctgttcgaggacttggccgccgcttctcctcccgtctccaag

SEQ ID NO: 2185 - DNA, 1690 bp, Arabidopsis lyrata
gtcaagcagcttaaatcatctatatgactaaaaattacaataagaaaaaacacagcctaataataatatgcaatggatcaaataacttgtcacataagaaatatattaacaaaacaaaaagggcaaaaaagacctgaaagctttgagacacacctgcataggtcccacagttcactcgtgacaccgtgaaagcaaaaacacgaacccgccacgttacacaaaaagcaagccacgtcaatatagtctcactgtcaactacacttaacttactattttcacattttatttccctattttattttgtttatataaacctaccagcctcctccttaatttctttaccaagagagaaatggaggacgacaatggtaacaacaccaacaacaacaacaacaacaacgtgatcgcacctttcattgtgaaaacatatcagatggttaatgatcctttgaccgattggctcatcacttggggacctgctcacaacagtttcatagtcgttgatccactcgacttctcgcaacgaatcttacctgcttatttcaaacacaacaatttcagcagctttgttcgtcaactcaacacttatgggtttaggaaagtggatccggaccggtgggagtttgcgaacgaacattttctgaggggacagaagcacttgttgaagaacatagcgcgtaggaaacacgcgcgggggatgtacggtcaagatttggaggatggtgagattgtgagagagatcgaacggttaaaagatgagcaaagggagctagaggctgagattcagaggatgaaccaaagaatcgaagcgacggagaagagaccggagcaaatgatggcgtttctttacaaagtcgttgaagatcctgatcttcttccaagaatgatgcttgagaaagaacggacaaagcaacaagtttccgacaagaagaagcgtcgtgtcacgatgtcgacagtgaaagcagaggaagaagaagtcgaagaagacgaagggagggtctttagggttatttcatcatcaacaccgtcaccgtcgtcaacggagaatcttcaccggaatcattcaccggatgggtgggttgttcccatgacgcaaggacagtttggtaattatgagactggtttggtggctaactcgatgctctcgaattcaacgtcgtctacgtcatcatcgttgacctccacgttttcgttgccggagagtattaacggaggaggaggaggaggaggaggaggaggatgtgggaatattcagggagaaagaaggtataaagaaacggcgacgtttggaggagtggtagagtcaaatccaccaacaacaccgccttatccgttttctctgtttcgaggtggcttttagcgtttagcttcacatgatatatgatctttattatggttctattattattattatttattatttgttttttgttcttaattattttatgtataaccaaaagaaagaaaaaaaataaggacagatcgatagttgagtcagtagtcatcgtttatagaaagttttgacagtatataatttctgattatatttgttagaaagttcatatgttgactttgttatttgtttttaaaagtattttccaggtgatttgtgtaatatatccatactttgtaataacaacaattttcatcttcttcactacttgagtgttttgatttttgaataaagtat

SEQ ID NO: 2186 - DNA, 1725 bp, Arabidopsis thaliana
gtcaagcagcttaaatcatctatgacttaaaattataattaagaaaaaacaatgcctaaatatgcatatatttcaaatgtatcacataacttgtgacataagaaaatataaacaaaacaaaaagggcaaaaaagacctgaaagcttagaggcacacctgcataggtcccacagttcactcgtgacaccgtaaaaggcaaaacacgaacccgccacgttatcacaaaaagcaagccacgtcaatatagtctcactgtcaactacacttaacttactattttcacatctcattttcctatctttatataaaccctccaggctcctctttaatttctttaccaccaccaacaacaaacatataaaccataaggaaaacagagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttagactttattattgttatattattattattatttattttttgtgtgtttgttcttaattattttatgtataaccaaaagaaagaaagaaaataaggacagatccatagttgagtcagtagtcatcgtttgtagaaagttttgacagtatataatttctgattatatttgttaaaagttcatatgttgactttgttttccttttaaaagtactttcaggtgacttgtgtaatatattcacacttgtaataacaacaattttgatcttcttcactacttcagtgttttgatttttgaataaagtattattgtagcc

SEQ ID NO: 2187 - DNA, 642 bp, Castanea mollissima
ctcaaaacttttgtctacgcctcttctctccacaaaaaaggaaaagcgatagagaaagttggagagagagatagagagagagtataagtaatggagggttacaacgtcatcgcgccgttcattatgaagacttttcagatggtaaatgatccgacgactgacagtctaatcacttggggcagagccaacaacagcttcatcgtcgtcgatcccttagacttctcacagaggattttacctgcctacttcaagcacaacaatttctctagctttgttcgtcagctcaacacctatggattcagaaaggtcgatcctgacaaatgggaattcgcgaacgagtggtttcttcgtggccagaagcacttgttggtgaacatcgtacgtaaaaagcacaatcggagctcgtacacgcagggcaagaatgaagaactagtggaagacgaggacttagtcatggagatagcgaggttaaagaatgaacagaaggccatggaggatgagcttgagggcatgaagaaacgattggaagctacagagaaacggccacagcaaatgatggcgttcctgcacaaagtagttgaaaacccaaatatcttacccaatttgatgcttcagagagaacgaactaggcagttaatcagc

SEQ ID NO: 2188 - DNA, 981 bp, Vitis vinifera
ctctctctcgtctctcgtttctcatctctcggctctctgcccgtcctcctcctccccccttttccaagagaggtcagacgcgaaagcagtgtatatgggatggaagctcccaataacaacatcatagcacccttcgtcatgaagacgtatcagatggtcaacgattcaagcactgatgctctcatcacctggggcagagccaacaacagcttcatcgtcttcgaccctttagacttctcccagaggatcttgcccgcttatttcaagcacaacaacttctccagctttgttcgtcagctcaacacctacggtttcagaaaggttgatccagatagatgggagttcgccaacgagtggttccttcgtggccagaggcaattgctcaagaacatcgtcaggaagaagcatagctcttgtggtaggagttcgtttttgctacaggcgaagctggaagatggtgatgaggaaatattggcggagattgagaggctgaagcacgagcagaagtcccttgaggaggagcttgaggggatgaccaagaggttggaagcaactgagagacgtccacagcaaatgatggcgtttctctacaaagttgtggaagacccagagcttattccgacaatgatgatggagaaagagaggaggaggcaattgggcgagaagaagaggcgtcttctgatccaatcgacatcgtcttcctcaggcaccgctgggacggcttcagtgaagtcggaagaggaagaagacggcagcactgtaggtataatttcatcgccggagactctgagccactcctcgccgtcgccggacacaagcactccggcgtgggtgaggccaaggcagatgatgggttggcctctcgtcgcccaacagccttaccctttggctgccattcccagtcccatatattccgggtctgtgaccggaataggacatttcaacacgatgtcgccgccgcctgaaaacaccatttctagc

SEQ ID NO: 2189 - DNA, 1169 bp, Fragaria vesca
gagagagaaaaaaaggaaaggggatgatgataactaacacctcacagaatcagagagcttcttcttcctctgaagcaaagccgcagcagagtctgatgatgagcatggaggacagcggcaacgtcatcgcgcctttcgttatgaagacttaccagatggtcaacgatcccacaaccgacaggttaatctcctgggggagagccaacaacagcttcatcgtcgtcgagccgctcgagttctcgcagcggctgttgccggcttatttcaagcacaacaacttctcgagcttcgtccgccagctcaacacttatggattccggaaagttgacccggaccggtgggagtttgcgaacgagtgtttcctgagagggcagacgcatttgttgaagaacgtggtgaggagaaaacacacgggcaatcacggcaacaacaaccacaggatggtcaatacgacggcgtttggtaaggcggaggagcttgacgacgaggagatagtgatggagatagcgaggctgaggcaggagcagaagagcttagaggatgagatggagagcatgaacaagagactggaggcgacggagagaagaccgcagcagatgatggcgtttcttcacagagtggcggaggacccggagattctgccacgtatgatgctggagaaggataggagaatcacggagggggacaagaagcggcggctgatgattgcctcgacgtcatcaacttcgtcgtcggggatgggggcgacgacaacttcggtgaagactgaggaggaagttgacggggccatgggggtgctttcgtcgccggaaccaggttttgaggtgcagagcttttgtcgggggtcgacgtcgccggagacttcgacggcgcaggcttggtggagccaggggcgggtcgtcggtcggactcggggtgatcaggagttgtatggtagttctacggccttaggcacgcaatcgggtcatggaaatgggaatagtagtaatttcggattggggttcgggtatagtgggaataggagtggtagtggagaagtgggttattttgcggaggtggaagagagtccgccgccgccttatccattctccctgttagaaggtgggttttagttttatttggtttcccctttttattggtctttaatctaaatgtgttacttctcgcca

SEQ ID NO: 2190 - DNA, 796 bp, Fragaria vesca
aaaaaggaaaaggggatgatgataactaacacctcacagaatcagagagcttcttcttcctctgaagcaaagccgcagcagagtctgatgatgagcatggaggacagcggcaacgtcatcgcgcctttcgttatgaagacttaccagatggtcaacgatcccacaaccgacaggttaatctcctgggggagagccaacaacagcttcatcgtcgtcgagccgctcgagttctcgcagcggctgttgccggcttatttcaagcacaacaacttctcgagcttcgtccgccagctcaacacttatggattccggaaagttgacccggaccggtgggagtttgcgaacgagtgtttcctgagagggcagacgcatttgttgaagaacgtggtgaggagaaaacacacgggcaatcacggcaacaacaaccacaggatggtcaatacgacggcgtttggtaaggcggaggagcttgacgacgaggagatagtgatggagatagcgaggctgaggcaggagcagaagagcttagaggatgagatggagagcatgaacaagagactggaggcgacggagagaagaccgcagcagatgatggcgtttcttcacagagtggcggaggacccggagattctgccacgtatgatgctggagaaggataggagaatcacggagggggacaagaagcggcggctgatgattgcctcgacgtcatcaacttcgtcgtcggggatgggggcgacgacaacttcggtgaagactgagaggaagttgacggggccatgggggtgctttcgtc

SEQ ID NO: 2191 - DNA, 1109 bp, Hordeum vulgare
ctcgtgccgaattcagccacgcaggaacgcgcaccgtcacctctccctctccctctcccctctcgtcgccagatccaaccccactcccgtccccgtccaccccgtcgccgccgtcgccgcgaatcccgccggcgtccaccccgcgcacgcgtgctctgcgcctctgtgtctgctcgacggactccaggacctccggatcggagccccgcgcgcctcgccatggcggccaacgcgctgaaggcccagctcaacgcgacagatcgcttccaattctgacaccggccggcgacaggagatcgggctcgccaatctctcaccggcttccctccgtccctgcccaaaggcggctgcagcgtcaaatcgcgcaccgagaagagctggtctgctcgcgctgctctgctctgctcggtggatgcgggcctgcggcagtggcagcggtggagaagggaggggaggtaggcatcgggtgacctccgtgacgctctcgatgttgggggagaagcccgacctggtctgcgaccgggcgacatgctcgggcaggcgacgcgaaccaaagacactaaacaagcgaagcgaaccccctcttcctcctcatgtcgccatccgccgccgccggcgaaaccccgtccggggagccgcggagagcaacaccagcgccgaggattcgcggtggctcgcggccctctctgaacccgagctcgatttgctcatcagcctgaagatgctggcctgtcacctgctgtcacccgctgattactctccaaatgcaaagttcatttccgtcctgtcacccgctgattactcacccgctgtcacctgcaggatggtttcttgctttatttccgtcctgtcacccgctgattactctccaaatgcaaagttcatttccgctttggtggcagacctattgtctttgttactgatttatgtgcacttacgccatgccttgggacattcagttgttactgttattcttcaaatactctgaatctgtgtgtcaaggggggcagatttggagcaaaactttgaattcatggtaagcataggacggtttccctgattcagagttgcggcatataatagtcttcacacaaatgcagcttataatc

SEQ ID NO: 2192 - DNA, 813 bp, Vitis vinifera
gtggacatatttagggatgctgcagttcttatggtcaactacattgatgaaatccgagctcaaggctttgaaataagttacctaaatattggaggtggtcttgggattgattactatcatgctggtgctgtccttcccactccgagagatcttatagatacagttcgggagctggttctttcacgagatcttaatcttatcattgaacctgggagatcacttattgctaacacttgctgcctagttaatcgggtcattggagtgaaaactaatggaacaaaaaattttgttgtgattgatggcagcatggctgaacttatccgtcctagtctttacgatgcttatcaacacatagaactggtgtctcctccaccttctgatgctcagatttcaacttttgatgtggtgggccctgtttgcgaatctgcagatttcttggggaaggatagagaacttcccactccacctaggggagctggcctggttgttcatgatgcgggtgcttactgcatgagcatggcatcatcttacaatctcaagatgcgcccacctgagtactgggttgaagatgatggatccgtgtccaagatcaggcatggagagacatttgaagaccatgtaaggtactttgaggggctttgattgtatggtggcagacattgacattcctacttagggctaagaagcttgtttgttgctttcaatctatgcatggtctgttggtggaaattgtgtatctgaatactccatagtagctgaattttatttatcagctgatctatcaatttattatgatccattattagacaaaac

SEQ ID NO: 2193 - DNA, 1287 bp, Vitis vinifera
tttggtgagcgggaacgagttgaggttggctcttcgagctgggtttgatccaacaaggtgtatctttaatgggaatgggaagcttttggaggatttggtgctagctgcccaagaaggtgtctttgtcaatgttgatagtgaatttgatttggataatattatatcagctgcaagaattgctggcaagaaggtcaatgttttacttaggatcaatccagatgtggatcctcaggtccacccatatgtagctactgggaacaagaactccaaatttggtattagaaatgagaagctgcaatggtttcttgatgctgtaaaggcacatcccaatgagctgaagcttgtgggggcccattgccatcttgggtctaccattaccaaggtggacatatttagggatgctgcagttcttatggtcaactacattgacgaaatccgagctcaaggctttgaaataagttacctaaatattggaggtggtcttgggatagattactatcatgctggtgctgtccttcccactccaagagatcttatagatacagttcgggagctggttctttcacgagatcttaatcttatcattgaacctgggagatcacttattgctaacacttgctgcctagttaatcgggtcactggagtgaaaactaatggaacaaaaaattttgttgtgattgatggcagcatggctgaacttatccgtcctagtctttacgatgcttatcaacacatagaactggtgtctcctccaccttctgatgctcagatttcgacttttgatgtggtgggccctgtttgcgaatctgcagatttcttggggaaggatagagaacttcccactccacctaggggagctggcctggttgttcatgatgcgggtgcttactgcatgagcatggcatcaacttacaatctcaagatgcgcccacctgagtactgggttgaagatgatggatccatgtccaagatcaggcatggagagacatttgaagaccatgtaaggtactttgaggggctttgattgtatggtggcagacattgacattcctacttgggggtaagaagcttgtttgttcctttcaatctatgcatggtctgttggtggaaattgtgtatctgaatactccatagtcactgaattttattgatcagctgatctatcaatctactatgatccattattagacaaaacaaaatatgatgatgatgatgatgagagagagagagagagagagagatgttgacaagtcaacttaactatctccttaagtctttcttaaacca

SEQ ID NO: 2194 - DNA, 810 bp, Raphanus sativus
  misc_feature (48)..(48): n is a, c, g, or t
  misc_feature (57)..(57): n is a, c, g, or t
  misc_feature (64)..(64): n is a, c, g, or t
attacaaaggtggatatattcagagatgctgcggtactcatggtggantacattgangagatcnggcgtcaaggctttgaagttagctacttgaacattggtggtggtttagggatagattattaccatgccggagctatcctccctacacccatggatctcatcaacaccgtaagagagcttgttctgtcacgtggcctgaacctaataatcgagccagggaggtcgttgattgcgaacacgtgctgtttcgtcaaccatgtgaccggtgtgaagacgaatggaactaaaaacttcatagtgatcgatgggagtatggctgagctgatccgtcctagtctttatgatgcatatcagcacattgagttggtctctcctccagcacctgaagcagatgtttccaaattcgatgtagtgggtcctgtttgtgagtctgctgatttcttggggaaagacagagagcttcctactcctccaaagggagctggtctggtggttcatgatgctggtgcatactgtatgagcatggcttccacttacaatctcaagatgcgtcctccggaatactgggttgaagatgatggatccatcactaagatcaggcatgctgagacattcgaagaccatttgcgtttctttgaaggtctataaactctctctggtttcctcttttatcattgtttgtcacgctattttagtttttactatattgattttcggaatcattattgtaatgctattgcttgtgttagaattttcatttttccctgttgtatctgaaaccttcaataagttgatgaataagaaaaa

SEQ ID NO: 2195 - DNA, 925 bp, Orobanche aegyptiaca
tatcttggttctacgatcacaaaggtagatatttttcgtgatgctgctcttttgatggtgaactacatagacgagattcgatcccaaggttttgagattgattacttgaatattggaggtggtctggggattgactattatcatactggagctgtactcccgactcctagagacctaatagacacggttcgtgaattggttgtatcccgaaatctgaatctcataatcgaacctggaagatcactcatagcaaacacttgctgctttgtgaatcatgtcactggagttaaaaccaatgggacaaaaaatttcatcgtggttgatggaagcatgtcggaacttattcgtccgagtttatatggtgcttaccagcacatagagctggtctcaccttcatctccagatgttgagatgtcgacgttcgacgtagtgggtcccgtttgtgagtctgccgatttcttgggaaaggatagggaactacctgcaccaccaaagggtgctggattggtggttcatgatgccggtgcttattgcatgagtatggcttcgacttacaatctcaagatgcgtccgcctgaatactgggtagaagatgacggatcgatatccaaaatccggcatggggagacatttgaagaccatttgagatattttgaaggtctttgagttatttgtacctcttcttattcatcatcccccagcactgtctgggtaagacatttgttcctctttttgtccttaaattttgtactgtattgtcgagtcgaaataacaaaacatgttccggagttccgctttccgaaagtgatgatattgtaagagtgtttgcaaaccttaaagcatgtgagaaatattacaagaatacttgcaaactcttaaaaaatgaatgcttgaacctttcttttagtgggaatattacgcgagg

SEQ ID NO: 2196 - DNA, 1697 bp, Citrus clementina
ctccatcttcctcaattgttcaccaatggccgccactcagctttgctctaattcagcctctctttccaaagccctaacccaaaacccatttccgaaaatccccatttcacccctcaaaaccaccttaaacttccaaagaaccctaaaacccttcactctcaaagcagtcctctcccaaaaccccgcgaaatcccagacacacacagccccagtcgagcactgcttcagcaagaaagctgacggctttctctactgtgaagatgttagagttcaggatgtcatggagacagttgaaaaaagacctttttatttgtacagtaagcctcagatcactagaaatgtggaggcttataaacaagcccttgaggggctgaattctatcattggttatgccattaaggctaataataactacaagattttggaacatttgagaaaattgggttgtggagctgttcttgttagtggcaatgagctgaggcgtgtccatccttatgttgctactgggaacaagaactctaaatttggcattaggaatgagaagttgcaatggtttttggatgccgtgaaggcacatcctaatgagttgaagcttgtgggggctcattgccatcttggttccaccattaccaaggtggacatattcagggatgctgcagttcttatggtcaattacattgacaaaatccgcgcccaaggctttgaagttgattacttgaacattggaggtggtttaggaatagactattatcacactggtgctgtccttcccaaacccagaaatctgattgacaccgttagggagctggttctgtcgagaaatctgaatctcatcattgaaccagggagatcactcattgcaaatacctgctgcttggttaatcacgtcactggggttaaaactaatggaacaaaaaatttcattgtaattgatggcagcatggctgaacttatccgtccaagtctctatgatgcttatcaacacatagagctggtttctccagcacctcaagatgctgaaatttctaaatttgatgtggtgggtcctgtctgcgagtctgccgatttcctggggaaggagcgagaacttcctacccctgataggggagctggtctggttgttcatgatgcaggtgcttactgcatgagcatggcatcgacttacaatctgaagatgcgcccacctgagtactgggttgaagaagatgggtcagtgtccaaaatccggcatggagagatattcgaagaccacatgcggttctttgaaggtctttgaatgcagatacgtctttgtttgacatcccattggattcttgactacaactgcaaaaaatgaatctcaacaattcagactctcctacctggatatcactaagcattcgaaatttttgtctgatggagttgttacaatgattatactgtaatttaagttgtattgaggatgtatgttcagtgcatcacagtgatccgtaggttacccaatttaatttacttatgcctgatgccatggaactcatatcgtgcttttactcaaagttgaagccataacagctcaagtgtttgtgtattgtacttcaacagttagtgattttgttcacaatcattgcgagggattaaaagtcgtagcagatatgatccggtgataggacaatgtttagcaaattttgaaataaaatatgggaatctcattcttttaa

SEQ ID NO: 2197 - DNA, 796 bp, Ipomoea nil
ggagctcactgccatctcggatctacaataaccaaagtagacattttcagagatgctgcagttttgatggttgcctacatcgatcaaatccgagctcagggatttgaaattgatttcttgaatattggaggtgggctggggattgattattatcatgctggagccatccttccctcacctagagatctaattgatacagttcgggaattggttgtatcacgaaacctcaatctcatcattgaaccgggaagatcacttattgctaatacgtgctgcttggtcaaccgtgtcactggagttaaaaccaatggcacgaaaaatttcattgtaattgatggtagcatgtcagaacttatacgtccaagtctctatgatgcttaccagcacatagagctagtttctcctacaccctcagaatccgaggtttctacttttgatgttgtgggtcccgtatgtgagtctgcagatttcttgggaaagaatagagaacttcccacccctcctaggggttctggcttggtagttcatgacgccggtgcctattgcatgagtatggcatcaacctacaatctaaagatgcgcccccctgagtattgggttgaagaggatggaaatgtgtcgaaaatcaggcacgcagaaacattcgaagaccacctgagattctttgagggtctctaattcctcggtcgtttcagcagtttcctttctgtagttgctttcttgtttcctttctgtagttgctttctttattctgtaccaaactattgtactttgtttttgagaccccaattctgtc

SEQ ID NO: 2198 - DNA, 1112 bp, Brassica juncea
aggatttagttttggctgctcaagaaggagtattcgtaaatgttgatagtgagtttgacttggaaaacattgtggaagcttcaagaatctctggtaagcaggtcaatgttctgctgcgtatcaatcctgatgtcgatcctcaggtgcatccatatgtagctaccgggaacaagaactcaaagtttggtatcaggaacgagaagcttcagtggtttctcgacgaggtgaaggcacatcccaatgagctcaagcttgttggagctcattgccatcttggctctaccattacaaaggtggatatattcagagatgctgcggttctcatggtggaatacattgatgaaatcaggcgtcagggatttgaagttagttacttgaacattggtggtggtttagggattgattattaccatgccggtgctgtccttcctacacccatggatctcatcaacaccgtaagagagcttgttctgtcacgtggcctgaatctaattatagagccagggaggtcgttgattgcaaacacgtgctgcttcgtcaaccatgtgaccggtgtgaagacgaatggaactaaaaactttatagtgatcgatggaagtatggctgagcttatccgtcctagtctttatgatgcttatcagcacattgagttggtctctcctccagcacctgaagcagaggtttccaaattcgatgtagtaggtcctgtttgtgaatctgctgatttcttggggaaggacagagagcttcccactcctccaaagggagctggtctggtggttcatgatgctggtgcatactgtatgagcatggcttccacttacaatctgaagatgcgtcctccagaatactgggttgaagatgatgggtccatcactaagatcaggcatgctgagacattcgaagaccatttgcgtttctttgaaggtctataaactctctgatttcctctttatcatttgtttgtcgctattttagttttactatattgattttaagaatcactattgtaatgctactgctgtgttggattttcatattccttgttgtatccgaagcctttcgataagttgatgaataaaagaaataaaagaattcacaacttactttat

SEQ ID NO: 2199 - DNA, 2179 bp, Theobroma cacao
ctgtctaaaaacagtcagcaaacgaacatcgcgtcaccttctccatcaatggcggcggctactcaccttctctctcactccccatctcttcccaaaaccctaaaccaccctttaacccaaaacccgttttcaaaattccccattttgcccctcaaaccatcacaaaatgtcttcaaacgccactccctctccatcaaagctgtcctatcccaaaaccctgccaaaaccctcacccccacttttcaacactgcttcacaaaatccccagatgggtttctctactgtgaggataccaaggttcaggacatcatggaaaaggtcgaaaagaggccgttttatttgtatagtaagcctcagattactaggaatgtggaagcttatacagaggctcttgaaggtttgaaaaattcgattatcgggtacgcgatcaaggcgaataataatttcaagattttgcagcatttgaagaagttgggttgcggtgctgtccttgttagtggtaatgaactcgagttagctcttcgtgccggcttcgatccaactaagtgtatatttaatgggaatgggaagatcttggaggatttgataatagctgcccaggagggtgtttttgtgaatgttgatagtgaatttgatctggagaatattgtagcagctgcacgaattgctggcaggaaggttaatgttttgcttcggataaacccagatgtggatcctcaggattttctgatgggaaatattggtttattgaagtgcaatcaacagaaacttcatcccattcttaggacatccaaccaccttctcaacctctactattttgtctccatttccatgatggctcttttgccagtccatccatatgttgctactgggaacaagaactctaaatttggcattaggaatgagaagctgcagtggtttctggatgctgtaaaggcacaccctaatgagctgaagcttgtgggggcccattgtcatcttggttcaaccattaccaaggttgatatattcagggatgctgcagttcttatggtcaactatatcgatgaaatccgtgcccaaggtttcgaagttgattatttgaacattggaggtggtttggggatagattactaccatagtggtgctgtccttcccacgccgagagatctcattgacactgtcagagaattggtcctttcaagaaatcttaatctcatcattgaacctgggagatcactcattgcaaatacttgctgcttagtcaatcatgtcactggagtcaaaaccaatggaacaaaaaatttcgttgtgattgatggcagtatggctgaacttatccgtcctagtctttatgatgcttaccaacatatagagctggtttctcctgcacctcctgatgcagaggtttctacttttgatgtcgttggccctgtttgtgaatcagcagatttcttgggaaaggagagaaaacttccaaccccagctaagggaactggcctagttgtgcatgatgcaggtgcatactgcatgagcatggcatcgacctacaatctcaaaatgcgccctcctgagtactgggttgaagaagatggatcagtgactaagatccggcatggggagacattcgaagaccacatgcggttttttgaaggtctttaagttaattaaaacatagaagccagcttgtttgaggcttgaaattggatctggctttgcaatcgtcatggatatattatgtatttgaattttcatttaaccagctgctgaagactttttgtggtatgattttattttgctaagcctagatgaggtggtagtatcagggaagaggaacttgcacaaagattgaatagatgaaatcaatgcctcctaccccacaccgtgcgtggcccccttctagtagaactaatcttttgactgggtaacagaggagtgttctgctggataatttttggccgttccatctttctatgtgagggtgacacccagtaggtcccttctttttaaccacaagaaacagaaggattagattttcaaagcggagatggcccccatgagtgtggggcttgagctacttgattttcatgattcaagttaaggcctcatgggatgctgtaaactaagacataaacccaccacctttaacttatgttttcttccaaatagaaagaattggattggggtttccactgtttga

SEQ ID NO: 2200 - DNA, 1212 bp, Cajanus cajan
gagcttaaattggctcttcgtgcttggttttgatcccacaaggtgcatctttaatgggaatgggaaaatcttggaggatttgaccttggctgctcaggcaggtgtatttgtcaacattgatagtgaatttgacttggaaaacattgtagaggctgcaagaagggctggaaagagggtcaatgttttacttcggattaatcctgatgtggatccacaggtccatccttatgttgccactgggaataagaactctaaatttggcattagaaatgagaagctgcagtggtttttagatgcagtaaaggagcatcctaacgagctcaaacttgtgggggcccactgtcatcttggttcaacaattaccaaggtagacattttcagagatgcagctactattatgatcaactacattgacgaaatccgagctcagggctttgaagttgattatttaaatattggtggaggacttgggatagattattatcattctggtgccatccttcctacacctagagatctcattgacactgtacgagagcttgttctttcacgtggtctgaatctcatcattgaaccagggagatcgctcattgctaatacatgttgcttagttaaccgggtgacaggtgttaaaactaacggatctaaaaacttcattgtaattgatggaagtatggctgaacttatccgccctagtctttatgatgcttaccagcatatagagctggtttcccctgctccatcaaatgctgagacagcaacctttgatgtggtcggccctgtctgtgagtctgcagatttcttaggaaaaggaagagaactgcctactccagcaaagggtactggtttggttgttcatgatgctggcgcttattgcatgagcatggcatcaacttataatttaaagatgcggcctcctgagtattgggttgaagatgatggatcagtgagcaaaataagacatggagagacttttgaagaccacgttcggttttttgagggcctttgaagatgaggctgaggaattgttgtgtatttggagtttgtatctttcttagtcaatgaatgcacgaatcttttagttatgtttctatgcttctatttgaatgttgacacacttgatagttaaagagaataaaactgatttcagttagatttaaaaggcatttaattgcctccttcctatatcaagttaatcgagtgcgaatgtgc

SEQ ID NO: 2201 - DNA, 1891 bp, Gossypium hirsutum
gaaaaacgacagtcaacaaacgcagagcattgcaatcttcatcactaatggcggctactcatcttctctctcactccccatttcttcccaaaccctaaaccactcattaaccaagaacccattttccaaatcccccattttgcccctcaagccctccaagaatctcttcaagcaaccctccctctccctctctctcaaagctgtcctctctcagaaccctgctaaaaccctcaaccccacttttcaacactgcttcactaaatccccagatgggtttctctactgtgaggataccaaggtccaggatgtcatggaaaaggtcgaaaagaggccgttttatttgtatagtaagcctcagattactaggaatgtggaagcttataaagaggcccttgaaggcttgaagaattccattattgggtacgccatcaaggcgaataacaatttcaagattttgcagcatttgaggatgttgggttgcggtgctgtgcttgttagtggcaatgaactcaagttggctcttcgtgccggcttcgatccaactaagtgtatctttaatgggaatgggaagatcttggaagatttggtactagctgcccaagaaggtgtttttgtcaatgtggatagtgaatttgatctggaaaatattgtagctgctgcaagaattgctggcagaaaggttaatgttttgcttcggatcaaccctgatgtagatcctcaggtccacccatatgttgctactgggaacaagaactctaaatttggtattaggaacgagaagctgcagtggtttctggatgctgtaaagggacatcctaatgagctgaaacttgtaggggcccactgtcatcttggttcaaccattaccaaggtggatatatttagggatgctgctgttctcatggtcaactacattgatgaaattcgtgcccaaggtttcgaggttgattatttgaacattggaggtggtttggggatagattactaccacagtggtgccgtccttcccacacctagagatctcattgacactgtaagagaattggtacattcaaggaatcttaatctcatcattgaaccaggaagatcactcattgcaaatacttgctgctttgtcaatcgtgtcactggagtcaaaactaatggaacaaaaaatttcattgtgattgatggtagtatggctgaactcatccgtcctagcctttatgatgcttatcaacatatagagctggtttctcctgctcctcctgctgctgaggtttctactttcgacgttgttggccctgtttgtgaatctgcgatttcttgggaaaggagagagaacttcccaccccagctaaggggactggcctggtcgtacatgatgcaggtgcttactgcatgagcatggcatcaacttacaatctcaagatgcgccctcccgagtactgggttgaagaagatggatcagtgaccaagattcgacatggggaaacatttgaagaccacatgcggttttttgaaggtctttaattcgatcaaggaacagtgtttgagggttgaaattggatctagagtgtaccatgtacatgaactttcattcaataaactgttgattttgttatggtctcatttttgtaagcctatttgacattgagcttgcaaccacgattgagtagatgaagcaatgccccctccccaccaccccaatggagaactatcatctcttggatagctaacaaaggatatctttttgcccgtttcatcattttcccaagctaaattgagattagggagtttaacaaattaaattttcaatctgattggtttgttggatgaattaatttgattgaaataattttaattatttaagatatgttttatatgaaaaaagaaaaaagtaccgactgcg

SEQ ID NO: 2202 - DNA, 1025 bp, Euphorbia esula
  misc_feature (9)..(9): n is a, c, g, or t
  misc_feature (11)..(12): n is a, c, g, or t
  misc_feature (325)..(325): n is a, c, g, or t
  misc_feature (436)..(436): n is a, c, g, or t
  misc_feature (505)..(505): n is a, c, g, or t
  misc_feature (514)..(514): n is a, c, g, or t
  misc_feature (763)..(763): n is a, c, g, or t
  misc_feature (949)..(949): n is a, c, g, or t
cgacagccntnnccatcttggctccactattaccaaggtggatatattcagagatgctgcagttcttatggtaaagtacattgatgaaatcagagctcaaggctttgaaattgattacctaaacatagggggtggtttgggtatagattattatcatgctggtgctgtgcttcctacaccaagagacctgattgacacggttcgagaattggtggtctcaagaaatctgaatctgataattgaaccggggagatcattaattgcaaacacgtcatgcctggtgaacagggtgacaggtgtcaaaactaatggaactaaaaatttnatagttatcgatggtagcatggccgaacttattcgtcccagtctctacgatgcttatcaacacatagaacttgtttcaccagaatcatctgatgcggaggtttcaaagttngatgtggtgggtcctgtctgtgaatctgcggatttcttagggaaggatagagaacttccaactccttcnaagggagcnggtttggtagtccatgatgctggagcttactgcatgagtatggcttcaacttacaatctgaagatgcgcccacctgaatactgggttcaagaagatgggtcagttgccaagattaggcacggggagacgttccaagaccatgtccggttttttgaaggactttaattggagaaattaagcatttttggcagaaaggctcgtgatataggccaattgccagtcgaaggaattgagcgttttctgcagatnggcttcaagatatgttttcattgtattgttagaagcaggttttagcagtttgcatcctctttaacagccctgattttatctgaatttttattggtaacttatgagtattagcttttaggggaaatttatgatctatgcaactcttttttagattatgtattggattaatcaattaagcattagagntaagttttggattttttgaaaccgtttcaaacttcatgttgaaggtaagattcatgggttagttaaatatataggg

SEQ ID NO: 2203 - DNA, 1798 bp, Arabidopsis thaliana
cagtgttactgtaacagtcgcacacctaacaaaaatcctccagccatggcggcagttactcaatttctctcccaaccttcatcaatccgcggaaccctaaatcagtaccaattgaatcagacttcactctcaagaatcccatttttgtctctcaagtcaacattgaagccacttaaacgcctctccgtcaaagccgccgtttcccaaaactccaccaaaaccctcacgaaagaatctgcttcctctttcgaccactgtttcaagaaatcatcagatgggtttctctattgcgaaggaaccaaggttcaagatatcatggaaacagtcgagaaacgacccttttacttatatagcaaacctcagatcacgagaaaccttgaggcttataaagaggctttggaaggagtgagatctgttattggttacgctattaaagctaataacaatctcaagattttggagcatttgaggagtttgggctgtggtgctgtgttggttagtggaaatgagctcaggcttgctcttcttgctggtttcgatcccacaaagtgtattttcaatggaaatggaaagtctttggaagatttagttctagctgctcaagaaggtgttttcgtaaatgttgatagtgagtttgacttgaataacattgtggaagcttcaagaatttctggtaagcaggtcaatgtgttgttgcgtatcaatcctgatgttgatcctcaggtgcatccatatgtagctactgggaacaagaactcgaagtttggtattaggaacgagaagcttcaatggtttctggatgaagtgaaggcacatcccaaagagctgaagcttgttggagctcattgtcatcttggttctaccattacaaaggtggatatattcagagatgctgcggttctcatgattgaatacattgatgaaatccggcgtcaaggctttgaggttagctacttgaacattggtggtggtttagggatagattattatcatgccggcgctgtccttcctacacccatggatcttatcaacaccgtaagagagctggttctttcacgagacctgaatctaataatcgagccagggagatcactgattgcaaacacatgttgtttcgtcaaccatgtaactggtgtgaagacgaatggaactaaaaacttcatagtgattgatggaagtatggctgagcttatccgtcccagtctttatgatgcctatcagcatattgagttggtctctcctacaccgcctgaagcagaggttaccaaattcgatgtagtgggtcctgtttgtgaatctgctgatttcttgggcaaagacagagagcttcccactcctccacagggagctggtctggtggttcatgacgctggtgcatactgtatgagtatggcttccacttacaatctcaagatgcgtcccccggaatactgggttgaagaagatgggtcgatcactaagatcaggcatgctgagacattcgatgaccatttacgtttctttgaaggactatgaactccgagatttactcatcattgttgctattttagatgaattgtatgattacgtttctataatgctattgctgtcttggatttttccacattctgtgctatgatttaaagtcctcaataaagtgatcatatgaataagaaacaggtcacaagtcaagaccgaaaataaaaggtgtatttgtgagttatgattattcttttggtttctttttagttactacatgtaaaattgtccattgtccaaacacatatataagacttgaataagtaaccttaaagccaaa

SEQ ID NO: 2204 - DNA, 877 bp, Artemisia annua
gaagtcatatcctgatgaacttaagctagttggggctcattgccatcttggatcaaccattaccaaggttgacatatttagagacgctgcagaaatcatggtgaagttcattgacgaaattcgagcccaagggtttgatattagttatttgaacattggaggtggtctagggattgattattatcacactggtaccgttcttcctacaccaagagacctcatcgacacggtgcgggatctagtcaagtctcgaaaccttaatctgattattgaacctgggaggtcactaattgcgaatacttgctgccttgttaaccgcgtcactggtgtcaaaacaaatggcacaaaaaactttattgtgattgatggcagcatggctgaacttatccgtcctagtctgtatgatgcttatcaacacatagagctagtttctccttcaccacctgatgctactatttcgacttttgatgttgtgggcccggtttgcgagtctgccgatttcttgggaaagaatagggaacttcctgctccagccaggggttctgggcttgtagttcatgatgcgggtgcctactgcatgagtatggcttcaacttacaacctcaagatgcgcccaccagaatattgggttgaagaagatggatcagtttccaaaatcaggcacggggagacttttgaagatcatatgagatacttcgagggactcatgatttaactaatcacttgtattttgagttgcaattttgtaagattccaagttccctttatgggtaaactgtcatttgcgaatgttgttcaacgagttgaattcttggttctcttgtgggttttgtccgccattgattgctggttaaatggtaatgcatcttcactttta

SEQ ID NO: 2205 - DNA, 1624 bp, Artemisia annua
gtgacttccaacaacttcatttctgttccacaacaatggcggctacaaaccttcatctccaaacactcttcaccccgaaaaccctagcccaatcctcattcccaaacacccctaaatccataaccttccataaaaaactcatacccatcaaagcactcatctcccaaacacccccacaaacccaaaaattcacccactgtttcacaaaacagaagatgggtacttgtatgttgaaaaaaccaaagttgaagagatcatggaagtagtggaaaacagaccattctatctctatagcaagcctcaaataacaagaaatgtggaagcttataaagaggctttggaaggtttggataatagtgttattggttatgctattaaagcaaataataatttcttgattttgaaccatttgaggagtttgggttgtggggctgttttggttagtggcaatgagttgaggttggctttaaaagctggctttgatcctacaaggtgtatttttaatggtaacgggaagcttttagaggatcttgttcttgctgctcaagaaggtgtatttgttaacatagacagtgaattcgatttggataatattgtagccgctgcaagaattgctgggaagagagtcaatgttttgcttcgaatcaatcccgatgttgatccccaggtccatccttatgttgcaacggggaacaagaattccaagtttggtattagaaatgagaaactgcaatggtttttggatcaagtgaagtcatatcctgatgaacttaagctagttggggctcattgccatcttggatcaaccattaccaaggttgacatatttagagacgctgcagaaatcatggtaaagttcattgacgaaattcgagcccaagggtttgatattagttatttgaacattggaggtggtctaggaattgattattatcacactggtaccgttcttcctacaccaggagacctcatcaacacggtgcgggatctagtcaagtctcgaaaccttaatctgattattgagcctgggaggtcgcttattgcaaatacttgctgccttgttaatcgcgtcactggtgtcaaaacaaatggcacaaaaaactttattgttattgatggcagcatggctgaacttatccgtcctagtttgtacgatgcttatcaacacatagagctagtttctcctccaccatctgatgctactatttcgacttttgatgttgtgggcccggtttgcgagtctgccgatttcttgggaaagaatagggaacttcctgctccagccaggggttctgggcttgtagttcatgatgcgggtgcctactgcatgagcatggcttcaacttacaacctcaagatgcgcccaccagaatattgggttgaagaagatggatcagtttccaaaatcaggcacggggagacttttgaagatcatatgagatacttcgagggactcatggtttaactgatcacttgtatttcgagttgcaattttgtaagattccaagttccctttatgggtaaactgtcatttgcgaacattcaacgagttgaattcttggttctcttgtgggttttgtccgccattgatggctggttaaatggtaatgcatcttcactttta

SEQ ID NO: 2206 - DNA, 948 bp, Cleome gynandra
aaggtcaatgtactgcttcgtatcaatcccgatgtcgaccctcaggtgcatccatatgtggctacaggaaacaagaactcgaagtttggtattaggaatgagaagctccagtggtttctggatgaggtgaaagcacatcctgaggagcttaagcttgttggagcgcattgtcatctaggatctaccattactaaggtggatatattcaaagatgctgctgttctgatggtgaaatatatagatgaaatccgagctcaaggctttgaagttaattacttaaacatcggtggtggtttagggatagattattaccatactggtgctgtccttccctcaccaagggatctcattgacactgttagagaactagttctttcacgtgacttgaatctgataattgagccggggagatcacttatcgcaaacacttgctgttttgtgaaccacgtcactggtgtgaaaaccaacggaactaaaaatttcatagtgattgatggaagtatggccgaacttatccggcccagcctttacggtgcctaccagcacatcgaattggtctcgccgccgccagccgaggcagaggtgtccacgtttgatgtcgtgggccctgtctgtgagtctgccgatttcttggggaaagacagagagcttcctacccctcctaagggtgcgggtctcgtggttcacgacgcgggtgcatactgtatgagcatggcgtccacctacaatctcaagatgcgccctcctgaatactgggttgaagaagatggatctatagccaaaatcaggcatggagagacattcgaagaccatttgcgtttctttgaaggtctttgaacgcaagagaatcaatcacctctaagttttgattttccttcctcgttttctcccaaactataaagattcagaagcaggggcatgttgtttagaaattccaataatttccat

SEQ ID NO: 2207 - DNA, 1893 bp, Glycine max
atagataataactatctcacgagattgaaattgatctgggacttgcacttgttcctgttttgtgggtttttgctgctttaaacttcccttcgggaacatcattgccacttccatggctgcctcacacatcctttataatcctcctcccctttccaaaacttttattaatcaccctttgaaccaaaacccttctcctcaaaacctaattctaccactcaaagctactattaaaccgcgggttcttagagcagttcactcccagaagatcactgctaactcctcgcttcataactccgatactaggactcgttttcagcactgtttcacaaagagtgaagatgggcttttgtattgtgaggggcttaaagtgcatgaaattatggattctgttgaaagaagacctttctacttgtacagtaaacctcaaattactagaaatgtggaagcttataaggacgccttggagggtttgaggtctataattggttatgccatcaaggccaacaataatttgaagattctggagcatttgaggcagttgggttgtggtgctgtgcttgtgagtgggaatgagcttagattggctcttcgggctgggtttgatccgacaaggtgtatctttaatggcaatgggaaagtcttggatgatttggtcttggctgccaaagaaggtgtttttgtcaacattgatagtgaatttgacttggaaaacatcatagcagctgcaaaaattgctcaaaagagggtgaatgttttactacggattaatcctgatgtggatccgcaggtccacccttatgttgcaacagggaataagaactccaaatttggcataagaaatgagaagctgcaatggtttctagatgctgtgaaggagcatcctaatgagttaaagcttgtaggggcccactgccatcttgggtcaacaatcaccaaggttgacattttcagggatgctgccattattatggttaactacattgaccaaatccgagctcagggttttgaagttgattatttaaatattggtggtggacttgggatagattatcaacattctggtgctgtccttcctacacccagagatctcattgacactgtaagggagcttgttctttcccgtggtcttaatctcattattgaaccagggagatcactcgttgcaaacacttgttgcttagttaaccgggtgacaggtgtcaagaccaatggatctaaaaactttattgtgattgatggaagcatggccgaacttatccgtcctagtctttatgatgcttaccagcatatcgagctggtttcccctgccccagcgaatgctgagatagcaaattttgatgtggtcggccctgtctgcgagtctgcggatttcttaggaaaagatagacaacttccaactccagccaagggtaccggtctggttgttcatgatgctggtgcttattgtatgagtatggcatcaacttacaatctaaagatgcggcctcctgagtattgggttgaagaagatggatcagtaagcaaaatcagacatggggagacatttgaagaccacatccggttttttgagggcctttgaagagagacctaattttttggcagatttgtgtgtagctcaggtttggatttcttgctagagaatgtaatgacatttttttttcttgattcctcattctggtttatcttagcattctaatggagacagctgattagaaaaattgaccatctaaagtcaactaaataaaattgagatggaggtcaaaattcatatttggtgaatttaagttgatttgacacttcatcctatattctcctcagtttttagtttcctcagtaaactagcttgtagcttgaaaagtggtggttaatggcagacacaacaatgacaacatc

SEQ ID NO: 2208 - DNA, 1605 bp, Glycine max
atagataataactatctcacgagattgaaattgatctgggacttgcacttgttcctgttttgtgggtttttgctgctttaaacttcccttcggtttgttttcaggaacatcattgccacttccatggctgcctcacacatcctttataatcctcctcccctttccaaaacttttattaatcaccctttgaaccaaaacccttctcctcaaaacctaattctaccactcaaagctactattaaaccgcgggttcttagagcagttcactcccagaagatcactgctaactcctcgcttcataactccgatactaggactcgttttcagcactgtttcacaaagagtgaagatgggcttttgtattgtgaggggcttaaagtgcatgaaattatggattctgttgaaagaagacctttctacttgtacagtaaacctcaaattactagaaatgtggaagcttataaggacgccttggagggtttgaggtctataattggttatgccatcaaggccaacaataatttgaagattctggagcatttgaggcagttgggttgtggtgctgtgcttgtgagtgggaatgagcttagattggctcttcgggctgggtttgatccgacaaggtgtatctttaatggcaatgggaaagtcttggatgatttggtcttggctgccaaagaaggtgtttttgtcaacattgatagtgaatttgacttggaaaacatcatagcagctgcaaaaattgctcaaaagagggtgaatgttttactacggattaatcctgatgtggatccgcaggtccacccttatgttgcaacagggaataagaactccaaatttggcataagaaatgagaagctgcaatggtttctagatgctgtgaaggagcatcctaatgagttaaagcttgtaggggcccactgccatcttgggtcaacaatcaccaaggttgacattttcagggatgctgccattattatggttaactacattgaccaaatccgagctcagggttttgaagttgattatttaaatattggtggtggacttgggatagattatcaacattctggtgctgtccttcctacacccagagatctcattgacactgtaagggagcttgttctttcccgtggtcttaatctcattattgaaccagggagatcactcgttgcaaacacttgttgcttagttaaccgggtgacaggtgtcaagaccaatggatctaaaaactttattgtgattgatggaagcatggccgaacttatccgtcctagtctttatgatgcttaccagcatatcgagctggtttcccctgccccagcgaatgctgagatagcaaattttgatgtggtcggccctgtctgcgagtctgcggatttcttaggaaaagatagacaacttccaactccagccaagggtaccggtctggttgttcatgatgctggtgcttattgtatgagtatggcatcaacttacaatctaaagatgcggcctcctgagtattgggttgaagaagatggatcagtaagcaaaatcagacatggggagacatttgaagaccacatccggttttttgagggcctttgaagagagacctaattt

SEQ ID NO: 2209 - DNA, 903 bp, Raphanus sativus
  misc_feature (291)..(291): n is a, c, g, or t
  misc_feature (811)..(811): n is a, c, g, or t
atcctgatgtggatcctcaggtgcatccatatgtagccaccgggaacaagaactcaaagtttgggatcaggaacgagaagcttcagtggtttctcgacgaggtgaaggcgcatcctaatgagcttaagtttgttggagcgcattgtcatctaggctctaccattacaaaggtggatatattcagagatgctgcggtactgatggtggaatacattgatgaaatcaggcgtcaaggctttgaagttagttacttgaacatcggtggtggtttagggattgattattaccatnccggtgctgtccttcctacacctatggatctcatcaacaccgtgagagagctagttttgtcacgagacttgaatctaataatagagccagggaggtcgttgattgcaaacacgtgctgtttcgtcaaccatgtgacaggtgtgaagacgaatggaactaaaaactttattgtgatcgatggaagtatggctgagctaatccgtcccagtctttatgatgcctatcagcacattgagttggtctctcctccagcacctgaagcagaggtttctaagtttgacgtagttggtcctgtttgtgaatctgctgatttcttgggcaaagacagagagcttcccactcctccaaagggagctggtctggtggttcatgatgctggtgcatactgtatgagcatggcttccacttacaatctcaagatgcgtcctccggaatactgggttgaagatgatggttcgatcactaagatcaggcatgcagagacattcgatgaccatttgcgtttcttccaaggtctatngattttcccattcatcattgtttgttgctgttttagtagaactatttggttattcagaatcactactctaatgctattgctatgttaagact

SEQ ID NO: 2210 - DNA, 1197 bp, Amaranthus tuberculatus
accgggaaagggtgaacgttttgcttcgcataaaccctgatgttgatcctcaagtacatccatatgttgcaacagggaacaagaactcaaaatttggcatcagaaatgaaaaactacagtggtttctagatgctgtaaaatcacatcctaatgagctgaagttggttggagctcattgccatcttgggtcgacaattaccaaggttaatatattcagagatgctgcagttcttatggtcgaattcatagaccaaattcgtgatcaaggtttcgagattagttacttgaacattggaggtggtttgggaatagactactatcacactggggctgttttacccacacccagagatcttattgatacggttcgagagttggtcctgtcacgagatctcaaccttatcattgaacccggaagatcacttatcgcaaatacttgttgcctagttaatcgtgttacgggtgtcaaaactaacggtacaaaaaatttcatcgtgattgatggaagcatggcagaacttatccgtccaagtctttatgatgcttaccaacatatagagctagtttctccagccccatcagatgcagagatatccactttcgatgtggtgggccctgtctgtgagtccgctgatttcttgggcaaggagcgtgaacttcctacaccacagaggggagctggattagtagtccatgatgcaggtgcctactgcatgagcatggcctcgacctacaaccttaagatgcgcccaccggaatactgggtcgaggaagatggatcagttgccaaaatccgacatggtgagacattcgaagaccatttgagatattttgctggtctttaattgtacgcagcaaatgaggttgctgtcatccaacccgaggaggtttaggaactcgcctaatgtagtgaaaatgatgtattctaggcaagccgcttggagtttgcagtttataggcgtgttgcatggtttgtatcgttattggtagtgttaagtctttgtttcctcgtcgatagcttcctcagatcacttctgcattcttgtgtaattcgaaggctttagccagtttcgtatttggatatctataataaggtgaataacattagttattgctcgcattacatgcacactttaagaagaaataccgctcgttccatgtcgagttgacactcggtcgaataaattatagattggc

SEQ ID NO: 2211 - DNA, 1751 bp, Arabidopsis lyrata
agtgtaactgtaacagtcgcactccaacacacctcacaaaaaatcctccagccatggccgcagctactcaatttctctcccaaccttcatctatccgcggaaccctaaatcaataccaattgaaccaaacctcactctcaagaatcccaattttgtctctcaagtccacattgaagccacttaaacgcctctccgtcaaatccgccgtatcccaaaactcccaaaactccaccaaaaccctcacgaaggaatctgcttcctctttcgaccactgtttcaagaaatcatcagatgggtttctctattgcgaaggaactaaggttcaagatatcatggagtcagtcgagagaagacccttttacttatatagcaaacctcagatcacgagaaaccttgaggcgtataaagaggctttggaaggagtgagatctgttattggttacgctattaaagctaataacaatcttaagattttggagcatttgaggagtttgggctgtggtgctgtgttggttagtggaaatgagcttaggcttgctcttcgtgctggtttcgatcccacaaagtgcattttcaatggaaatgggaagttgttggaagatttagttctagctgctcaagaaggtgttttcgtaaatgttgatagtgagtttgacttgaataacattgtggaagcttcaagaatttctggtaagcaggtcaatgtactgctgcgtatcaatcctgatgtcgatcctcaggtgcatccatatgtagctactgggaacaagaactcgaagtttggtattagaaatgagaaacttcaatggtttctggatgaagtgaaggcacatcccaaagagctgaagcttgttggagctcattgccatcttggctctaccattacaaaggtggatatattcagagatgctgcggttctcatgattgaatacattgatgaaatccggcgtcaaggctttgaggttagctacttgaacattggtggtggtttagggatagattattatcatgctggcgctgtccttcctacacccatggatctcatcaacaccgtaagagagcttgttctttcgcgagacctgaatctaataatcgagccagggagatcgctgattgcaaacacatgttgtttcgtcaaccatgtaactggtgtgaagacaaatggaactaaaaacttcatagtgattgatggaagtatggctgagcttatccgtcccagtctttatgatgcctatcagcatattgagttggtctctcctacaccgcctgaagcagaggtttccaaattcgacgtagtgggtcctgtttgtgaatctgctgatttcttgggaaaagacagagagcttcctactcctccgcagggagcttgtttggtggttcatgacgctggtgcatactgtatgagtatggcttccacttacaatctcaagatgcgacctccggaatactgggttgaagaagatgggtcgatcaccaagatcaggcatgctgagacttttgacgaccatttgcgtttctttgaaggtctatgaactctttgatttactcatcactgttgctatttttgttgaattgtatgattattcggaatcaggaccataatgctattgctgtcttagtatttccacattatgtgctttgattcaaagtcctcaataaagtgatcatacgaataagaaaaaggtcacaagccaagacagaaaataaaaggtgaatttgtgggttatgattattcttttggtttcttctta

SEQ ID NO: 2212 - DNA, 1512 bp, Artemisia annua
ccatcaaagcagtcatctcccaaacacccccacaaacccagaaattcacccactgtttcacaaaacagaagatgggtacttatatgttgagaaaaccaaagttgaggagataatgcaagtggtggaaaaaagaccattttatttgtacagtaaggctcagataacaagaaatgtggaggcttataaagaggctttggagggtttggataatagtgttattggttatgctataaaagctaataataatttcttgattttgaaccatttgaggagtttgggttgtggggctgttttggttagtgggaatgagttgaggttggctttgaaagctggttttgatcctacaaggtgtatattcaatggaaatggtaaacttttggaggatcttgttcttgctgctcaagaaggtgtatttgttaacatagacagtgaatttgatttggataatattgtatcggctgcaagaattgctggaaagaaagtcaatgtattgcttcgaatcaatcctgatgttgaccctcaggtccatccttatgttgcaaccggaaacaagaactccaaattcggtatcagaaatgaaaaattgcaatggtttttggatcaagtgaagtcgtatccagatgaacttaagctagttggtgctcattgccatcttggatcaaccattaccaaggttgacatatttagagacgctgcagaaattatggtgaagttcattgacgaaattcgagcccaagggtttgatattagttatttgaacattggaggtggtcttgggattgattattatcatactggcaccgttcttccaacaccaagagatctcatcgacacggtgcgggatctagtcaagtctcgaaaccttaatctgattattgaacccgggaggtcacttattgcgaatacttgctgccttgttaaccgcgtcactggtgtcaaaacaaatggcacgaaaaactttattgtgattgatggcagcatggctgaacttatccgtcctagtttgtacgatgcttatcaacacatagagctagtttctcctccaccacctgatgctcctgtatcgacttttgatgttgtgggcccggtttgcgagtctgccgatttcttgggaaagaatagggaacttcctgctccagccaggggttctgggcttgtagttcatgatgcgggtgcctactgcatgagcatggcttcaacttacaacctcaagatgcgcccacctgagtactgggttgaagaagatggatcagtttccaaaatcaggcatggggagacttttgacgatcatatgagatacttcgagggactctaggttacacgaagcgcttgtaattttttttaagattccaagttccctttatggcgaaactttgtcatttgcgaatgttctacgagttgaattcttggttctctattggggtttgtctgccattgatggctggtttaacttgtaatgcatcttagcatcttcacttttagcttttgagtatgcaactatgcatttctttt

SEQ ID NO: 2213 - DNA, 1000 bp, Brassica napus
gagtttgacttggagaatattgtggaagcttcgagaatatctggtaagcaggtcaatgttctgctgcgtatcaatcctgatgtggatcctcaggtgcatccatatgtagccaccgggaacaagaactcaaagtttggtatcagaaacgagaagcttcagtggtttctcgatgaggtgaaggcacatcccaatgagctcaagcttgttggagctcattgccatcttggctctaccattacaaaggtggatatattcagagatgctgcggttctcatggtggagtacattgatgagatcaggcgtcaagggtttgaagttagttacttgaacattggtggtggtttagggattgattattaccatgccggtgctgtccttcctacacctgtggatctcatcaacaccgtgagggagctagttctgtcacgagacctgaatctaataatagagccagggaggtcgttgatagcaaacacgtgctgtttcgtcaaccatgtgacaggtgtgaagacgaatggaactaaaaactttatagtgatcgatggaagtatggctgagctaatccgtcccagtctttatgatgcctatcagcacattgagttggtctctcctccagcacctgaagcagaggtttccaaattcgacgtagtgggtcctgtttgtgaatctgctgatttcctgggcaaagacagagagcttcccactcctccaaagggagctggtctagtggttcatgatgctggtgcgtattgtatgagcatggcttccacttacaatctcaaaatgcgtcctccggaatactgggttgaagatgatggttctatcactaagatcaggcaagctgagacattcgaagaccatttgcgtttcttcaacggtctatagattttccattcatcattgtttgttgttatctccattcacctctgtaatgctattgctgtgttacattttcatgttgcttgttaaacccaaagtcttcaataaggtgatgaataag

SEQ ID NO: 2214 - DNA, 1587 bp, Cleome spinosa
caagaaggttgtcttttgagtaggttttttcggtcccatttccgttctgacgtagtcaacgacgacatcgaagctctgtggctccaccaatggcggcgactacacatctcctctaccaatctccgattcttccgaaaatccaagctcaacaccaattcactcggaacccatttcccagaacccccattttacctcttaaatcgaacctcaagcccctgaaacgcctctccctcaaagccgccgtctcccataaccctgcaaaaaccctaaccagggatgctaatagcgaccagacaacctcgtttcaccactgtttcaagaaatcctcagatgggttcctctactgtgaggaaactagggtccaggacatcatagagagcgtggagaagagacccttttacttgtacagcaagcctcagatcacccggaacttcgaggcgtacagtgaggccttgagagggttgcgatcaatcatcggttacgcgataaaagccaataacaatctcaagattcttgagcatttgaggggtttgggttgcggtgctgttcttgtcagtggaaatgggctcaggcttgctctccgagctggtttcgatccggctaagtgcatcttcaatggaaacggcaagctcttggaggatttggttctagctgctcaagaaggcgttttcgtaaacgttgatagtgaattcgacttagagaacatcgtgcaagcttcgagaattgctggcaagaaggtcaatgttctgcttcgtatcaatcctgatgttgaccctcaggtgcatccatatgtggctacagggaacaagaactcaaagtttggtattaggaacgagaagctccagtggtttctggatgaggtgaaagctcatcccgaagagctgaagcttgttggagcacattgtcatctaggatctaccattacaaaggtggatatattcagagatgctgctgtccttatggtgaaatatattgatgaaattcgagctcaaggcttcgaagtcaattacttgaacattggtggcggtttagggatagattattaccacactggtgctgtccttccctcaccgagggatctcatcgacactgtgagagagcttgttctttcacgcgacttgaatctaataattgagccgggaagatcacttattgcaaacacttgttgtttcgtgaaccacgttactggcgtgaaaacaaacgggactaagaatttcatagtggttgatggaagtatggctgaacttatccgcccgagcctttacggtgcctatcagcatatcgaattggtctcttctccgccacatgaggcagaggtttccacatttgacattgtcggtccagtgtgcgaatctgccgatttcttggggaaagacagagagcttccgaccccttcaaaaggtgccggtctggtggttcacgacgcgggtgcatactgtatgagcatggcgtcgacgtataatctcaagatgcgccctcctgaatactgggttgaagaagatgggtcaatcgccaagatcaggcacggagaggcattcgaagaccatttgcgtttcttcgaaggtctttgagcatgacacctctgag

SEQ ID NO: 2215 - DNA, 1656 bp, Vigna unguiculata
  misc_feature (827)..(827): n is a, c, g, or t
  misc_feature (832)..(832): n is a, c, g, or t
ggggcaaaatcattcatctaacacactgcaatggcaggctcacaccttctttctcactctcattcccttcccaaaacctataaccactcctttaaccaaaaccctttatctcaaaagcttcttctacccctcaaattcaaagccaccctcagaccgcgtgctctcagggctgttctctcccagaaagctgctcaaaccgcggtagaggactcaaagaaggctccttttcagcactgtttcaccaaatccgaagatgggtatctctactgtgagggcctcaaggtacatgacatcatggaatctgttgagaaaaggcctttctatctttacagcaagccccagataactaggaatgttgaagcctataaaaatgcattggaagggttgaattctataattgggtatgccattaaggccaacaataacttgaagattctggaacatttgaggcacttgggctgtggagctgtgcttgttagtgggaatgagctgagattggctcttcgtgctggctttgatcccacaaggtgtatctttaatgggaatggtaaaatcttggaggacttggtcttggctgcccaagcaggtgtgtttgtcaacattgatagtgagtttgacttggagaacattgtagaggctgcaaaaagggctggaaagaaagtcaacgttttgcttcggattaatcctgatgtagatccacaggtccatccttatgttgccaccgggaataagaactctaaatttggcattagaaatgaaagttgcaatggttcttagatgcagtgaagagcatcctaatgagctcaaacttgtagggcccactgccntctcngttcaacaatcaccaaggtagacattttcagggatgctgccaccattatggtcaactacattgatcaaatccgagctcagggttttgaagttgattatttaaatattggaggaggacttgggatagattattatcattctggtgccatccttccttcaccaagagatctcattgacactgtacgagatcttgttctttcccgtggtcttaatctcatcattgaaccagggagatcactcattgctaacacatgttgcttagttaaccgggtgacaggtgttaaaactaatggatctaaaaacttcattgtaattgatggaagtatggcagaacttatccgccctagtctctatgatgcttaccagcatatagagttggtttcccctgccccatcaaatgctgagaaaacaacctttgacgtggttggcccagtctgcgagtctgcagatttcttaggaaaagaaagagaacttcctactccagccaagggtactggtttggtggttcatgatgctggcgcatattgcatgagcatggcatcaacatacaatctaaagatgcggcctcctgagtattgggttgaagatgatggatcagtgagcaaaataagacacggagagacttttgaagaccacattcggttttttgagggcctttgagctggtaattcatcctgtaggaaaggaagctggaaaattgttgtgtattttggattttggatctttcctagtcactgaatgcatcactcttttttcttgtttttcttctattctacttcaataaagttgactttggttagattatacactgcagttaatctttta

SEQ ID NO: 2216 - DNA, 978 bp, Momordica charantia
gaaatgagaagttgcagtggtttcttgatgctgtcaaggcgcatcctgatgagcttaggcttgtcggggcccattgccatcttggttccaccatcaccaaggtggacatattcagagatgctgcagtactaatggtcaactacattgaccagatcagagatcaaggttttgaagttaattacctcaacattggaggtggacttgggatagattattatcatgctggcgcggttcttcctactcccagagatctaataaatacggtacgggagctggtcctttcacgagatcttaatctaatcattgaacctgggagatcacttattgccaatacttgctgtttggttaatcgagtgacgggggtcaaaactaatgggactaaaaactttattgtgattgatggtagcatggccgaactgatccgccctagtctttatgatgcttatcaacacatagaattggttgctccttcagcatctgattccgaaatctcgacttttgatgtggttggccctgtctgtgagtctgcagatttcttagggagggaaagagaactcccaactccaaacaagggagctggtttggttgtccatgatgctggtgcttactgcatgagtatggcatctacttacaatctcaagatgcgtcctcccgagtactgggttgaagacgatggatctgtgtccaaaattaggcatggggagacatttgacgatcacatacgattcttcgaaaatctttgactggagattcgcatccattcctcttgttcaactatggccttttcccccatgtatgcttggctttttcaactattcaatcaagctgttggccaaagttgagtaatgttttagaaagactgttgttgagtttgtgtaaactttaaaaacaaatgaaaaagtgatcatgtttctcatcttatattcagtgtctaaagattaaaaagaaacagggaacttgttaccaaattatggtagg

SEQ ID NO: 2217 - DNA, 1608 bp, Cynara scolymus
  misc_feature (1397)..(1397): n is a, c, g, or t
  misc_feature (1408)..(1408): n is a, c, g, or t
  misc_feature (1422)..(1422): n is a, c, g, or t
  misc_feature (1447)..(1447): n is a, c, g, or t
  misc_feature (1496)..(1496): n is a, c, g, or t
  misc_feature (1499)..(1499): n is a, c, g, or t
  misc_feature (1508)..(1508): n is a, c, g, or t
  misc_feature (1511)..(1511): n is a, c, g, or t
  misc_feature (1521)..(1521): n is a, c, g, or t
  misc_feature (1534)..(1534): n is a, c, g, or t
  misc_feature (1541)..(1541): n is a, c, g, or t
  misc_feature (1547)..(1547): n is a, c, g, or t
  misc_feature (1577)..(1578): n is a, c, g, or t
cactttaccttcctcagtttcctcatcaatggcggttgcttattcttcttctcaccttcaacttcaaccactgtctttcaccaaaaccctaaatcgttcttcgaactcgatcacacccaaaaccctagtttccttcaaacccaattcaaaaactcttggtatccgagcaatcatatctcaaacacctccagaaacccagaaatttgagcattgtttcaccaaaaaagatgatgggtatttgtactgcgagaatcttaaggttcaagaagtcatggaggccgttgaaaggaggccattttatctttacagtaagcctcagataactagaaatgtggaggcttataaggatgctttggagggattgaattcggttattgggtatgcaattaaggccaataataacttcatgattttacagcatttgagaagtttaggttgtggggctgttttggttagtggcaatgagctcagattggctcttcgtgctggttttgatcccaccaggtgtatttttaatggaaatgggaagcttttggaggatcttgttcttgctgctcaagaaggtgtctttgttaatatagacagtgaatttgatctggataatattgtatcagctgcaagaattgctggaaagaaggtcaatgtactgcttcgaatcaatccggatgttgaccctcaggtccatccttatgttgcaaccgggaacaagaactccaaatttggtataagaaacgagaagttgcaatggtttctagatgccgttaagtcgttccctgatgaacttaagctagttggagctcattgtcatcttggatccaccattaccaaggttgacatcttcagggatgctgcagccattatggtgaagttcattgacgaaattcgagcccaagggtttgacattaattacttgaacatcggaggtggtcttgggatcgattattatcataagggcaccgtacttcctacacccagagatctgattgacacagtccgggagctggtcttgtctcgaaaccttaatctcattattgaacccgggaggtcactgattgcgaatacttgctgctttgttaatcgtgtcactggtgtaaaaacaaacggcatgaaaaactttattgtgatcgatggcagcatggctgaacttatccgtcctagcctatacgatgcttatcaacacatagaattggtttctcctccacctcctgattctgcggtttcgacttttgatgtcgtgggcccggtctgcgagtcggccgattttttggggaaaaacagggaacttcccgctccagccagggattctgggcttgtagttcatgatgccggtgcctactgcatgagcatggcttcaacttacaaccttaagatgcgcccaccggaatactgggttgaanaagatggatcngtagccaaaatcangcatggggagacttttgaagatcanatgagatactttgagggactctcactctaacttcatttgcacttttctnctnctttctatntcnagatttcttnaatctctgtttcnttttctnaaactnaaattgcattatctgcaacgtattggctcnnttaactcttaaatcaactttaaaatcaaca

SEQ ID NO: 2218 - DNA, 1835 bp, Helianthus annuus
acgtcactagcaaaaacccttgctcctatttcaacccacaatcactttctgcctccactctgcaccctctcaccaatggcggctgcatcttctccttcatccgctcacccccaactcatttcattcaccaaaaccctaaacaacaaatccccattcacctccaaatccctaatctccttcaaacccactttcaaacccttcaccatcaaagcaatcacatccgaaaaaccaacacaaacccacaaattcgaccactgtttcaccaaacaagacgatgggtatttgtactgcgagggtctcaaggttcaagaagtcatggaggctgttgaaaagagacccttttatctttacagtaagcctcagataacgaggaatgttgaggcgtataaggatgctttggagggcttgaattcgatcattggttatgctattaaggcgaataataattttgtgattttgaagcatttgagagagttgggttgtggggctgttttggttagtgggaatgaacttagattggctcttgctgctggttttgatcctacaaggtgtgtttttaatggaaacggaaagcttttggaggatcttgttcttgctgctcaagaaggtgtgtttgttaacatagatagcgaatttgatttggataacattgtatcggcagcaagaattgctgggaaaaaggtcaatgtattgcttcgaatcaatccggatgttgaccctcaggtccatccttacgttgcaactggaaacaagaactccaaattcggtatacggaacgaaaaattgcaatggtttttagatgccgtgaagtcatatcctgatgaacttaagctagttggggcccattgccatctcggatccaccattaccaaggttgacattttcagagatgctgcagcaattatggtgaagttcatcgacgaaatccgtgcccaagggttcgatattagtcatttaaacattggaggtggtctcgggatcgattactatcacaccggcaccgttcttcctaccccaagagatctcatcgacacagtgcgggagctagtcaagtctcgaaatctgaatttgattatcgaacccgggaggtcgctcattgctaacacttgctgttttgtgaatcgtgttacgggtgtgaaaacaaacggtacaaaaaactttatcgtgattgatggaagcatggctgaacttattcgtcctagcctatatgatgcgtatcaacacatagaactggtttctcccccaccatcggattctgctgtttcgacttttgatgttgtgggcccggtttgcgagtcggctgatttcttggggaaaaatagggaacttcctgcaccagccaggggttctgggcttgtagttcatgatgcaggtgcctactgcatgagtatggcttcaacttacaacctcaaaatgcgcccacccgagtactgggttgaagaagatggatccgtagccaagatcaggcatggggagacatttgatgaccatatgagattttttgagggcctctcagtctagcttatatcgcggccttcttatatctatgtgtttgtatctctatcttttgaatacaagattctaagttccatttgatggccaaatcatgtgatggattttgcctgccactagtattgcatctttcatgtttagaagattacaaggcatgatttgaattgtttgatctttttcgtcccgtctttatgaaatcgtccaactcttagggatcatctcctatgtttagagatttacatgacaaaagttaatgtgaaagttgtatgctaaggcgatttaagtatcatgtcgaatacataatacactagacgcgcttgaaa

SEQ ID NO: 2219 - DNA, 950 bp, Trifolium pratense
  misc_feature (431)..(431): n is a, c, g, or t
tcaactacattgacgaaattcgtgctcagggttttgaagttgattatttaaatattggtggtggacttggcatcgattattatcatgctggtgctgtccttcctaaacccagagacctaattgatactgtacgggagcttgttctttcccgtggtcttaaactcatcattgaaccagggagatcacttatagcaaacacctgttgcttggttaaccgggtgacaggtgtcaaaactaatggctctaaaaacttcattgtcattgatggaagtatggctgaacttatccgtccaagtctttatgatgcttatcagcatatagagctggtttctcctgccccagcaaatgctgagatagcaacttttgatgtagtcggccctgtctgcgagtctgcagatttcttaggaaaaggaagagaacttccaactccngccaagggtactggtctagttgttcatgatgctggtgcttattgcatgagtatggcatccacttacaatctaaagatgcgacctcccgagtattgggttgaaaacgacggatcattgagcaaaatcagacacggtgaaacattcgaggaccacatgcggttctttgaggggctttgaactgataacttgtattttcttactcaaacgaaagctcgagatttgttgtattggggtttggatctttccttgttcacgtacgcgataatttggttttgattctaatgcatactcttgaagggaaagcagaataaaagagaattcagttaagatgtaacacatcattaaatttaaatttcccctttctagtttcagttaagcaaatgtttgtttttgcagctatcacatatcacaacatattcacatgtaatgtggagcttttgtatggtggttgtatacatttgataatgactgaaaaccaatttgacaatttagattcatgtaaactcttttataaggttg

SEQ ID NO: 2220 - DNA, 2094 bp, Aristolochia fimbriata
tagaaagtcctaaagtatgagtaaaagtaaaaaccctaaaaggctaaaaccctctgacggtccaactcggcctccaagctcatttgctccgaacacttgaggtctgaactgatcggcaatggcgacgacgtgttttctagctcgtccttcgcggttcgcaaggaccaccagccctttggacgtggtatgtatcaccaagccttccatcgctctgaagcaactttcgacaaaaacctccaaagggttccggctacgagctgtcctctccgagaagccccaagttcaatcctccacaaaattcaagcactgtttcagcaaatctgacgatggtcatctctactgcgagggtttgaaagtgcaagagttgttggattctttcgagcaaagacccttttatttatacagtaaacctcagattacccgaaactgtgaagcttatcgcgaggcgttgcaggggttgagttcgatcattggatatgctatcaaggcgaacaataatctcaagattctcgagcatttgagacgactgggctgcggagctgtcctcgtgagcgggaacgagctcaagttggcgcttcgtgctggttttgaccccaaaaggtgcatttttaatggtaatgggaagcttttaaaagatctggtcctggcggcagaagaggaagtttttgtgaatgtggatagtgaatttgatttaaagaatattgtaaccgcatcgagaattgctgggaaaaaagttaatgtgttacttcggataaatcctgatgttgatccccaggtccatccttatgttgccactgggaacaagaactctaaattcggcattagaaatgagaaacttcaatggttcctagatgctgtgaagtcacatccaaatgaattgaagcttgttggggctcactgccatcttggctctactattaccaaggtagacatattcaaggatgctgcagttctcatggtgaattacatagatgaaattcgagctcagggctttgaaattgattacttaaacataggaggtggtcttggaatagattaccatcacagtggtgccattctccctactcccatggatcttatcaacactgtacgtaaattggttatttctcgaaatctaacactgattatcgaacctgggagatctctaattgccaatacttgctgttttgttaatcatgtcactggggtcaaaaccaatggcacaaaaaattttatagtggtggatggcagtatggctgaacttatccgacctagtctttatggggcatatcagcacatagaactaatttctcctccaccatctgatgccgaggtttcagtctttgatgttgttggcccagtctgtgagtcagccgacttcttaggcaaggatagggagttgcctactcctcccaagggtgctggcttggttgttcatgatgcgggggcatattgcatgagcatggcatcaacttacaatctgaaaatgcgcccaccagaatactgggtggaagatgatggatccgtgtcaaaaatcaggcacgcagagacatttgaagataatttgagattctttgaaggtctatgatggatgagttaaggtatatgattggtgagcttttgaataatggggtcgttgttgtaacttatgtcgcttctgtgctgatttttacgacgtgattcatcattagatgagataaaagatattttgttttcctacaggaacacaggttccctgttgggagatcatgtattccttggcctggcttttttgttagttctacgtttaccttttgtcgcttattaaataagatcggaagttgaataaagttcttgacggaataggtaaacttatgaattttccaattagtgggtaaattaagggtctgtgtaatgaactccactgcaagcactatgtacaagcatgaaacgaagagatgaatataatggaaagggaggagtcggggaatgattagtgaagaagttaccaagacattattattacaaaaaaaaagggtgaaagaagagtggagcttttaacaagcattagtctgcgagtgaatatcgttttcatagagattgatgattaagcacaaaattatgttaccctcgtga

SEQ ID NO: 2221 - DNA, 1815 bp, Carica papaya
atcaaagcggctctaagttcagctccagagctgccatactctccggctgctacagtcaagactcaacgttctttctccatcaatgatggcgaatcactatttttctttacagtcgagaccgaacactcttcctccatcaatgatggcggttcactcttcgtctctgtcaagaaccctaaaacatccattgcaccaaaactcattttcccaattccccattttgcctctcaaatccaatctgaaacccgtgaaacccctctcccacatggcagtcgtccagaatccttctaaatccctgaaccaagaagaaaaaacagcggagtttcaccattgtttcacaaaatcccctgatggatttctttgctgcgagggggtcaaggtgcaagatatcatggagactgtcgagagaagacctttttatttatatagcaaagagcagattactagaaatgttgaggcatataaagaggccttgcagggattgaggtctataatcggttacgccataaaagccaacaataatttgaagattttggagcatttgagacatttgggatgtggatctgttttggtctctggaaatgagctaaggcttgctcttcgtgccggttttgaccctaaaaaatgcatctttaatgggaatgggaagcttctagacgatttggttctagctgccaaagaaggtgttttcgttaatattgatagtgaatttgaccttgaaaacatcatagcagctgcaagaattgctggaaagagggttaatgttttacttcggataaatccagatgtggacccacaggttcatccatatgttgctacaggaaacaagaactctaaatttggcattaggaatgagaagctgcaatggtttctggatgctgtgaaggcatatcctagtgagttgaaacttgttggagctcattgtcatcttggttcgactattacaaaggtggacgtatttagagatgctgcagttattatggtgaagtacattgatgaaattcgatctcaaggattcgaagttgattatttaaacattggaggtggtttagggattgattattatcatagtggtgctgtgcttcccacacccaaagatcttattgacacagtgagggagcttgttctttcaagagaccttaatcttataattgaacctgggagatcacttattgcgaatacatgctgcttggttaaccgggtcactggcgttaaaacaaatggaaccaaaaacttcattgtcattgatggcagcatggctgaacttatacgtcccagtttgtatgatgcttatcaacatatagaactggtttctcctacatcatctgatgctgaagtttctacatttgatgtggttggtcctgtttgtgagtctgcggacttcttaggaaaggagagaaaacttccaaccccagctaagggagctggcctggttgttcatgatgcaggtgcttactgcatgagcatggcatctacatacaatctcaagatgcgtcctccagagtactgggttgaagaagatggatcagtggccaaaattcggcatggagagacatttgaagatcatatgcggttctttgagaatctctgattgtagacatcagcctttgagcggcttgaaatttggtttgtcttcatgaatgctgtttctgaaatctggatattgctgaatatagcaacttttttgccaacctgttgaattgaattctcttgattatagtgataatcagcgcaaaagtaagaaccggaaatgaaacaaggaggccagataaaacaattaaaaaaataaatgtgacacagcaattatgatttgct

SEQ ID NO: 2222 - DNA, 958 bp, Prunus persica
  misc_feature (4)..(4): n is a, c, g, or t
  misc_feature (658)..(658): n is a, c, g, or t
  misc_feature (757)..(757): n is a, c, g, or t
  misc_feature (839)..(839): n is a, c, g, or t
  misc_feature (864)..(864): n is a, c, g, or t
  misc_feature (880)..(881): n is a, c, g, or t
  misc_feature (908)..(908): n is a, c, g, or t
  misc_feature (931)..(931): n is a, c, g, or t
tggngactcccgctcgtggcgcgtccactctagtggctaccaaataccccggctacatgctgtacagaactccaaattcggtattagaaatgagaagctgcaatggtttttggatgctgtgaaggcacatccgaatgagctaaaacttgttggcgcccattgtcatcttggatccactattaccaaggtggatatatttcgggatgctgctgttcttatggttaagtacattgacgaaatccggtctcaaggttttcaagttgattacttaaatatcggtgggggacttgggatagattactatcatgctggtgccgtacttccgacacccagagatcttattgatactgttcgcgacgtggtccaatcacagggtctaaatcttatcattgaacctgggagatcacttattgcaaattcttgctgcttggtcaaccgagtaacaggtgtcaaaacaaatggcaccaaaaactttatcgtgatcgatggaagcatggctgaactcattcgccccagtctgtatgatgcttatcaacatatagagctggtttctcctgcttcacctgatgctgagatttctacttttgatgtggttggccctgtttgtgagtctgcggatttcttagggaaggatagagaacttccaactccacccaanggagctggtctggttgttcatgatgcaggcgcttactgcatgagcatggcttcaacttacaatcttaaaatgcgacctccagaatattgggttgaagangatggatcagtggccaagatccgacatgcagagacatttgaagatcatatgcgattctttgacggtctttgattgcgcgacnttgattagttagagccagttaaagnggccagaatttttctnntatgttgtttgttgtaacattggaacntttgtatttggatatgaagttanctctttaatagaagttgtaccacctta

SEQ ID NO: 2223 - DNA, 1529 bp, Lotus japonicus
tgaccatgattacgaattcgtcctttctatctctacagtaagccccagattaccagaaatgttgaagcttatagggatgcattggaaggattgacatcgataatcggttacgctatcaaggctaacaataatttgaagattctggagcatttgagaagcttaggttgtggtgctgtgctagttagtgggaatgagctcagattggctcttcgtgctgggtttgatcctacaaggtgtatctttaatgggaatgggaaaatcttggaggatttggtcttggctgcacaagcaggtgtgtttatcaacattgatagtgaatttgacttggagcacattgttgaggctgcaaggattgctcggaagagggtgaatgttttgcttcggattaatcctgatgttgatccacaggtccatccttatgttgccactgggaataagaactccaaatttggcattagaaatgagaagctgcagtggtttttagattctgtgaaggcacatcctaatgaactaaagcttgtaggggctcactgtcatcttggatcgacaattaccaaggtagacattttcagggatgcagccaatattatggtcagctacattgacgaaatccgagctcagggttttgaagtggattatttaaatattggtggtggacttggaatagattattatcatactggtgctgttcttcctacacccagagatctaattgataccgtaagggagcttgttctttctcgtaatctcaatctcatcattgagccagggagatcactcatagcaaacacctgttgcttagttaaccgggtgactggtgtcaaaactaatggatctaaaaacttcattgtaattgatggaagtatggctgaacttatccgcccaagtctttacgatgcttaccagcacatagagctggtttcccctgctccagaaaatgctgagacagcaacttttgatgtagttggccctgtctgtgagtctgcagatttcttaggaaaagaaagagaacttcaaactccggcccagggtactggtctggttgttcatgatgctggtgcttattgcatgagcatggcatcaacttacaatctgaagatgcgtcctcctgagtattgggttgaagatgatggatccgtgagcaaaatccgacacggagagacatttgaagaccacattcggttctttgagggcctttgagctgacaatttaccttgtaagaaaagaggcttgagatttgttgtatttggggtttggatctctccttgccaaagaaagcaccaatattttagttttgtttctttgactctcattaaatgtcgacactattgaatgggaaagaagaataaaaatgacttcacagtcatttaatttcctcccaccagtttcattttagtcatagtgctgagtatacctgcagctgttgctcaaaatgtggaggtgaaggttatccatgctgatggcatatgtttgataatcttactttgtggtgtgtcattttcagcttgagttcatattgtagctttctt

SEQ ID NO: 2224 - DNA, 1935 bp, Fragaria vesca
actttaaagcagtgtcctctgagtcgagagtagcacaccatactgttgtcttactcctctcgcttccgaacatggcggctgcacaccttaccttcaaccctccatcctccttctccaaacccctaaaccactctctcccccgcaatccattttcccgaaactccattctacccttcaaaccctcccttaaacccctcctcctcaaagccgtcctcacccaagaagcccctcaaacggtgccgtttaagcactgcttctccaaatcctctgatgggtttctctactgcgagggcctcaaggtccaggacgtcatggagtccgtggagaagcgccctttctacctctacagcaagccccagatcacccgaaacgttgaggcctataaagacgccttggagggtttaaagtctgttattgggtacgccattaaagccaacaataacttcaagattttggagcatttgaggggtttaggctgtggtgctgtgctcgttagtgggaatgagctcaggttggctcttcgagctgggtttgacccaactaggtgtattttcaatgggaatggaaagttgttggatgacttggttttggctgcccaagagggtgtctttatcaatgtcgatagtgagttcgacttggagaatattaccaccgctgcgagaatggctggcaagagggtcaatgtgctacttcgaattaacccggatgtagaccctcaggtccatccttatgtatccactggaaacaagaattccaaatttggtataagaaatgagaagctgcaatggtttttggatgaggttaagaaacatcctgatgagctaaaacttgttggggcccattgccatcttggatccaccattacaaaggtggatatatttcgagatgctgcagttcttatggttgagtacattgacaagatcagagatcaaggttttgatgttaattacttaaacattggtggtggtcttgggatagattactatcatactggtgctgttcttccaacacccagagatctcattaatactgtttgggaggtggtcctatcacgagacctaaatcttatcattgaacccggaaggtcacttattgcaaattcttgctgtctggtcaaccgagtaacaggggtgaaaacgaatggcaccaaaaactttattgtgatcgatggaagcatggctgaactcattcgtcccagtctctatgatgcttatcaacatattgaactagttgctcctgcaccgcatgaagctgagatttctacttttgatgtggttggtcctgtctgtgagtctgcagattttttagggaaggagagaaaacttccaactcctccaaagggagctggtctggttgttcatgatgcaggtgcttactgcatgagcatggcctcgacttacaatcttaaaatgcgccctccagagtattgggttgaagaagatggatcagtgtcaaagatcaggcatgcagagacatttaaagatcatatgagattctttgagggtctttgattgcgggagctcagtagtcaggcagcccgttaaagggactggattttatttatgtttgttttgtttcttctttcctgttcttttatagttttatgtcgcctctgttttcgcacttgactcgagttgtcatctatggaagcactgaatcatctagtgtcctttatatgcttcaccaagaagatgaaatttatggaatttctagttgcagataacattggagcgtgttcaatatagatgttccagttgcaccagctgcaagtaatgacattaattatgattaattacataaagctactttcagattgcttacaagtggcgttgcataacatataggttagttgattcgctcagttaggtttgttgttagtgtcaaaagggatcttttgttgataggtttgcatgtaaatgaagctttttcattaca

SEQ ID NO: 2225 - DNA, 961 bp, Malus domestica
taacgggaatggaaagttgttggacgacttggttttagcggcccaagaaggtgtttttatcaatatcgatagtgaatttgacttggaaaacattgttgccgctgcgaggattgctggcaagagggtcaatgttctacttcggatcaaccctgatgtagatcctcaggttcatgcttacgttgccactgggaacaagaattccaaatttggtattagaaatgagaagctgcaatggtttttggatgctgtgaaggcacaccctgatgagctaaaacttgttggggcccattgtcatcttggatccaccattaccaaggtggatatattccgggatgctgctgttcttatggttaagtacatcgatgaaatccggtctcaaggttttcaagttgattacttgaacatcggtggtggacttgggatagattactatcattctggtgccatacttccgaaacccagagatctaatcaacactgttcgtgacgtggtcctatcacaaggtctaaatcttatcattgaacctggtagatcacttattgcaaattcttgctgcttggtcaaccgagtaacaggtgtcaaaacaaatggcaccaaaaactttattgtgatcgatggaagcatggctgaacttatccgtcccagtctctacgatgcttaccaacatatagaactagttgctcctacagcacctgatgctgagatttcgacttttgatgtggtgggccctgtctgcgagtctgcagatttcttagggaaggacagagaacttccgactccacctaagggagctggtctggtggttcacgatgcaagcgcttattgcatgagcatggcttcaacttacaatcttaaaatgcgccctccagagtattgagtccaagaagatggatccgtagccaagatccgtcatgcagagacatttgaagacacatgcgattctttgagggtctttgatggc

SEQ ID NO: 2226 - DNA, 1967 bp, Arachis hypogaea
ataacatgcagtatctcacagcttccttccaagccttgtcggcaaatagagcaaagaaggaagaacacagttacttgccatggcaagcacacacctcgtttctcaatctccttccattccaaaaaccttgaatttcagcaaccctttcttttccaaatccccatttccccaaaacctagttcttcccctcaaagcttcccttaaaccccgcgttctcagagccgttaacgctgccaatactcccctggtgaatcctgcagagaagaagacccatttcaagcactgtttcacgaaatccgatgacggttacctttactgcgagaccgttaaggtccaagagatcatggagtccgtggatagaagacccttctacttgtacagtaagccccagattacaagaaacgttgaggcttataaggatgcgttgcaaggtttgaactctgttattggttatgccattaaggcaaacaataacttgaagattctcgagcatttgaggcacttgggttgtggtgctgtgcttgttagtggtaacgagcttaggcttgctcttcgtgctggatttgaccccacaaggtgtatctttaatgggaatgggaagattttggaggatttgacattggctgcactggaaggtgtgtttatcaacattgacagcgaatttgacttggaaaacatcgttgccgctgcaagagttgttggaaagagggtcaatgttttacttaggatcaaccctgatgtggatccacaggtccatccttatgttgccactggaaataagaactctaaatttggcattagaaatgagaagctgcagtggtttttagatgctataaaggagcatcctaatgaggttaagcttgtaggtgcccactgccatcttgggtcaacaattaccaaggtagacatctttagggatgctgctgttattatgatcaactacattgaccaaatccgagatcaaggttttgaagttaactacttaaatattggtggtggacttgggatagactattatcattctgatgctgtccttccgaccccaagggatctcattgatactgtacgggagcttgttctttcccgtggtctcaatctcatcattgaaccagggagatcacttgttgcaaacacctgctgtttagttaaccgggtgacaggtgtcaaaactaatgggtccaaaaactttgttgtgattgacggaagcatggctgaacttattcgtcctagtttgtatgatgcttaccagcatatagagctggtttcccctgccacagcagatgccgagatattgacctttgatgtcgttgggcctgtctgtgagtctgcagatttcttagggaaaggaagagaactcccaactccagccaagggtgctggtctggttgttcatgatgctggtgcttactgcatgagcatggcatcaacatacaatctaaagatgaggcctcctgaatattgggttgaggatgatggatctgtgagcaaaataagacatggagagacttttgaagatcacattaggttctttgagggactttgagccgagaacaaagttaattttggttgtattttggtttttggtcttttggatattgtcatgccaaagaacaccaacagtttttgttctgtttcttccattctggccaaactttgatcccttggccccttgtaggaacatgaattaaaacattgaatccagtaagagttataagagcattcaatctccttgtggtttcaatttagtaaaatgcaagtgtggttgtaaattgaaaagtggaacttgtgtataaagatatgaaatatgttctacataatcttaataatgcatatgcatactaggtagtgtttagtgtttaataatgaatactatattctacagtgtagctgtggcttactaagaaattaaacgaggctgtgttccaaattgcggtgaacagaaagagcatactaacgataatttagta

SEQ ID NO: 2227 - DNA, 1711 bp, Arachis hypogaea
gaagcccttgtcggcaaatagagcaaagaaggaagaacacagttacttgccatggcaagcacacacctcgtttctcaatctccttccattccaaaaaccttgaatttcagcaaccctttcttttccaaatccccatttccccaaaacctagttcttcccctcaaagcttcccttaaaccccgcgttctcagagccgttaacgctgccaatactcccctggtgaatcctgcagagaagaagacccatttcaagcactgtttcacgaaatccgatgacggttacctttactgcgagaccgttaaggtccaagagatcatggagtccgtggatagaagacccttctacttgtacagtaagccccagattacaagaaacgttgaggcttataaggatgcgttgcaaggcttgaactctgttattggttatgccattaaggcaaacaataacttgaagattctcgagcatttgaggcacttgggttgtggtgctgtgcttgttagtggtaacgagcttaggcttgctcttcgtgctggattcgaccccacaaggtgtatctttaatgggaatgggaagattttggaggatttgataattgctgcacaggaagatgtgtttatcaacattgacagcgaatttgacttggaaaacatcgttgccgctgcaagaattgctggaaagagggtcaatgttttacttaggatcaaccctgatgtggatccacaggtccatccttatgttgccactggaaataagaactctaaatttggcattagaaatgagaagctgcagtggtttttagatgctataaaggagcatcctaatgaggttaagcttgtaggtgcccactgccatcttgggtcaacaattaccaaggtagacatctttagggatgctgctgttattatgatcaactacattgaccaaatccgagatcaaggttttgaagttaactacttaaatattggtggtggacttgggatagactattatcattctgatgctgtccttccgaccccaagggatctcattgatactgtacgggagcttgttctttcccgtggtctcaatctcatcattgaaccagggagatcacttgttgcaaacacctgctgtttagttaaccgggtgacaggtgtcaaaactaatgggtccaaaaactttgttgtgattgacggaagcatggctgaacttattcgtcctagtttgtatgatgcttaccagcatatagagctggtttcccctgccacagcagatgccgagatattgacctttgatgtcgttgggcctgtctgtgagtctgcagatttcttagggaaaggaagagaactcccaactccagccaagggtgctggtctggttgttcatgatgctggtgcttactgcatgagcatggcatcaacatacaatctaaagatgaggcctcctgaatattgggttgaggatgatggatctgtgagcaaaataagacatggagagacttttgaagatcacattaggttctttgagggactttgagccgagaacaaagttaattttggttgtattttggtttttggtcttttggatattgtcatgccaaagaacacaacagtttttgttctgtttcttggattctggccaaactttgatcccttggccccttgtaggaacatgaattaaaacattgaatccagtaagagttataagagcattcaatctccttgtggttaca

SEQ ID NO: 2228 - DNA, 1703 bp, Raphanus sativus
  misc_feature (138)..(139): n is a, c, g, or t
  misc_feature (141)..(141): n is a, c, g, or t
  misc_feature (206)..(206): n is a, c, g, or t
  misc_feature (226)..(226): n is a, c, g, or t
  misc_feature (492)..(492): n is a, c, g, or t
  misc_feature (525)..(525): n is a, c, g, or t
  misc_feature (624)..(624): n is a, c, g, or t
  misc_feature (636)..(636): n is a, c, g, or t
  misc_feature (726)..(726): n is a, c, g, or t
  misc_feature (1511)..(1511): n is a, c, g, or t
ggaacgccactgttcctgtctcatccgaaacactcacagccatggcgacagccactcacctcctctctcaaccctcatctctccggagaaacctaaaccaataccaatcgaaccaatctcccttctccagaatcccanntntgtctctcaagtccaccctcaagccacttcaacgcctctccatcaaagccgccgccgcatcatcnccaaactctgtcaaaaccgngacgaaggactcaatcgatcagtctgcgttcaaccactgtttcaagaaatccgtcagatgggttcctctactgcgaggggaccaaggtcgaggatatcatggagagcgtggagagaagacctttttacttgtacagcaagcctcagatcacgaggaacgtcgaggcttacaagaaggccttggaaggtgtgagctcctccgtcatcggatacgccatcaaagccaacaacaacctcaagattctggagcatctgaggagtttgggntgcggtgctgtcctcgttagtgggaacgagctnaggcttgctcttattgctggtttcgatcccacaaagtgtatcttcaatggaaatgggaagctgttggaggatttagttatagctgctgaggcaggtgtnttcgtgaacgtngatagtgagttcgacttggataatatcgtggaagcttcgagaatctctggtaaacaggtcaatgttctgctgcgtatcaatcctgatgtngatcctcaggtgcatccatatgtagccaccgggaacaagaactcaaagtttggtatcagaacgagaagcttcagtggtttctcgacgaggtgaaggcgcatcctaatgagctcaagcttgttggagcgcattgtcatctaggctctaccattacaaaggtggatatattcagagatgctgcggtactcatggtggaatacattgatgagatcaggcgtcaaggatttgaagttagttacttgaacattggtggtggtttagggattgattattaccatgccggcgctgtccttcctacacctatggatctcatcaacaccgtaagagagctggttttgtcacgagacttgaatctaataatagagccagggaggtcgttgatagcaaacacgtgctgtttcgtcaaccatgtgacgggtgtgaagacgaatggaactaaaaactttattgtgatcgatggaagtatggctgagctgatccgtcccagtctttatgatgcctatcagcacattgagttggtctctcctccagcacctgaagcagaggtttccaaattcgacgtagttggtcctgtttgtgaatctgctgatttcttgggcaaagatagagatcttcccactcctccaaagggagctggtctggtggttcatgatgctggtgcatactgtatgagcatggcttccacttacaatctcaagatgcgtcctccggagtactgggttgaagatgatgggtcgatcactaagatcaggcatgctgagacattcgatgaccatttacgtttnttccaaggtctatagattttcccattcatcattgtttgttgctgttttagtagaactattttggtttaattcaaaatcactactgtagtgctgttgctatgttaagactttcatatttgcatgtttttactccaaagtcttgaaataaggtgatgaataagaaaaaggacacagaactgtgtttttgtttga

SEQ ID NO: 2229 - DNA, 4058 bp, Solanum phureja
aaaattaatagtgatataaataagctaagcaagagctattttgatgttcttggaatttgttgtacatcagaagttgttttggttgagaaaattctcaagaatcttgatggtgttaaagaagtttcagtaattgtcacaacaaagactgtcattgttactcatgattctcttctcatttctcaacaacaaattgttaaagcattgaatcaagcaagactagaagcaagtataagagtgaaaggattgcaaaactaccaaaagaaatggccaagtccatttgcaattggtagtggaattttgcttgctctttcatttctgaagtattttttcttacctctccaatggttagcacttgttgctgttgttgttggaattccccctattatttttaggggtattgctgccatacgcaacttcacacttgacatcaacattcttgtattaattgcagttgctggatcaatagttttacatgattattgggaagctgctactattgtgttcttattcactattgctgaatggctagagtcaagggcaagtcacaaggctactgctgttatgtcatcactggtgaatatagtccctcctacagcagttttagctgaaaacggagaagtagtaaatgttgatcaagtcaagttgaatagcattcttgctgtgaaagctggtgaaactataccgattgatggaattgtagtcgaaggggaatgtgatgtggacgagaaaactttgacaggggagtcatttccagtttctaagcaaaaagactcgacggtctgggctgggactacaaatctaaatggttatatcagtgttaagactacagctctggctgaagattgtgcggtggctaggatggcgaaacttgtagaagatgctcagaacaaaaagtcaaaaactgaaagatacattgacaaatgtgctaaatattacacaccagcaattgtggttatagctgctggtttggcagtagttcctaccgcattaagggttcacaaccgaaaagaatggtatcgcttggctttagttgctttggtgagtgcatgtccatgtgcacttgtgctatctacaccagttgctatgtgttgtgcactttcaaaggcagcaacatcaggtcttctgttcaaaggagcagagtaccttgagactcttgctaaaatcaaaatcatggcttttgataaaactgggacaataactcgaggagagtttgcagtgaccgagttcaggtctctcattgatggccttagcctcaatacacttctttactgggtttcaagcattgagagcaagtcaggtcatccgatggcagctgctcttgtcgactatgcacaatcaaactctgtcgagccaaagcctgatagagtggagcagtttcaaaattttactggtgagggaatatatggaagaattgatggaatggaaatctatgtagggaatagaaagatttcttcaagagccggatgtactacagtgccagaactagagggtgacagtatagaaggaaagtctgttggatacatatttttgggatcctctccagctggaattttcactctttctgatgtttgtcgaactggcgtaaaggatgcaatgagagaactgaagcagatgggaatcaaaactgtgatgctcactggtgattgttatgcagctgccaaccatgtgcaggatcagttaggtggagctttggatgaatttcaagcagaactcttaccagaggacaaggcaacaatcattaagggatttcagaaggaagctccaacagcaatgataggcgacggacttaatgatgctcctgcattagcaacagctgatattggtatctcaatgggtatctctgggtcagcacttgcgaaggaaacaggacatgttatactaatgacaaatgacattggaaggataccgaaagctgcacgtcttgctagaagagttagaaggaaaataattgagaatatgataatagcaattggtacaaagggtgccatagttgcattggcaatagcaggtcatccgttggtttgggctgctgtcctcgcagatgctgggacatgcttgctagtgattttgaacagcatgctactgctgcgaggagctacacgtagacatgagaaaaaatgttgtaaatcttctacttcttcgcatgctcaccagcacgaaagtaaagcttcttgttgcaagtcggaaaaggctcctcaactatgttgctctgatattgagtcacaaaaagaatgtagaaagcaatcatgctcgtccgaggtgtgtgttcaaaaacgtcaacctttcccctcaggatcaacgtcgagtggcaataatcagtgctcaaactccattgaaaataatggtcatcattctcattctcattcgcatcctcagtgctgctcatccaagatgtctgttacagcatgccaatctgcagtttcagaatcgaagtcgtgtggaagtaacaattgctcagactccattcacaagagtagttgtcattctttgacaaactcctcaataagttcttcagatatgtctgctccacgatgtcattctgccacgtcaaactccaaattatgtggaagtaccaagagctccaacttaagtgacaaaaatagttgtcgatctcacgaaattcctcaaacgtgctctaccaagaaggctgctcatggatgccactctgaagtttctggtcctaaatcatgtggaaatagcaagtgttccgactcaagagacaataatatccatcattcacattctgatcatcaaacatgcgcgtccaaggtgtgtgctccacaaagtccatctgcaacttcaagctcaacgacatgtggaaaaacaaagtgctcgaacaccactagcaagaattcttgtcattcacatgctaactctgaaccatgctcttcaaaaaagtctggtccagcatgccaaaatgctaattcaggatcaaggtcatgcggaaatcacaaatgccaagactctgcaaccgaacaaggtattcattcacttactgatcaactctctgaggaaaagatttcggagcagaaaagcttggttttagaatcaaatcatgatcttagtcatggctgctgtgaagaggaacatgaccatcatccaaatttagacaaagcatatgacagttgtgcattacaagaatgttgttattcggttcaaggagatataaatgacatatcagaaactggaatccaggaaacttctcaatgtgatagcactaatcaaacatgccaaactgtaatttcaggctcaatgatctgtggagataataagagcctggactctgtagacatccatgggtgtcattcacatgctcatccaccccacaaggaggaaccacatcattctgttggacatggctgttcggacaaggaacacgatcattcacatccagagaaatcatatgacagttatgcaacacaagattgttgtttttcagttcaggaccatagcattgacatatccgaaaatggaactgctcattgtgacagcattaaacaaagcatggtcattccaagtagctgcaaacatacaccacaagatcaggtaagtcactgtggatttcactctacaactacccctactgatgaagaactagccaagctggttagaagatgttgcaattatagaccatgccacgaagtccgctctggctacagaaagcatgctgcagaatgtggtccaaccacccgatcaaccatcaatatcttacgggacaaccatcatcatcatctagactgcagtggtcgtaaggtttgttcgccaattgagaagagacacattggtggatgctgtgaaaccttcagaaaagaatgttgccccaagaacaatcattttgcatcaagttttggaggaggtttatcagaaattgttttagagtaagatgcaatcttaaagtgtaaatatgttgcaacttttctacctattttatcttcaagaagctgagatgctattttgtattaacatagctattacaatggcttgtatattaatcctaaaaatggtttgtgtatttgctgaattctaacaatgttggaagcttcaatgtcatttacatg

SEQ ID NO: 2230 - DNA, 958 bp, Solanum phureja
gccaaatcaaacagccaaacacggcacaaagagatactctccaatcttcttcttcttcttctctctcaactgtaaaacagcaaaaatggcggcttctgctcgacgatcaaccggaccggttctccgttcactgtcccccgccgggagattttactcgtcgacatctagaacttcgtcgtcttcggcttcatcgatccggttcacactggaccgtgaaacttccccgagccgatctatttccgtaatgaaccggcagaaaacaatggcttcttctcagaagaagacgtgtatgtgttcaccgacgaatcatccaggttcgttccgttgtagtatgcataagaaaatggataatcgacggagtagtaatactagccaaacagcgtcgaattcgattcgattgcatatgaggcgatcggcgatgacgaattcgttagtgcgaatcggaactgttgaaggtgagcttgttaaaagagctttagcggctttgattcgtccttcttctcatcaacagcgccgccgttccgatttccaacgccgacctagccggctttccgttatttccagtcccggtgattcataagactgatactcgacctctagaagtttctgttgaatgctgacgtcagcattcaacaacgccgtcccgccgatctagccggatttccattatttccggtgccggtgattcgtaagacatgaatagagctgttagaagtttgcttttctagtgaatgctgacctcagcaatcgatgtctggccgtgaagtgacggcgacggcagctgcaacaaggtggcggcaaatggagtatacacggtggaggtcggaacggaacgatttttttgtgtactccggtgaccaaaacgttaagatccatatgtctatagtctaaatacatgaagaaaattataaaatcatccaattttcctaattatgaatgcatcactaaggttctaatt

SEQ ID NO: 2231 - DNA, 897 bp, Solanum tuberosum
caaagagacactctccaatcttcttcttcttcttctctctcattgtaaaacagcaaaaatggcggtttctgctcggcgatcaaccggaccggtgctccgttcactgtcccccgccgggagattttactcgtcgacatctagaacttcgtcgtctttggcttcatcgatccggttcacactggaccgtgaaacttccccgagccggtctatttccgtaatgaaccggcagaaaacaatggcttcttctcagaagaagacgtgtatgtgttcgccgacaaatcatccaggttcgttccgttgtagtatgcataagaaaatggataatcgacggagtagtaatactagccaaacagcgtcgaattcgattcgattgcatatgaggcgatcggcgatgacgaattcgttagtgcgaatcggaactgttgaaggtgaacttgttaaaagagctttagcggctttgattcgtccttcttctcatcaacagcgccgccgttccgatttccaacgccgacctagccggctttccgttatttccagttccggtgattcataagactgttattcgatctctagaaatttctgttgaatgctgacgtcagcattcatcaacgccgccgcgccgatctagccggatttccattatttccggtaccggtgattcgtaagacgtgaatagagctgttagaagtttgcttttctagtgaatgctgacctcagcaatcgatgtctggccgtgaagtgacgtcagctgcaacaaggtggcggcaaatggagtatacacggtggaggtcggaacggaacgatttttatgtgtactccggtgaccaaaacgttaagatccatatgtctatagtctaaatacatgaagaaaattataaaatcatccaattttcctaa

SEQ ID NO: 2232 - DNA, 932 bp, Solanum melongena
ccaaatcaaacagccaaacacggcattaagaagtactcttcatcttcgttagcttcttctctctaaactgtaaaacagcaaaaatggcggcttctgcacggcgatcaaccggaccggtgctccgttcactttcccctgccgggagactttactcatccacatctagaacgtcgtcgtcttctgcttcgtcaatccggttcacactggaccgtgagacttccccgagccggtgtatttctgtaatgaaccggcagaaaacagtttcttcttctcagaagaagacgtgtatgtgttcgccgacgaatcatccaggttcgttccgttgtagtatgcataagaaaatggatgttcgacggagtagtagccaaacggcgtcgaattcgatccgattgcatatgaggagatcggcgatgacgaattcgctagtgcgaatcggtactattgaaggtgagcttgtaaaaagagctttagccgctttgattcggccttcttctcttcaacagcgccgccgtttcgatttccaacgccgacctagccggctctcagttatttccagttccggtgattcataagaccgctattcgagctctagaagtttctattgaatgctgacgtcagaatcgtgagaatttccagcgccgatctagccggctttccattattcccggtgccggtgattcgtaagtcgttattagatctcttagaagagtttgcatgctgttgaatgctgacttcagcaaacgatgcccggccgtgaagtgacgtcatttacgacaaggcggcggcgaggcgtggcggcaaatggagtacactcggtagaggtcggaacggaacggttttttttgtgtactccggtgaccaaaaccttaagatccatttatgtatagttttaatacatgcaaaaaagttataaaatcatccaatttttctac

SEQ ID NO: 2233 - DNA, 474 bp, Solanum phureja
atcaacttcaacaatggccaccattattcattctattttctccttctttttcatcatcaacattatttttctctcttcctcatattatgcactaggaggacgcgatatcctgaaaatcaacgacaaaattatacaccccgatacgttcatcccatacgatggcacggtcctaattcccggtattgggagggttgttgtcccacctattggcactcatgataatccatttacatacaatcctatcaccggctctaataatggcaacggtttagttattccaattcctggcttggcactggcattggctcttacattcctggtggtgacgatacacttgttcccaaccctggagtcgaagtccctagtggtggtaccattcctgtaccaccataggtatcgtcattaataaaaaaataaaaaagacagtctgatgcatgcataaagcattttgagttcacatcattgaatttctta

SEQ ID NO: 2234 - DNA, 633 bp, Solanum tuberosum
cattctattttctccttctttttcatcatcaacattatttttctctcttcctcatattatgcactaggaggacgcgatatcccgaaaatcaacgacaaaattatacaccccgatacgttcatcccatacgatggcacggtcctaattcccggtattgggagggttgttgtcccacctattggcactcatgttaatccatttacatacaatcctatcaccggctctaataatggcaacggtttagttattccaattcctggctctggcactggcactggcattggctcttacattcctggtggtgacgatacacttgttcccaaccctggagtcgaagtccctagtggtggtaccattcctgtaccaccataggtatcatcattaataaaaagataaaaaggacagtctgatgcatgcataaagcattttgagttcacatcattgaatttcttaatgaaataaacatggaattgcatgtagttgagttaatttaattatgtattatagtgtttgtttttgtagtgttgatgtgtgcgtgcatgtgcggctttaattttctagtgtttctctccaataaacttcattgtattcgatgtgttttaattttgtgcaaattgaattagtattatactt

SEQ ID NO: 2235 - DNA, 632 bp, Solanum phureja
cattctattttctccttctttttcatcatcaacattatttttctctcttcctcatattatgcactaggaggacgcgatatcctgaaaatcaacgacaaaattatacaccccgatacgttcatcccatacgatggcacggtcctaattcccggtattgggagggttgttgtcccacctattggcactcatgataatccatttacatacaatcctatcaccggctctaataatggcaacggtttagttattccaattcctggcttggcactggcactggcattggctcttacattcctggtggtgacgatacacttgttcccaaccctggagtcgaagtccctagtggtggtaccattcctgtaccaccataggtatcgtcattaataaaaaaataaaaaagacagtctgatgcatgcataaagcattttgagttcacatcattgaatttcttaatgaaataaacatggaattgcatgtagttgagttaatttaattatgtattatagtgtttgtttttgtagtgttgatgtgtgcgtgcatgtgcggttttaattttctagtgtttctctccaataaacttcattgtattcgatgtgttttaattttgtgcaaattgaattagtattatactt

SEQ ID NO: 2236 - DNA, 880 bp, Solanum tuberosum
atcaactcgtttgcacctcaattattttattaatcaaaaactactagttcattctatggatccaaaacaagccaagaccacatccggatcgggtcattcatcgacccataagcccaacagccacccgaagccatccaaatctgagctgatgtccagcgccaagctagtagctgacgccgccaaagcaaaactccatcacgatccaaaacaatttgagaaatcggagctcgccggagctgccgctgacctccttaacgccgcctcacagtacggtaaaatagaagagacagggatcgggaaattcgtcggaaaagcagagacttatctccataaatacgaaacttctcatcattccaccaccaccgccgccgcgactacacatacgcagtcatcggggcatacaggtggaggaaaacatgaaaaaacaggaagtggatatggggagtatattaaaatggcggaaggacttttgaagaaaaattccgatgggagtcagtcgtcggaatctggtaaaaaaggagattatctgaagatggccggagatttcttgaagaagcattgacctcgatctgatttattttatttgaaattatgttttactaatttctattttatgtttggataaatgtgatttgtaatgtgtggctaggctgcattgccacttgtgttaggccaattaatgaaaataaatttgttttacactgtttgaatcattgttatccattgtgtattgtattgtattctattgtactgtattgtatggtagatatccatacaatgtttggctagactgtactgtttgttgttgtttaataacatttttattgtttgatttgactgtatcatattgtattaacatctatagatttactaaaaaaaa

SEQ ID NO: 2237 - DNA, 924 bp, Solanum phureja
atgtgttggtacacggataatacacatgagttgtctactcgtttaagcttttacaccataacgtgttgacttgtaccacaaccaaaaatacaaaatcataatgatatagccctttccttcccctaaacaatttaatactttaaaaatcacccctttataaatatattcatagctaccattgttcattcatcaattttctcacataatcttgagaacctatcaactcgtttgcacctcaattattttattaatcaaaaactactagttcattctatggatccaaaacaagccaagaccacatccggatcgggtcattcatcgacccataagcccaacagccacccgaagccatccaaatctgaggtgatgtccagcgccaagctagtagctgacgccgccaaagcaaaactccatcacgatccaaaacaatttgagaaatcggagctcgccggagctgctgctgacctccttaacgccgcctcacagtacggtaaaatagaagagacggggatcgggaaattagtcggaaaagcagagacttatctccataaatacgaaacttctcatcattccaccaccaccgccgccgcgactgcacatacgcagtcatcggggcatacaggtggaggaaaacatgaaaaagcaggaagtgggtatggtgagtatattaaaatggcggaaggacttttgaagaaaaattccgatgggagtcagtcgtcggaatctggtaaaaaaggagattatctgaagatggccggagatttcttgaagaagcattgaccttgatctgatttaatttttttgatattatgttttactaatttctatttaatatttggataaatgtgatttgtaatgtgtggctaggctgcattgccacttgtgttaggccaattaataaaaataaatttgttttagagaacc

SEQ ID NO: 2238 - DNA, 1081 bp, Solanum melongena
agttatagtttctactgctgatttgttctatggatccaacacaagccaagactatatctggatcggtccatcattcatcgacccagaagcccaatagccacccaaagccatccaaatcggagttgatgtccagcgccaagctagtagccgacgccgccaaagcaaaactccatcatgatccaacacaatttgaaaaatccaagctcgccggagccgccgctgacctccttaacgccgcctcagagtacggtaaactagaagagaaggggatcgggaagttcgtcgggaaagcagagaattatctccacaaatacgaaacttctcatcattctaccaccacaacaaccgccgccggcgccgcttatacgactgcacactcgcagtcatcagggcatacaactgggggaaaccatgaaggatctggaagtgggtatggtgagtatattaaaatggcagaaggaattttgaagaaacattccgatgggagtcagtcgtcggaatccggtaagaaaggggagtatctgaagatggccggagatttcttgaagaaacgttgacctgttttaatttttattttttgctgaaagttcagtagataataaatttgctttggtggtgggcatttgtccatatttggtattgaaaatattgaaattgtgttagatgatgaatataaactggagttacttatatttattgagtaattttatttttattattattttttaagtttttgaaaattttagaattcgacttgaattttaaaattttaggattaaatatatttttttatgtgtaattctttttaaaaaaaaatccatgttaaatgaactacgctttatttccatttaatcttattattgtttgtaatactccatctattttaatttatttattttatttgtctttctattttatttaaaaaataaaattttgtttattaaaggtgtacattttacatttcttttatttagtactataatatgtttaatctttttctttattagattttatatctagttataatttagacaaacaaatgaaaagtgaaggaataatatatgttcattttttctttgcc

SEQ ID NO: 2239 - DNA, 796 bp, Capsicum annuum
aattatataaacttgtttgcatctcaactattttattccatggatccaactcaatccaagaccacatccggcgcggctcattcatcgaaccataagcccaacagccacccaaagccatccaaatctgagctgatgtccagcgccaaactagtagcggacgcagccaaagcaaagctccatcatgatccgaaaaattttgaaaaatcggagctcgctggagccgccgctgaccttcttaacgctgcctcccagtacggcaaactagaagagaaaggaatcgggaaatttgtaggaaaggcagagacttatctccacaaatatgaaacttctcattccacaaccacaactactcatgctgcagctgcctctacgactggacacacgcattcatcgggacatacagaagggaaacatgaagaatctggaagtggatatggagagtatattaaaatggctgaaggaattttcaagaaacattcagatggaaatcagtcgtcggaatccggtaaaaaaggagagtatctgaaaatggctggagatttcttgaagaagcattgaccctgtaccatatacaatattatctcatcttcttttcttaattaaatcttttgaattatgttttattattttttttctctattttttttttttcaaagttctattactatctcttgagtttggttattaaatgaaagttcaattatggcgaagggcaatggataaatgtgatatgtatatgtgttgcctgcgatattgccacttgtgccaatgaaaataaatttgtttaatagtggct

SEQ ID NO: 2240 - DNA, 708 bp, Nicotiana tabacum
  misc_feature (94)..(94): n is a, c, g, or t
  misc_feature (327)..(327): n is a, c, g, or t
  misc_feature (613)..(613): n is a, c, g, or t
  misc_feature (615)..(615): n is a, c, g, or t
  misc_feature (629)..(629): n is a, c, g, or t
  misc_feature (655)..(655): n is a, c, g, or t
  misc_feature (705)..(705): n is a, c, g, or t
cggggattatccaaagttcacggcacacaatctttcttcaacttatttcccaaattttctcatagtccaaacaatttcatggatccaacacaanccaaaactacctccggagccagtcattcgttgtcccataagcccaacagccacccaaaaccatccaaatctgagctgatgtccagcgctaagctagtggccgacgcggccaaagcaaaactccatcacgagccaaacagtaaggtcgacaagtctgagctcgccggagccgccgctgacctccttaacgccgcctcacagtacggcaaactagaagagaaagggatcggaaanttcgtcggaaaagcagagacttatctccacaaatatgaaacttctcattccaccaccacctccacgactgaacacacgcagtcctcggcgcatacagggggaaaacatgaacaatctggaagtggatatggcgagtatattaaaatggctgaaggaattttcaagaaacattccgatggcacccactcatcggaatccggcggaggtaaaaaaggagagtatcttaaaatggctggagatttcttgaagaagcattgacttgtactatgtgaattcctttttatcntntgttttagaatttntttgctgcagttctactattgttatntatcagtggataggtgtgatttgtaatgtgtggcctacgctgcattgccnatg

SEQ ID NO: 2241 - DNA, 1114 bp, Nicotiana benthamiana
gcacgagggttcacagcacacaatctttcaacttatttcccaaatttctcatagtccaaacaatttcatggatccaacccaatccaaaactacctccggagccagtcattcgtcgtcccataagcccaacagccatccgaaaccatccaaatctgagctgatgtccagtgctaagctagttgccgacgcggccaaagcaaaactccatcacgagccaaacagtaaggtcgacaagtctgagctcgccggagccgccgctgacctccttaacgccgcctcacagtacggcaaactagaagagaaaggcatcggaaagttcgtcggaaaagcagagacttatctccacaaatacgaaacttctcattccaccaccaccactaccggaacaaccaccaccacctccacgactgaacacacgcagtcctcggcgcatacagggggaaaacacgaacagtctggaagtgggtatggcgagtatattaaaatggctgaaggaattttcaagaaacattccgatggcacccactcatcggaatccggcggaggtaaaaaaggagagtatcttaaaatggctggagatttcttgaagaagcattgacttgtactatgtgaattcctttttatcatttgttttagaatttttttgctacagttgtactattgttatatatcagtggataggtgtgatttgtaatgtgtggcctaggctgcattgccgatggtgttcgccaatgaaaataaatttgttttaacatgttatccaaaaaaaaaaaaaaagggcggccgctcgcgatctagaactagtgagtaggcgcgcctactccattggtgtaacttgctaggtctaactcaatttacatcattattaattgtgtttcctttttatccattattatttgtagttgggggtgtttggttctgatgtgatttgaccagtattctggaatttggtatgtcctacagtcctaggtcttatttgacatgtcgaccagagctttatgaacttttggctaattgggttttatgttcataaatctgtgtttctggtggactttgtttttgtgaagatgtgtcgtctgagttcagttaattaattaattaatatttgtgtcct

SEQ ID NO: 2242 - DNA, 1322 bp, Solanum tuberosum
atggatccccggggctgcagaattccgacgaagctgcttcaggctttgaaagtacttataaaatcccaaacaaacttgatcaatcttcttacaaatagatcaaaaaatggaagaaatagagcacaaatacattgaagtgaatgggctaaagcttcatatagctgaaattggaagtgggtcttccccagttgtggtgttcttacatggattccctgaaatttggtattcttggaggtaccaaatgctagctgtagccaaagcgggttacagagctattgcacccgattttagaggatatgggttgtcggatcaaccaacccaacccgagaaaaccacatttctcgatcttaacaatgacctccttgcacttcttgatgctcttaatatctctaaggtttttctcgtcggtaaagactttggatcttttgtcgtttcgtatttttccattctccataaggagagactctctggatttattgttatgggggtgccatttttgcctccaaaacctcttgagtttaaacaaggcctccctgaaggcttctatatttcgagatttggggtgcctgggagagctgaagctgattttggtcgtcttgacgccaaaacagtagtgaagaatgtatacattcttttctccagaagtgaattaccaatagccaatgaagatcaggaaatcatggacatagtgcaaccttcaactcctctacccccttggttctctgaggaagacctgactgcatatggtgctttgtatgagaactctggattccgaactgctttgcaggttccctataggtcactgcatgaacaagtcaacattacagatccaaccgttcacgttccagcactgttcatcaagggagagaaagattatttcctcaaatttccaggaatcgaagattacattagtagtggagtcctcaaaagtttagtccctaatctgcagatagttaacttgccagaaggaacccattttgttcaagaacaactacccaacgaggttaatcaactcgtgctcgaattcctcaccaagaatagtaagcttcagtaaggcctcattgttgttgttgttgctccatctactaagaatagaaaatccaataagttgttgttgttccgagttccgactactaagaatagtaaccttcagtatgtcctagttgtgttctacatgtaatattttgctgcagtgaccctgcaattcctataaaagcaggcactgaaagatgaaattaccttgttatgaaagcctggttccatctctctttcttgttatgttatattatgaatgttgactgattacctaagggtagataatt

SEQ ID NO: 2243 - DNA, 1296 bp, Solanum phureja
ctgcttcaggctttgaaagtaattataaaatcccaaacaaacttgatcaatcttcttacaaatagatcaaaaaatggaagaaatagagcacaaatacattgaagtgaatgggctaaagcttcatatagctgaaattggaagtgggtcttccccagttgtggtgttcttacatggattccctgaaatttggtattcttggaggtaccagatgctagctgtagccaaagcgggttacagagctattgcacccgattttagaggatatgggttgtcggatcaaccaacccaacccgagaaaaccacatttctcgatcttaacaatgacctccttgcacttcttgatgctcttaatatctctaaggtttttctcgtcggtaaagactttggatcttttgtcgtttcgtatttttccattctccataaggagagagtctctggatttattgttatgggggtgccatttttgcctccaaaacctcttgagtttaaacaaggcctccctgaaggcttctatgtttcaagatttggggtgcctgggagagctgaagctgattttggtcgtcttgacgccaaaacagtagtgaggaatgtatacattcttttctccagaagtgaaataccaatagccaatgaagatcaggaaatcatggacattgtgcaaccttcaactcctctacctccttggttctctgaggaagacctgactgcatatggtgctttgtatgagaactctggattccgaactgctttgcaggttccctataggtcactgcatgaacaagtcaacattacagatccaaccgttcacgttccagcactgtttattaagggagagaaagattatttcctcaaatttccaggaatcgaagattacattagtagtggagtcctcaaaagtttagtccctaatctgcagatagttaacttgccagaaggaacccattttgttcaagaacaactacctgacgaggttaatcacctcgtgcttgaattccttacgaagaatagtaagcttcagtaagtcctcattgttattgctccgtctactaggaacagaagctccaataaggcattgttattgttgttgtcgtttgttgttgctccatctactaagaatagaagtttcaaataagttgtttttccgagttcagttcagtaagtcctagttgtgttctgcatgtaatattttgctgcagtgaccctgcaattcctataaaaagcaggcactgaaagatgaaattaccatgttatgaaagctttgttccatctctctttcttgctatgttatattatgaa

SEQ ID NO: 2244 - DNA, 1309 bp, Capsicum annuum
gcacgaggatatgatgcataattaataaagtacttaaagaaaaccaccgtaaagtagtaattataaaatccccagaaccctacagcaaaattgtcctaacactcatcaaaaaatggaaggaatagagcacaaatacgttgaagtgaatgggctaaagcttcatgtagctgaaactggaaatgggaattccccagttgtagtgttcttacatggattccctgaaatatggtattcttggaggcaccagatgatagctgtagccagagctggttacagagctattgcaccagatttcagaggatatgggttatcgggtcagccaccccaacccgagaaaaccacctttcttgatcttaccaatgacatccttgcacttcttgatgctcttaatatctctaaggttttcctcatcggtaaagactttggctcttttatcgtttcacaatttgtcaatctgtatgaggagaaagtctctggatttattgtaatgggggtgccatttttgcctccgaaacctctccagtttaaacaaggcatccctgaaggcttctatatttcgagatttgcggaaccagggagagctgaagctgattttggtcgccttgacgccaaaacagtagtgagaaatatatacattcttttctccagaagtgaattacccattgccaatgaaaatcaggaaatcatggacattgtgcaaccttcaactcctctgcccccttggttctctgaggaagatctgactgcatatggtgctttgtatgagaactccggattccgaactgctatgcaggttccctataggtcactgcatgaagaactcaacattacagatccaaccgttcacgttccagcactgtttattaaaggagagaaagattatttcctcaaatttccaggaatcgaagattacattagtggtggactcctcaaaagtttagtccctaatctgcagattgttaacttgccagaaggaacccattttgttcaagaacaactacctgacgaagttaatccacttgtgctcgaattccttactaagaacagcaagcctcagtaaggtctcgctgttgttgttgctccgtctactaagaaaagaagttccaataaaacattgttattgttactgttgttattcttccgagttcctactacgaagaatagtaagcttcagtagacttagttagttgtgttctctacatatgtaatattttgctgcagtgagcctgcaattaccatgttataaaagccatattctctctttcttgttctgttatattatgaatgttgagttgatcatacctttcat

SEQ ID NO: 2245 - DNA, 1179 bp, Petunia hybrida
ttaagatggatcaatagagcacaaatacgttgaagtgaataatgggctaaagcttcatgtagctgaaactggaagtgagtcttcaccagctgtggtatttttgcatggatttcctgaaatatggtacagttggaggtaccaaatgatagctgtgactaaagctggttacagagctattgcacccgatttcagaggatatggcttatcggatcaacccaccgaacctgagaaaactacctttcttgatcttaccaatgatatccttgcactttttgatgctcttagcatctctaaggctattctcgttgggaaagacttcggatctattatcatttcccgctttgtccttctccatggagagagagtctccggatttattgttatgggagtaccatatttgcccccacaacctctcaagtttcaagatggcctccctgaaggtttctacatttcaagatggagagagccaaggagagctgaagctgattttggtcgccttgatgccaaaacagtagtgaaaaatgtgtacattcttttctcccgaagtgagataccaatagctaatgaaaatcaagaaatcatggacattgtgcaacctctaacccctttacccccttggttcactgaggaagacttggcagcatatggagctttgtatgagaaatctggtttccaaactgcattgcaagttccttacagatcactgcttgaagaagtcaacattacagatccaacagttcatggaccagcactatttattgtgggtgagaaggattatttcctcaaatttccaggaatcgaagactacattagtggagaactcaaaaatttagtacctaatttggagatagcctctctaccagagggaaaccattttgttcaagaacaactacctgacgaggttaatacactcatgcttgacttccttaccaagaacagtaagcttcagtaaggcttgtttcgtataatgaatccgtcttacttgggactgtgacattatcctcattgttgttcttgttcctcattgttgttatttttccgtgtcatttaatttaaaagcaatgcattcgccatctggaatgctctatcaagtcctagttgtgttctacttgtaatattttgttgtagtgatcctgcagtttttactatgcatcttgaacatgagggccgtctactctt

SEQ ID NO: 2246 - DNA, 1580 bp, Nicotiana benthamiana
  misc_feature (1357)..(1357): n is a, c, g, or t
  misc_feature (1449)..(1449): n is a, c, g, or t
  misc_feature (1451)..(1451): n is a, c, g, or t
  misc_feature (1459)..(1459): n is a, c, g, or t
  misc_feature (1461)..(1461): n is a, c, g, or t
gtatgaagaacatctataggggggagacatacctccctacttaattttaaaattatatatataatatattctttatgtttcaaaaaaaaaaaaaaggttttgttgaaagaaaaaaatgaataaacaactgtttaacatttgctactatttccttttcattagctgtcaatccccattaaaaaataaaaaaagtggctttatcgtggtttatttgaaactcaagggcatatacagttctgccaccttccaatatatacacccaaaaaaagtcaattgcccttgctcatcggagttttactgatactactacactccaatcgcaatacgcaacagtagcggtaccggaaaatgtgctccactaagcaaaaacagaagcaaaatctccaccagcagcgctccaccgagcctgtctctacctccgccgttgacggtggcgatgaagagaactggagggaagaatccataaccggcggatcactgaagcatgtggattcggacaccggaaaaaacggctgggcgtcaccgccgggagacttattcaacctacgaggtccaaactacttcacgaaaaaagcgaaagtaccttcaggcgcgtggctcctacagccggccggcgtcgattggctccgatccaattccaagctcgaccacgtcctcgctcgtcacgacaatcgcgtgatgcacgcgctgcggaaatctcactcccaaggcaagtctctcaaaaccttcatactcgccgtgaatctccaagtcccagggcgtgaccaccacagtgccgtcttctacttttccacaaacgacgatgagccgctcgaaccgggttcgctcctctaccggttcgtcaacggcgatgacgcgtaccgtaacagccggttcaaaatcgttaacaggatcgtgaaaggaccgtggatcgtgaaagctgcagttgggaattactcggcttgtatactcggaaaagcgttgaattgctactatcacagaggccctaattactttgaaatcgacgtggatattggaagctcggcgattgcgaacgcgattttgcacttggcattagggtacgtaacgtcggtgacgatcgacatggggttttgtgtggagtcgcagacggaggaggagttgccggagaagttgtttggggctgtaagggtttgtcaaatggagatgagctcagcgacctttgttgatacgacatcgtccaggaaggtattaaccgctactgctaatttacataatcctatcggtagtagcagagtccaagctgaggagaacggtgaaaatgaagaggattaaaaaaatatttatttttattatattttgaaggaaattgttggtggaatccatgtagatagatgtntaattttaagcttaagcttttttgtctaataaaagttcctttcttccactcatttactttgttttctttgtatatcatttcagtttctaagntntgctgtgntntgcttattcctgttgctaaaattttctcaatgggcacaactattagacttgcccaccaaaaatgtacaatgtatgaatacccatccaaaatgtattcaataaaaacattatattggagt

SEQ ID NO: 2247 - DNA, 866 bp, Avena sativa
ccaccaccgctccctggtacgtacctccctcacgccacccgcacccatccccacgtacgtacctactaccaccacccgccgccggccatggcgccgaagctgctgccggccgccgcagccctcctcctcctggccctcgcggcctcggcggcgtcggcgttcaccacggccggcgacctgggcggcgcggcggccgtcgtgatgcggcgcggcgggcggacgtgcaggggcaccgtgggcgactgcatggagtacttcggcgtcgacggcgagggcgagggcgacgtggcggccatggccggcggaaagcgccgcctgctgcaggacggctccgggtacatcggctacgacgcgctcaggcgggacagcgtgccctgctcccagcgcggagcatcctactacaactgtcagcccggcgcagaggccaacccctactcccgcggatgcagcgccatcacccagtgcaggggctgataaagtacctaaacccacacccacgcatccctctccctctgtctatctctctcgattagtttttacccacggcacgtatgtatgcctgatcgttcactactcctctgcttgctgtaattacgatttcacaacaagatcatcagtcgcttcctgaccatgcttgaacaggaatcgatcactggattcgtgcatgctctctctctcgagtgctcaatctcctcaccagagacatgttagctgattgtgtaatttatgtcgatttgggtggaaaagtaaggttcagacttgtgtgtaactggtactacatgtttggtgtctctcaactttatttgtttaacttccctgcaccatcaccaagtgggttgactgtttcaaaaaaaaaaaaaaaaaaa

SEQ ID NO: 2248 - DNA, 1435 bp, Hordeum vulgare
ctggtgcagtgtgttcttcggcagcatctccgcctctccggactgctgtccttgttaccaacaagccggcactctccatccacaagctccaaagaaagaaacgggtaatccgaaaggccttccaagaagcgagggggcagagggcggcgcaaaccatggccacggtggagcagcagcagcagcagatcgagcacagccacctcgccatcagaggcctcaacctccacgtagcccaagcaggcacaggcgagctcgggacggtgctgttcctgcacggcttcccggagatatggtactcgtggcgccaccagatgctggccgtggccgccgccgggtaccgcgccgtcgcgccggactggcgggggtatggcctctccgaccagccaccggagccggaggcggcggcgtacagcgacctgatagaggatctcctcgccctcctcgatgcgctctccgtccccaaggcttaccttgtggcaaaggatttcggaaccatgctagcttatgattttgctcttcgtcaccccaaccgcacatgcggtgttatgtgtttgggtatcccttttcttcacggtggctcctccttcactgccatgccagaaggcttctacatactgcgctggcgggaaccaggaagagcagaggcagactttggcaggtatgacgtcaagcgagtcgtgcgcaccatctacattctcttctctagaagcgaaatcccgacagcgaaggaagatcaagaaatcatggatctcgcggacctgtcgactccccttccagagtggttcaccgaggaggatcttgatgtctatgcgtccctctacgagaaatctggtttcgtgtatccactgcacatgccatacaggtctctccataagaggcaaccaattgaagacccaaaattcgaagtcccggtgttcgtcgtcatgggggagaaagactacgtgtgcaagttccccggggtcgaggccgtcttgaagaatggcaccatggagaagtttgcgccggatctgaagatcacttacatccctgaaggaggccatttcgtgcaggagcagttcccggacaaggtcaatgatctcctccttggcttcctcaaggaccatcctgtggcttgacacacggggcctactatgctcggcctgtactcggtctcataagtaccgtactccgtgcacattccgcggtgttatatatatatgttcggtccgtgttgtcctctaataatcctttagaacgccagtgtttagtcctcctgtaattgtgtaatttcacccaaaatttatctgaatttcatttcgaattcccaggaatcgaatcgaattgaagatcgtttcagcttggtaggtcctaacgtaggcaggcacatgccgcaaggggtgaatcatgccgtaggttataactcgttacaccaatcatgttatcttttaggaactcc

SEQ ID NO: 2249 - DNA, 1435 bp, Hordeum vulgare
ctggtgcagtgtgttcttcggcagcatctccgcctctccggactgctgtccttgttaccaacaagccggcactctccatccacaagctccaaaggaagaaacgggtaatccgaaaggccttccaagaagcgagggggcagagggcggcgcaaaccatggccacggtggagcagcagcagcagcagatcgagcacagccacctcgccatcagaggcctcaacctccacgtagcccaagcaggcacaggcgagctcgggacggtgctgttcctgcacggcttcccggagatatggtactcgtggcgccaccagatgctggccgtggccgccgccgggtaccgcgccgtcgcgccggactggcgcgggtatggcctctccgaccagccaccggagccggaggcggcggcgtacagcgacctgatagaggatctcctcgccctcctcgatgcgctctccgtccccaaggcttaccttgtggcaaaggatttcggaaccatgctagcttatgattttgctcttcgtcaccccaaccgcacatgcggtgttatgtgtttgggtatcccttttcttcacggtggctcctccttcactgccatgccagaaggcttctacatactgcgctggcgggaaccaggaagagcagaggcagactttggcaggtatgacgtcaagcgagtcgtgcgcaccatctacattctcttctctagaagcgaaatcccgacagcgaaggaagatcaagaaatcatggatctcgcggacctgtcgactccccttccagagtggttcaccgaggaggatcttgatgtctatgcgtccctctacgagaaatctggtttcgtgtatccactgcacatgccatacaggtctctccataagaggcaaccaattgaagacccaaaattcgaagtcccggtgttcgtcgtcatgggggagaaagactacgtgtgcaagttccccggggtcgaggccgtcttgaagaatggcaccatggagaagtttgcgccggatctgaagatcacttacatccctgaaggaggccatttcgtgcaggagcagttcccggacaaggtcaatgatctcctccttggcttcctcaaggaccatcctgtggcttgacacacggggcctactatgctcggcctgtactcggtctcataagtaccgtactccgtgcacattccgcggtgttatatatatatgttcggtccgtgttgtcctctaataatcctttagaacgccagtgtttagtcctcctgtaattgtgtaatttcacccaaaatttatctgaatttcatttcgaattcccaggaatcgaatcgaattgaagatcgtttcagcttggtaggtcctaacgtaggcaggcacatgccgcaaggggtgaatcatgccgtaggttataactcgttacaccaatcatgttatcttttaggaactcc

SEQ ID NO: 2250 - DNA, 1156 bp, Brachypodium distachyon
ggaaccatggcgacggcggagcagcggattgagcacagccgcatcgccgtcagaggccttaatctccacgtcgcccaatcaggcacaggtgagctcgggacggtgattttccttcacgggttccccgagatatggtactcgtggcgccaccagatgcaggccgtggccgccgccgggtaccgcgccgtcgcgctggactggcgcgggtacggtctctccgaccagccgccggagaaggagacggcgtcgcgcgacgacctggtggaggatctcctagccctcctggatgcgctcgcagtccacaaggcattcctcattgcgaaggattttggagcgatgcctgcgtatgactttgctcttcgtcaccccagccgcacaagtggtgtcatgtgtttgggcatcccttaccttcacggtggatccccattcaccaccttgccagaaggcttctacattctccgttggcgggaaccaggaagagcagaggctgactttggcaggtacgatgtcaagagagtcgtgcagacaatctacatcctgttttcgagaagcgagatcccgatagcaaacgaagatcaagagatcatggatcttgcagacttatcgactccccttccagagtggttcaccgagaaggatcttgatgtctacgcatccctctacgagaaatccggttttggatatccactgcagatgccatacaggtctctccataagacacaaccggtcgaagatccaaagttccaagtcccagtgttcgtcgtcatgggggagaaagactatgtcttcaagttccccggggtcgaggccgtcctgaaagatggtgtcatggagaagttcgcacctgacctgaagatcacatacgtgcctgaaggaagccattttgttcaggagcagttcccggacatggtcaatgagctcctccttggcttcctcagggaccatcctgtggcctgacagatgttctctgctttgcctgtattcacattctgcaatgttatgatctgcactatcaatgaagggtgtgtgatggctggtattgctttgcattatcaatggagtatgtttatgttgtatctggtttgtaccgctagttttatcagcaatctaaagtctaatatctttaataaggggaataaaagcctaatatttctcc

SEQ ID NO: 2251 - DNA, 1263 bp, Sorghum bicolor
gtaccttcagccttctctccaaaagtccaccctcacaaatctgcaaagaagtggccatgaacatggagcagcaaatcaagcacagccatctcccgatccgaggcctcagcctccacgtggcccaagcaggcaaaggcgagctgggcacggtggtgttcctgcacgggttcccggagatatggtactcgtggcgccaccagatgctggccgtggccgccgccgggtaccgcgccgtcgcgccggactggcgagggtacgggctctcggaccagccgccggaggcggaggccgcgtcgtacgacgacctggtggaggatctcctcgcaatcctcgatgctctctccattcccaaggctttccttgtggcgaaggatttcggagccatgccagcctatgactttgctcttcgtcaccctagccgcacatgtggtgtcatgtgtttggggatccccttccttcacggtggctcatccttcaccagcttgccagaaggcttctacattttgcgctggcgggaaccaggaagagcagaggctgattttggccggtatgatgtgaagagagttgttcggaccatctacgtgctcttctctaggagcgaaataccaatagcaaaagaaggccaagagattatggaccttgcagacttgtcaacacctcttccagagtggttgactgaggatgatctagctgtgtatgcttcactctatgagaaatcgggtttccggtatccaatggaaatgccatataggtcgctccataaaaggatgccaattgaagatccaagattccaagtcccagtgtttgttgtcatgggggagaaagactatgtgttcaagttccctggtgttgagtccgttttgaaagatggcatcatggagaaattcacaccggacctaaagatcacctacatccctgaaggaagccatttcgttcaggagcagttcccggacaaggtgaatgatctcctggtcagtttcttgaaggaccaccctgtggctgcatagatgttctagcagtccatgttcactgtcacaagcaacacctacgataggaaaaactgctatgtgtagtgtcgccagtaaaggaacaatctgatactgaatttgcatcagctttcagtgttctgactgtgtttgcatctagcgtgtgaaacaagttttaaaaatcaagcagtattgattgcataaagcatcagtgttcttgacgaaaatgattataaagaccgaaaattcaagtattgccttaggccttatttagttg

SEQ ID NO: 2252 - DNA, 1205 bp, Saccharum officinarum
atctgcaaagaagtggccatgaacatggagcagcaagtcgagcacagccatctcccaatccgaggcctcagcctccacgtggctcaagcaggcaaaggcgagctgggcactgtggtgttcctgcacgggttcccggagatatggtactcgtggcgccaccagatgctggccgtggccgccgccgggtaccgcgccgtcgcgccggactggcgagggtacgggctctcggaccagccgccggagccggaggccgcgtcgtacgacgacctggtggaggatctcctcgcaatcctcgatgccctctccattcccaaggctttccttgtggcgaaggatttcggagccatgccagcctatctgtttgctcttcgtcaccctagccgcacatgtggtgttatgtgtttggggatccccttccttaacggtggctcaccttcaaccggcttgccagaaggcttctacattttgcgttggcgggaaccaggaagagcggaggctgattttggccggtatgatgtcaagagagttgttcggaccatctacgtgctcttctctaggagcgaaatcccaatagcgaaagaagatcaagagattatggaccttgcggaattgtcaacacctcttccagagtggttcactgaggatgatctggctgtgtatgtttcactctatgagaaatcaggtttccggtatccaatggagatgccatataggtctctccataaaacgaagccaattgaagatccaaaatttcaagtcccagtgtttgttgtcatgggggagaaagactatgtgttcaagttccctggggttgagtccgtgttgaaagatggcatcatggagaaatccgcaccggacctgaagatcacctacatccctgaaggaagccatttcgttcaggagcagttcccggacaaggtgaatgatctcctggtcagcttcttgaaggaccaccctgtgtctgcatagatgtgttctagcagtccatgttcactgtcacaagcaacagctacgatgggcaaaactgctttgtgtagtgtcgccagtaaaggaacaatctgatgagtgaattcagctttcagtgttttgactctgtttgcatctcgcgtgtgaaacaagttttaaaaatcaagcagtattgattgcatagagcatcagtgttcttgtagaaaatgattggagattgaaaactcaagtattgcctt

SEQ ID NO: 2253 - DNA, 894 bp, Triticum aestivum
ttcctcgagagaaaccaggaagcagaggagcggctgaggcgagcccttcacctcgatccagccaagatggcattcgccgcctccacggcctgctgcaagccgtccgccctgctggcccctcgcgcctcgtcgtcgtcgccgccgtcccaggcgcgcctctgcaggccctccacctcggccgcgttccacggcctcagggcgccggcgtcggcgttcgcactcgcgcctgcgccgcgccgccgcgcggcgtccacgggcatcgtctgcggcaaggtgagcaagggcagcgtgccgcccaacttcacgctcaaggaccaggacggcaagacggtgtcgctctccaagttcaagggcaagcccgtcgtcctctacttctaccccgccgatgagacgccgggctgcaccaaacaggcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctccccgggcggcagacctacgtgctggacaagaagggcgtggtgcagtacatctacaacaaccagttccagcccgagaagcacatcggcgagaccctcaagatcatccagaacctctgaatctgaacaactttctctcaaagattcttttcccgtcgatcgatcggtctctgccgatgtaatcgtatgatatgatatactcctggacatgatccatgcgtagagctgttttgatgtgtaatccagtgtacatgtattgaatatgttcagttcgccagcagtgcgcaccttctt

SEQ ID NO: 2254 - DNA, 1040 bp, Triticum aestivum
  misc_feature (1022)..(1024): n is a, c, g, or t
  misc_feature (1028)..(1028): n is a, c, g, or t
ataccccggccgaagaattcccccggggaatttcgtagagccccagggggttccggggtttggggcaccgcggggcccctgtccctgggcctgaaagggggctgaaaacccgcgaggctcccgcttcctcgagagaaaccaggaagcagaggagcggctgaggcgagcccttcacctcgatccagccaagatggcattcgccgcctccacggcctgctgcaagccgtccgccctgctggcccctcgcgcctcgtcgtcgtcgccgccgtcccaggcgcgcctctgcaggccctccacctcggccgcgttccacggcctcagggcgccggcgtcggcgttcgcactcgcgcctgcgccgcgccgccgcgcggcgtccacgggcatcgtctgcggcaaggtgagcaagggcagcgtgccgcccaacttcacgctcaaggaccaggacggcaagacggtgtcgctctccaagttcaagggcaagcccgtcgtcctctacttctaccccgccgatgagacgccgggctgcaccaaacaggcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctccccgggcggcagacctacgtgctggacaagaagggcgtggtgcagtacatctacaacaaccagttccagcccgagaagcacatcggcgagaccctcaagatcatccagaacctctgaatctgaacaactttctctcaaagattcttttcccgtcgatcgatcggtctctgccgatgtaatcgtatgatatgatatactcctggacatgatccatgcgtagagctgttttgatgtgtaatccagtgtacatgtattgaatatgttcagttcgccagcagtgcgcaccttcttacannnaaanacaaaaaaaaaa

SEQ ID NO: 2255 - DNA, 922 bp, Hordeum vulgare
cagagagaaaccaggaaccagagcagcggctcaggcgagagtccttcaccccgatccaggcaagatggcattcgccgcctccacggcttgctgcaagccgtccgcgctgctggcccctcgcgcgtcggcgtcgtcgtcgtcccaggcgcgcctctgcaggccctccacctcggccgcgttccagggcctcagggcgccggcgccggccttcgccctcgcgcctgcgccgcgccgccgcgcggcgtccaccggcatcgtctgcggcaaggtgagcaagggcagcgtgccgcccaacttcacgctcaaggaccaggacggcaagacggtgtcgctctccaagttcaagggcaagcccgtcgtcctctacttctaccccgccgatgagacgcccggctgcaccaaacaggcgtgcgcgttcagggactcgtacgagaagtacaagaaggcgggggcggaggtgatcgggatcagcggggacgacgcggcgtcgcacaaggcgttcgcaaagaagtaccggctgccattcacgctgctgagcgacgaggggaacaaggtgcgcaaggagtggggggtgccgtcggacctcttcgggacgctgccggggaggcagacctacgtgctcgacaagaagggcgtggtgcagtacatctacaacaaccagttccagcccgagaagcacatcggggagaccctcaagatcatacagaacctctgaatcctctctctctctcagcttccctacgagtaacagattgttatcttttttttccttggataaatctcgatctgtgccgctgtaatcgtgtaacataacatgctcctgaacatgcatgcatgatccccccctacgtgtagagctgttttgatgtgtaatgcaatggattactacgtacgtgttaccgtcaaaaaaaaaaaaaaaaaa

SEQ ID NO: 2256 - DNA, 890 bp, Hordeum vulgare
atgcgagagtccttcaccccgatccaggcaagatggcattcgccgcctccacggcttgctgcaagccgtccgcgctgctggcccctcgcgcgtcggcgtcgtcgtcgtcccaggcgcgcctctgcaggccctccacctcggccgcgttccagggcctcagggcgccggcgccggccttcgccctcgcgcctgcgccgcgccgccgcgcggcgtccaccggcatcgtctgcggcaaggtgagcaagggcagcgtgccgcccaacttcacgctcaaggaccaggacggcaagacggtgtcgctctccaagttcaagggcaagcccgtcgtcctctacttctaccccgccgatgagacgcccggctgcaccaaacaggcgtgcgcgttcagggactcgtacgagaagtacaagaaggcgggggcggaggtgatcgggatcagcggggacgacgcggcgtcgcacaaggcgttcgcaaagaagtaccggctgccattcacgctgctgagcgacgaggggaacaaggtgcgcaaggagtggggggtgccgtcggacctcttcgggacgctgccggggaggcagacctacgtgctcgacaagaagggcgtggtgcagtacatctacaacaaccagttccagcccgagaagcacatcggggagaccctcaagatcatacagaacctctgaatcctctctctctctcagcttccctacgagtaacagattgttatcttttttttccttggataaatctcgatctgtgccgctgtaatcgtgtaacataacatgctcctgaacatgcatgcatgatccccccctacgtgtagagctgttttgatgtgtaatgcaatggattactacgtacgtgttaccgtcaaaaaaaaaaaaaaaaaa

SEQ ID NO: 2257 - DNA, 998 bp, Triticum aestivum
cagaggagcggctgaggcgagtccttcacctcggtccagccaagatggcattcgccgcctccacggcctgctgcaagccgtccgtgctgctggcccctcgcgcctcctcctcctcctcctcgtcccaggcgcgcctctgcaggccgtccacctcggccgcgttccacggcctcagggcgccggcgtcggccttcgccctcgcgcctgcgccgcgccgccgcgcggcctccgcgggcatcgtctgcggcaaggtgagcaagggcagcgtgccgcccaacttcacactcaaggaccaggacggcaagacggtgtcgctctccaagttcaagggcaagcccgtcgtcctctacttctaccccgccgatgagacgccaggctgcaccaaacaagcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctcccggggaggcagacctacgtgctggacaagaagggcgtggtgcagtacatctacaacaaccagttccagcccgagaagcacatcggcgagaccctcaagatcatccagaacctctagctgatcgatcgattcgaggatcgtactacgatttttcttcccttccccatgcctaatatctccgccccgcctgtatctacattacatacatgctgaacatgatccatgcgtagagctgttttgatgtgtaatccagtacgtacgtgtactgcgtatgttcagttcgccagcagtgtgcaccttcgtcaaggacgccgttttgtaaaatctatctacttttaaacctcgtcccccccccctgagcgacacggagcccttgacctcggcccgggacacgcctatcccgcggccatggggccc

SEQ ID NO: 2258 - DNA, 983 bp, Triticum aestivum
ccacgcgtccgggaggttccgcttcctccagagaaacagaggagcggctgaggcgagtccttcacctcggtccagccaagatggcattcgccgcctccacggcctgctgcaagccgtccgtgctgctggcccctcgcgcctcctcctcctcctcctcgtcccaggcgcgcctctgcaggccgtccacctcggccgcgttccacggcctcagggcgccggcgtcggccttcgccctcgcgcctgcgccgcgccgccgcgcggcctccgcgggcatcgtctgcggcaaggtgagcaagggcagcgtgccgcccaacttcacactcaaggaccaggacggcaagacggtgtcgctctccaagttcaagggcaagcccgtcgtcctctacttctaccccgccgatgagacgccaggctgcaccaaacaagcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctcccggggaggcagacctacgtgctggacaagaagggcgtggtgcagtacatctacaacaaccagttccagcccgagaagcacatcggcgagaccctcaagatcatccagaacctctagctgatcgatcgattcgaggatcgtactacgatttttcttcccttccccatgcctaatatctccgccccgcctgtatctacattacatacatgctgaacatgatccatgcgtagagctgttttgatgtgtaatccagtacgtacgtgtactgcgtatgttcagttcgccagcagtgtgcaccttcgtcaaggacgccgttttgtaaaatctatctacttttaaacctcgtcttcacactcaaaaaaaaaa

SEQ ID NO: 2259 - DNA, 861 bp, Triticum aestivum
ttcctcgacagaaaccaggaagcagaggagcggctgaggcgagtccttcaccccgatccagccaagatggcattcgccgcctccacggcctgctgcaagccgtccgtgctgctggcccctcgcgcctcctccttgtcgtcgtcccaggcgcgcctctgcaggccgtccacctcggccgcgttccacggcctcagggcgccggcgtcggcattcgccctcacgccagcgccgcgccgccgcgcggcctccacgggcatcgtctgcggcaaggtgagcaagggcagcgtgccgcccaacttcaccctcaaggaccaggacggcaagacggtatcgctctccaagttcaagggcaagcccgtcgtcctctacttctaccccgccgatgagacgccaggctgcaccaaacaggcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctccccgggaggcagacctacgtgctggacaagaagggcgtggtgcagtacatctacaacaaccagttccagcccgagaagcacatcggcgagaccctcaagatcatccagaacctctgaatctgaacaactttttctcgaagattcttttcccgtatatcgatcgatcgatctctgccgctgtaatcgtatgatatactactactcgtgaacatgatccctgtgtagagctgttttgatgtgtaatgcaatgtactagtgcgt

SEQ ID NO: 2260 - DNA, 942 bp, Triticum aestivum
ggaggttccgcttcctcgacagaaaccaggaagcagaggagcggctgaggcgagtccttcaccccgatccagccaagatggcattcgccgcctccacggcctgctgcaagccgtccgtgctgctggcccctcgcgcctcctccttgtcgtcgtcccaggcgcgcctctgcaggccgtccacctcggccgcgttccacggcctcagggcgccggcgtcggcattcgccctcacgccagcgccgcgccgccgcgcggcctccacgggcatcgtctgcggcaaggtgagcaagggcagcgtgccgcccaacttcaccctcaaggaccaggacggcaagacggtatcgctctccaagttcaagggcaagcccgtcgtcctctacttctaccccgccgatgagacgccaggctgcaccaaacaggcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctccccgggaggcagacctacgtgctggacaagaagggcgtggtgcagtacatctacaacaaccagttccagcccgagaagcacatcggcgagaccctcaagatcatccagaacctctgaatctgaacaactttttctcgaagattcttttcccgtatatcgatcgatcgatctctgccgctgtaatcgtatgatatactactactcgtgaacatgatccctgtgtagagctgttttgatgtgtaatgcaatgtactagtgcgtacgtgtaccgcgtatgttcaatcgtctggacagtgcagaaacgtagtggtgccgttgtccaaaaaaaaaa

SEQ ID NO: 2261 - DNA, 917 bp, Pseudoroegneria spicata
ccgttgctgtcgccgcttcctccagagaaaccaggaagcagagcagcggctgaggcgagtccttcacctcgatccaagcaagatggcattcgccgcctccacggcctgctgcaagccctccgtgctgctgacccctcgcgcgtcgtcgtcgtcgtcgtcccaggcgcgcctctgcaggccctccacctcggccgcgttccacggcctcagggcgccggcgtcggccttcgccctcgcgccagcgccgcgccgccgcgcggcgtccacgggcatcgtctgcggcaaggtgagcaagggcagcgtgccgcccaacttcaccctcaaggaccaggacggcaagacggtgtcgctctccaagttcaagggcaagcccgtcgtcctctacttctaccccgccgatgagacgccaggctgcaccaaacaggcgtgcgcgttccgggactcgtacgagaagtacaagaaggcgggggcggaggtgatcgggatcagcggggacgacgcggcgtcgcacaaggcgttcgccaagaagtaccggctgcccttcacgctgctgagcgacgaggggaacaaggtgcgcaaggagtggggggtgccgtcggacctcttcgggacgctgccggggcgccagacctacgtgctcgacaagaagggcgtggtgcagtacatctacaacaaccagttccagcccgagaagcacatcggcgagaccctcaagatcatccagaacctctgaacctctcagcttctctgaaaaatcatacatactttcctggattcttttcaaattgatcgatctctgccgctgtaatcgtatgatatgctcctgaacatgatccctgtgtagagctgttttgacgtgtaatgcaatgtactagtacgtgtaccgtgtatgtatgttcaatgctctggccagtgca

SEQ ID NO: 2262 - DNA, 1306 bp, Triticum aestivum
ctcccactgaagcagcggcggaagaagaagaagctagaggacatgggggcgcagagagctctcctcgcgagcttcctgctcgccgcgttggccacccaggccttcgtcgccgtctcggccaggaccagcccgacggacaaggcaagccaagatgacgtgaagaagccggactgcgtgccgtcgctcgacccgcacaacttccccggccacgggggcaccaccgtgccgcttccctcgcacggaggctcctccggcacgccgccttaccacggaggctccggcactacgccgtcgcacggcggctccggctcgactccgtcgcacagcggctccgggtcgacggtgcctgacccgtcgcatggcggatacgggacgccgccttcgcacggcggctctggttcgctgcctgacccgtcgcacagcggaggaggttacggatccactccggacgcgccatcccacggcggaggcgcgtacgggagctccccgacgccttccactggcggtgcctacggcagctcacccacgccgtcccacgacgggggcgcctacgggagctccccgacgccggcccacgacggaggctcctacagcggaactccggctgcaccgtcgcacagcagccacgggtctatcacaccgacgccgctcatcccagtcgaccccaacagcctcgggacatgcgactactggaggacgcaccccatgcagatctggtcggcgctggggagctggccgagttcggtgagccacttcttcggcgccgccggtggcgcggtcgccggcgggccgagtatgagcatccaggacgcgctggcgaacacgaggaccgacggcgccggcgcgctgctgcgcgagggcaccgcagccctgctcaactccatgacccgcccggggttcgcctacaccacccagcaggtgagggacgcattcgcggcggccgtggccggcggctctgacagtgccgcggcggcgcaggcggcggcgttcaagaaggccaacgaggggaagaaggtgtagatcgaccggatcgccatcgagtgggctttagctatagctggttacctatatctgtggcatgcgttcatgcatgcatgcgtttaggccggacggacgtgtgcttgcgttttggttgttccgtttgagttgatggtttggttgtgtaagttggtgtcttcgtgggctagcttggatctatcgtactacgtgttgtaatgaatctcgtttaagttttttgcagttccgtaccctgtcgcattgaatggaatatattgaagcgaactattcctagctcaaaaaaaaaaaa

SEQ ID NO: 2263 - DNA, 1244 bp, Leymus cinereus x Leymus triticoides
  misc_feature (20)..(20): n is a, c, g, or t
  misc_feature (206)..(206): n is a, c, g, or t
  misc_feature (242)..(242): n is a, c, g, or t
  misc_feature (248)..(248): n is a, c, g, or t
  misc_feature (252)..(252): n is a, c, g, or t
  misc_feature (254)..(254): n is a, c, g, or t
  misc_feature (850)..(850): n is a, c, g, or t
  misc_feature (879)..(879): n is a, c, g, or t
  misc_feature (1213)..(1215): n is a, c, g, or t
agctagaggacatgggggcncagagagctctcctcgcgagcttgctgctcgccgcgttggccacccaggccttcgtcgccgtctcggccaggagcggcccgacggacaaggcaagccaagatgacgtgaagaagccggactgcgtgccgtcgctcgacccgcacaatttccccggccacgggggcaccaccgtgccgcttccctcncatggaggctcctccggcacgccgccttaccacggnggctcnggcncnacgccgtcgcacggcggctccggctcgacgccgtcgcacggcggctctgggtcgttgcctgacccgtcgcacggcgggtacgggacgccgccttcgcacggcggctctggctcgttgcctgacccgtcgcacagcggaggaggttacgggtccactccggacgcgccgtcgcacggcggaggcgcgtatgggagctccccgacgccttccactggcggtgcctacggcagctcacccacgccgtcccacggcggaggcgcctacgggagctccccgacgcctgcccacgacggaggctcctacagcggaactccggctgcaccgtcgaacagcagccacgggtctgtgacaccgacgccgctcgtcccagtcgaccccaacagcctcgggacatgcgactactggaggacgcacccgatgcagatatggtcggcgctggggagctggccgagctcggtgagccacttcttcggcgccgccggtggcgcggtcgccggcgggccgagcgtgagcatccaggacgcgctggcgaacacgaggaccgacggcgccggcgcgctgctgcgcgagggcaccgccgcgctgctcaactccangacccgcccggggttcgcctacaccaccnagcaggtgagggacgcgttcgcggctgccgagtccggcggctccgacagcgccgcggcggcgcaggcggcggcgttcaagaaggccaacgaggggaggaaggcgtagatcgaccggatcgccatcggcagggctttagctagctacctatatctgtggcatgcgtgcatgcatgcatgcgtttaggccggacggacgtgtgcgttgtgttttggttgtttcatttgagttgatggtttggttgtgtacgttggtgtcttcgtgggctagcttcgatctatcgtactatgtgttgtaatgaatctcgtttaagttttttgcagttccgtacccannngcattgaatggaatatatgaagcgaacta

SEQ ID NO: 2264 - DNA, 1279 bp, Triticum aestivum
cctctccactccactaccaccgaagcagctcccactgaagcagcggcggaagaagaagaagctagaggacatgggggcgcagagagctctcctcgcgagcttcctgctcgccgcgttggccacccaggccttcgtcgccgtctcggccaggaccagcccgacggacaaggcaagccaagatgacgtgaagaagccggactgcgtgccgtcgctcgacccgcacaacttccccggccacgggggcaccaccgtgccgcttccctcgcacggaggctcctccggcacgccgccttaccacggaggctccggcactacgccgtcgcacggcggctccggctcgactccgtcgcacagcggctccgggtcgacggtgcctgacccgtcgcatggcggatacgggacgccgccttcgcacggcggctctggttcgctgcctgacccgtcgcacagcggaggaggttacggatccactccggacgcgccatcccacggcggaggcgcgtacgggagctccccgacgccttccactggcggtgcctacggcagctcacccacgccgtcccacgacgggggcgcctacgggagctccccgacgccggcccacgacggaggctcctacagcggaactccggctgcaccgtcgcacagcagccacgggtctatcacaccgacgccgctcatcccagtcgaccccaacagcctcgggacatgcgactactggaggacgcaccccatgcagatctggtcggcgctggggagctggccgagttcggtgagccacttcttcggcgccgccggtggcgcggtcgccggcgggccgagtatgagcatccaggacgcgctggcgaacacgaggaccgacggcgccggcgcgctgctgcgcgagggcaccgcagccctgctcaactccatgacccgcccggggttcgcctacaccacccagcaggtgagggacgcattcgcggcggccgtggccggcggctctgacagtgccgcggcggcgcaggcggcggcgttcaagaaggccaacgaggggaagaaggtgtagatcgaccggatcgccatcgagtgggctttagctatagctggttacctatatctgtggcatgcgttcatgcatgcatgcgtttaggccggacggacgtgtgcttgcgttttggttgttccgtttgagttgatggtttggttgtgtaagttggtgtcttcgtgggctagcttggatctatcgtactacgtgttgtaatgaatctccatttaagttttttgcagttccgtaccc

SEQ ID NO: 2265 - DNA, 1361 bp, Hordeum vulgare
ctccactccactcccactgaagcagcggcgcaagaagaagaagaagaagaagctagaggacatggcggcgcagagagctctcttcgcgagcttcctgctcgccgcattggccacccaggccttcgtcgccgtctcggccaggagcgtcccgacggacaaggcaagccaagatgacgtgaagaagccggactgcgtgccgtccctcgacccgcacaacttccccggccacggcggcaccaccgtgccgcttccttcgcacggaggctcatccggcaccccgccttaccacggaggctccggcaccacgccgtcgcacggcggctccggctcgactccctcgcacagcggctccgggtcggtgcctgacccgtcgcacggcggttccggctcgactccctcgcacagtggctccgggtcggtgcctgacccgtcgcacgggggctctggttcgttgcctgacccgtcgcacagcggaggaggttacgggtccactccggatgcgccgtcacacagcggaggcgcctacgggagctccccgacgccttccactggcggtgcctacggcagctcacctacgccgtcccacgacggaggcgcatacggcagctcacccacgccgtcccacgacggaggcgcatacgggagctccccgacgccggcccacgacggaggctcctacagcggaactccggctgcaccgtcgcacagcagccacgggtctgtgacaccgacgccgctcatcccagtcgaccccaacagcctcgggacatgcgactactggaggacgcacccgatgcagatatggtcggcactggggagctggccgagctcggtgagccacttcttcggcgcagccggtggcgcggtcgccggcgggcccagcgtgagcatccaagacgcactggcgaacacgaggaccgacggcgccggcgcgctgctgcgtgagggcaccgccgcgctgctcaactccatgacccgcccggggttcgcctacaccacccagcaggtgagggatgcgttcgcggcggccgcggccggtggctccgacagcgccgccgcggcgcaggcggccgcgttcaagaaggccaatgaggggaggaaggcgtagatcaaccggatcgccgtcgagagggctttaatttagctagctggctgcctatatctgtggcatgcgtgcgtttaggccggacggacgtgtgcgttgcgttttggttgtttcatttgagttcgtggtttggttgtgtacgttggtgtcttcatgggctagcttcgatctatcgtactatgtgtgttgtaatgaatctcgtttaagttttttgcagttccgtaccctgtcaaattggatggaatatataaagcga

SEQ ID NO: 2266 - DNA, 1376 bp, Hordeum vulgare
ccacctctccactccactcccactgaagcagcggcgcaagaagaagaagaagaagaagctagaggacatggcggcgcagagagctctcttcgcgagcttcctgctcgccgcattggccacccaggccttcgtcgccgtctcggccaggagcgtcccgacggacaaggcaagccaagatgacgtgaagaagccggactgcgtgccgtccctcgacccgcacaacttccccggccacggcggcaccaccgtgccgcttccttcgcacggaggctcatccggcaccccgccttaccacggaggctccggcaccacgccgtcgcacggcggctccggctcgactccctcgcacagcggctccgggtcggtgcctgacccgtcgcacggcggttccggctcgactccctcgcacagtggctccgggtcggtgcctgacccgtcgcacgggggctctggttcgttgcctgacccgtcgcacagcggaggaggttacgggtccactccggatgcgccgtcacacagcggaggcgcctacgggagctccccgacgccttccactggcggtgcctacggcagctcacctacgccgtcccacgacggaggcgcatacggcagctcacccacgccgtcccacgacggaggcgcatacgggagctccccgacgccggcccacgacggaggctcctacagcggaactccggctgcaccgtcgcacagcagccacgggtctgtgacaccgacgccgctcatcccagtcgaccccaacagcctcgggacatgcgactactggaggacgcacccgatgcagatatggtcggcactggggagctggccgagctcggtgagccacttcttcggcgcagccggtggcgcggtcgccggcgggcccagcgtgagcatccaagacgcactggcgaacacgaggaccgacggcgccggcgcgctgctgcgtgagggcaccgccgcgctgctcaactccatgacccgcccggggttcgcctacaccacccagcaggtgagggatgcgttcgcggcggccgcggccggtggctccgacagcgccgccgcggcgcaggcggccgcgttcaagaaggccaatgaggggaggaaggcgtagatcaaccggatcgccgtcgagagggctttaatttagctagctggctgcctatatctgtggcatgcgtgcgtttaggccggacggacgtgtgcgttgcgttttggttgtttcatttgagttcgtggtttggttgtgtacgttggtgtcttcatgggctagcttcgatctatcgtactatgtgtgttgtaatgaatctcgtttaagttttttgcagttccgtaccctgtcaaattggatggaatatataaagcgaactagtatt

SEQ ID NO: 2267 - DNA, 958 bp, Pseudoroegneria spicata
actgaagcagcggcggaagaagaagaagaagctagaggacatgggggcgccgagagctctcctcgcgagcttcctgctcgccgcgttggccacccaggccttcgtctccgtctcggccaggagcggcccgacggacaaggcaagccaagatgacgtgaagaagccggactgcgtgccatccctcgacccgcacaatttccccggccacgggggcaccaccgtgccgcttccctcgcacggaggctcctccggcacgccgccttaccacggaggctcaggcacaacgccatcgcacggcggctccgggtcgactccgtcgcacagcggctccgggtcgactccgtcgcacagcggctccgggtcgctgcctgacccttcacacggcgggtacgggacgccgccttcgcacgggggctctggttcgctgcctgacccgtcgcacagcggaggaggttacgggtccactccggacgcgccatcacacggcggaggcgcgtacgggagctccccaacgccttccactggcggagcctacggcagctcacccacgccgtcccacgacggaggcgcctacgggagctccccgacgccggcccacgacggaggctcctacagcggaactccggctgcaccgtcgcacagcagccacgggtctgtcacaccgacgccgctcatcccagtcgaccccaacagcctcgggacatgcgactactggaggacgcaccccatgcagatctggtcggcgctggggagctggccgagctcggtgagccacttcttcggcgccgccggtggcgcggtcgccggcgggccgagcgtgagcatccaggacgcgctggcgaacacgaggaccgacggcgccggcgcgctgctgcgcgagggcaccgccgcgctgctcaactccatgacccgccaggggttcgcctacaccaccgagcaggtgagggacgcgttcgcg

SEQ ID NO: 2268 - DNA, 1559 bp, Leymus cinereus x Leymus triticoides
aacaatggcctcgacggcaacgacagctcggcacatggtcgctttaccgtacccgggccgcggccacatcaaccccatgcttgccgtgtgccgcctgctcgtcgccgcggacggcgctctcgccgtcaccgtcgtcgtcacggaggagtggcacgggctgctggcctctgccggagtgacccccacgctaccggaccgcgtccgcctcgacaccattcccaacgtcatcccctccgaaaacggccgtggggccgaccacgccggcttcatcgaggccgtaaactgcaagatggcggagcccgtggagcggctgctcgaccggctggtgctggagctggggcggaggccagatgctatcgtggccgacacatacctgcagtgggcggtggcggccggcgcgcagcgcgggataccggtgggctcgctgtggacccagccggccacgttcttcctggcgctctaccatttggacctgtggccgccggtggatgaaggtgccagcgaagaagaattaagctgcaagtccatggagcaatacgtcccgggcctgtcatcactaagattgtctgatctcaagatcttcagtgcctgggagcggccaatgaaaatagcagcggaggtgttcgtcaacgtacgtaaagcacagtgcgtccttttcacctccttccacgagcttgagcccggttgcatcaacaaaatagcagagtcacttccctgccccgtctatccaatcggcccgtcaatcctacgcgcgccggacaaaggggagagcgctcgtgacgaggagcaccggcgctggctggacgcgcagccggagaactcggtgctgtacgtctcgttcggcagcttcgtctccatgccgcccaagcagttcgaagagatcgccatgggcctgcgcgacagcgcggtcaggttcttctgggtggcccgggacagggccaccgccggcctgcgggagaagtgcggcgacaaggggctggcggtgccgtggtgcgaccagcaggaggtgctgcgccacccgtccgtcggcggcttcctcagccactgcgggtggaactcggtgctcgaggccgtgtgcgccggagtgcccgtgattggcttccccgttgcgtgggatcagttggtgaatgcccggatggtcgccgacgaatggaaggtcggcatcaacctgaggaggcagaggggggaggatgggattgtgagcagggccgcggtctctgatgccgcgaggaagctgatggatttggacagtggtgccggccaagagatgaggagaagggctgcgcatctgcgcgaggcttcccgtggtgcggtcctggaaggcggctcgtcccatcgttctttgagcgctttcctggaggatcttgtcgagggaaaattggaggtcgctgaaagttctgcgtgatattcttcgtttggtccagtcagtgacagaaaaaaatactctagctatttgcgggtcaaaatagtgcaccataaactattcttcagtgacagaaaaaaaatactctagctatttgcgggtcagaatagtgcaccataaactattcttcaaagaa

SEQ ID NO: 2269 - DNA, 883 bp, Solanum phureja
accaaagatttttctctctgttttttccctgttttcgatatctagagctttttctgtgttaagggttgttatcaagattcagaaaaaatggctggtggtggagcatcgactaaggcatcgaatggtggtcctactagagtgaggaagagggttgaagttgaatctgctgctgctgcagctagtcttaagcgtgctaaggatggaagtgcttttgctcgttgtgaagaatgcagcaaagatgtgcctatagcattgataagcttccacaattgtagccttgatgcaaaaatcaagatgaacttggaagctcaagttgtggaaaatcagactgaagtgaagaaaccagcagcaaagagcagggagaagtcaacagagccaaaggctaagagggaaaagaaacccaagaatccaaatgctccaaagcgccctcctactgctttctttgtgttcatggatgattttagacaggaatttaaggctgcaaatcctgattgcaagagtgtttccacggttgctaaggagggtggtgagaaatggaagtccatgactgatgaggagaaaaaaccatatcaggaaaaggctgcagagctgaaagcagcatatgagaaagccttaaagtctaacactgatgctgataatgccaatgatgacgatgaggagcctgagaaggaaataaaggaggaaatagtggtagatgaggaagtgaaggatgagatagaagtagatgaggaatagaactgttagtttttgaattggtgtcactatcttcaagattcttgaattgactagtttcgagagcttatgtaaatttttgattcaattgtcaacttagtcctacttgaagtagttatatatgaaaatttatggtttagttcttgcttgc

SEQ ID NO: 2270 - DNA, 1005 bp, Nicotiana tabacum
  misc_feature (319)..(319): n is a, c, g, or t
gaaaaccacattttcccacattccctcccttcatatccttctttaaaccctccaaatccccactcttttccccaacaatcccacttctgttttcctcttctaattccgaaattttctttgaaaagttcattaaaaaattagctgtaaatggctggtggtggagcatcaaagaattcaaatggtccaactagagtaagaaagagagtagaagttgaatctgctactgctgctagtcttaaacgtgctaaagatggcagcgcttttgctcgttgtgaagaatgcaacaaggatgtacccatagcattgattaatttccacngttgtagccttgatgctaaaatcaagatgaatttggaggctcaggttgtagaaaatgcaagtgaaacaaagaaaccagcatcaaagagtaaggagaaattgaccgaaccaaaagctaagagggaaaggaaagcaaagaatccaaatgcaccaaaacgccctcccactgctttctttgtattcatggatgagtttaggcagacgtttaaggctgcaaatcccgattgcaagagtgtctcaacggttgctaaggaaggtggtgagaaatggaagtccatgactgatgaggagaaaaagccttatcaggataaggcagcagagctcaaagcagcatatgaaaaggccctgaagcagtctatcactgatgctgagaatgccaatgatgaagatgagttgtctgagaaggaagtgaaggaagaagtagaagtagttgaggaagtgaaagaagaaacagaagtagttgatgaagtgaaggaagaggtagaagtagacgaggaatagagcttttggtgtttgaaatttgtagctattttccagctttttgaaatgactagtcttgagcttatgtaaattttgatcattgtcaacttaggtttattaaaagtaatatatggaagcttatgttaagttcttgctttcaagtctttttggaatgaaatttatgttaactttctgatagcggccgca

SEQ ID NO: 2271 - DNA, 1527 bp, Saccharum officinarum
cgctgtcctggctccggcggtcatggcgcagacctgcgacgacgagctgccggctcagcttgtcggaaacttctcggggctcgcctgcgcccccgtctggcacaacttcgtgctccggtacgcacagggcaaggacaacgtgctgcgggtggtgctgtcgaccatgtacagcacggggtgggtggggatggggttctccaagaacggcctcatggtgggctcgagcgccatggtggggtggatgggcaagacggggctcccgcacatcaagcccttctcgctggggggcaagaccccctcccaggtggtcgcggaccagggcttcctcgtctccagcgaccaccacaagcccaccgtgctcgtgcaccaggccaagatctacctcgccttccagctcagcttcaccgagccgctcaagggccagaacgtactcctcgccttcggctccgccatccccgtcaacgaccgcctctccgagcaccaggacaagaccgccatcgtatttgatttcaccacaggcagctcttcaagctcgtcatccttcccggaaggtctgaaaaggacccatggggcgctcaacttgttcgcgtggggtgtgctcctgccaattggcgccattgttgcaaggtactgcaggagatgggatcctctgtggttctacctccatgccggcatccagtttgtgggattcatcctgggtctggccggcgtggtggctggagtatcattgtacaacaagatccaagccgacgttccggcgcataggggcctcggcatatttgtgcttgtgctaggcattttgcagattctggcaattttcctgaggcccaataaggactccaagtaccgcaagttctggaactggtaccaccactgggtcggcaggctcgccctcttctttgcagccatcaacattgtcctggggatcaaggtcggcggcgcaggcaactcttggaagatcggctacggtttcaacctggccgtccttctgatcaccatcatcaccctggaagtcctgctctggacaaggtggaaaaacaacagcggctccacgggggcatattagcgacttaccgatttaggtgttcgtgatggtcactgtgttaggatcgatggatgtgtacctctgtgtaacccgtagatccggtgtgagccttctcaccctttgcgcgttattcaccgctctgtccatgacgccgcagcagcttggacgccggtgtaggggcagctccgggtcggtggcgagacggcgaggtagcgatgccgtggagatccagaggggacggtggtgaccctgcagtgaatcgacggcggtggtggcgggctcatcccggcgctggcagcacgtctttagatcggtattaggggttctgtaggtgggtgtgggggctccagtgaacctcttctcgagctcgatccccaccttctctatttgtatgtgctgtgcgacaggggcccaccaccaattatgggtgtgctcccccgattcaggaagcaaccccaaggccccataggccgttgggccct

SEQ ID NO: 2272 - DNA, 1796 bp, Zea mays
gacaacatggctagcacaacccaagaaagatccatagggagggtagcgcgtgcacggtgcacacacatggatcctttggcttgttctagatctagcgacttgggacgcttgctcacaggagattctccattctcgtaagaacagcccaccgtcactagcaacatgccaaattgccaatgacaatatcataagctgcatccaggtcggagatgcccacacagccaccaacacgtacccaactcccacgcagctcggttcagtaaaagctactagcagtagtgggcggtggttggcacatcgcagttgatacggaggcgtagcgtaggctgtactggttctcccgcgtcggcgtcgacggccgtgtccttctcgggaagatggtaatgggggccgcgtccgtcggcacgctgctcgtcgcgctcgccgtcctcgctccggcggtgatgacgcagagctgcgacgacgagctgccggctcagctcgccggcaacttctcggggctcgcctgcgcccccgtctggaacagcttcgtgctccggtacgcgcaggacaaggacaacgtgctgcgggtggtgctgtcgaccatgtacagcacggggtgggtggggatggggttctccaagaacggcctcatggtggactccagcgccatggtggggtggatcggcaagacggggctcccgcacatcaagccgttctcgctgcggggcaagaccccctcccaggtggtcgcggaccagggcttcctcgtctccagcgacaaccacaagcccaccgtgctcgtgcagcaggccaagatctacctcgccttccagctcagcttcaccgagccgctcaggcgccagaacgtgctcctcgccgtcggctccgccatccccgtcaacgaccgcctcgccgagcaccaggataagacctccatcgtattcgatttcaccacaggcagctcatcaggctcgtcatccttcccggaaggtctgaaaaggacccatggggcgctcaacctgttcgcctggggcgtgctactgccgatcggcgccatcgtcgcaaggtactgcaggagatgggaccctctgtggttctacctccacgccggcatccagttcgtggggttcatcctgggcctagccggcgtcgtggctggagtatccttgtacagcaagatccaggccgacgtccccgcgcacaggggccttggcatattcgtgctcgtgcttgccattttgcagatcctggcgattttcctgaggcccaacaaggactccaagtaccgcaagttctggaactggtaccaccactgggtcggcaggctcgccctcttctttgcagccatcaacattgtgctcgggatcaaggtcggcggagcaggcaactcttggaagatcggctacggtttcaacctggccgtccttctgatcaccatcgtcaccctggaagtcctgctctggacgaggtggaaaaacagcaccggttccacgggggcatattagctacttaaccgatttttataggtgtttgtgatggtcagtgaaggaggttcgtattcttttgttcgaatattttcgcgtgtatgcagttgctgtaatgtccgcgtttgctgcgtgatgtgttttccttttggtgcatgtgtcctggacttgccgttccgatgccttttgtgctgctcggaatggagatggaatgatgatttccgcaattccgccgcatttcccatgctgcgaatggtggtagatctggtatattctgttgtgacactgtgactgacttagagtatctatacgagactatatttttgactc

SEQ ID NO: 2273 - DNA, 1723 bp, Zea mays
ctttggcttgttctagatctagcgacttgggacgcttgctcacaggagattctccattctcgtaagaacagcccaccgtcactagcaacatgccaaattgccaatgacaatatcataagctgcatccaggtcggagatgcccacacagccaccaacacgtacccaactcccacgcagctcggttcagtaaaagctactagcagtagtgggcggtggttggcacatcgcagttgatacggaggcgtagcgtaggctgtactggttctcccgcgtcggcgtcgacggccgtgtccttctcgggaagatggtaatgggggccgcgtccgtcggcacgctgctcgtcgcgctcgccgtcctcgctccggcggtgatgacgcagagctgcgacgacgagctgccggctcagctcgccggcaacttctcggggctcgcctgcgcccccgtctggaacagcttcgtgctccggtacgcgcaggacaaggacaacgtgctgcgggtggtgctgtcgaccatgtacagcacggggtgggtggggatggggttctccaagaacggcctcatggtggactccagcgccatggtggggtggatcggcaagacggggctcccgcacatcaagccgttctcgctgcggggcaagaccccctcccaggtggtcgcggaccagggcttcctcgtctccagcgacaaccacaagcccaccgtgctcgtgcagcaggccaagatctacctcgccttccagctcagcttcaccgagccgctcaggcgccagaacgtgctcctcgccgtcggctccgccatccccgtcaacgaccgcctcgccgagcaccaggataagacctccatcgtattcgatttcaccacaggcagctcatcaggctcgtcatccttcccggaaggtctgaaaaggacccatggggcgctcaacctgttcgcctggggcgtgctactgccgatcggcgccatcgtcgcaaggtactgcaggagatgggaccctctgtggttctacctccacgccggcatccagttcgtggggttcatcctgggcctagccggcgtcgtggctggagtatccttgtacagcaagatccaggccgacgtccccgcgcacaggggccttggcatattcgtgctcgtgcttgccattttgcagatcctggcgattttcctgaggcccaacaaggactccaagtaccgcaagttctggaactggtaccaccactgggtcggcaggctcgccctcttctttgcagccatcaacattgtgctcgggatcaaggtcggcggagcaggcaactcttggaagatcggctacggtttcaacctggccgtccttctgatcaccatcgtcaccctggaagtcctgctctggacgaggtggaaaaacagcaccggttccacgggggcatattagctacttaaccgatttttataggtgtttgtgatggtcagtgaaggaggttcgtattcttttgttcgaatattttcgcgtgtatgcagttgctgtaatgtccgcgtttgctgcgtgatgtgttttccttttggtgcatgtgtcctggacttgccgttccgatgccttttgtgctgctcggaatggagatggaatgatgatttccgcaattccgccgcatttcccatgctgcgaatggtggtagatctggtatattctgttgtgacactgtgactgacttagagtatctatacgagactatatttttgactc

SEQ ID NO: 2274 - DNA, 994 bp, Panicum virgatum
tcgccccccagctgctccatggccatggcgacctccaccttctccccgcgccccgcctccctcaggcccctgcgggccggcgccaagcctcgcctccacctcctccccttcccccgcctccgcgccggccgccgggggagccgcctcgagcgcgccgccgcgggggaggcgcccgtcgaggtcgcgccgcccaaggagcccgaggcggagccggcacccgccgcggcttccaacgggtccgccgtcaaggccgtcgaggcgcccgcggaggccgcgccggcgccggctttccgggacgcgaggtgggtgaacgggacctgggacctcagcaagttcgagaagggcggcgccgtcgactgggacgccgtcatcgacgccgaggcaaggagaaggaaatggcttgaagattatccagaggccacaaatacagatgaggctgttgtctttgatacttcagttattccatggtgggcatggatgaagaggttccaccttcctgaagctgagaagctgaatggtcgtgctgccatgatcggcttcttcatggcttactttgtcgatagcttgacgggtgtggggcttgtcgaccaaatgggcaacttcttctgcaaaaccctgctgtttgttgctgtggctggcattctgcttatcaggaagaatgaggaccttgactcactgaagaagataatcgatgagacaacgttctacgacaagcaatggcaggcaacctggcaagatgagaccactggggggccgaagaactagatcagcgttggggtctgaatgcagaatccttttcttgtgttgtgttttgttttacggccctttttgtttccccatctagtgagacttgcaggaacattttgacaatataataatctacgtatcttgtaaaaagtatgaactcactttctgtgctagagataaattacgctgaagtttcatttgttatggtttgccatgtatggcctcaaacatttctcattggagcaga

SEQ ID NO: 2275 - DNA, 2752 bp, Triticum aestivum
gaaacgcacgccaaatttgcacacgcagtttccaccgacccgcagtgccgcacagcacaggcacagcgccaccgctaccgcgtccgtcatccccacacacacatgtagcccgacactctccacccgcacacacagagagacagtacacagctcagtcgcgggcgcgcagcgagatcgccacgctctcctccactctccagcgagcgcggagccggactccaaggcggccggcggtccggcgctcctgctccccgcgccgcctccgcgcaatgctggccgcttccggcgcagatcgggccgactcctcaccctcctcctcccggccgcggctctcgatcggcgcctgactccgggtgagcggaggacggctggatcttgcggcggacggcgcgagggagggacggacggacgcgctccgccgtctcccgatttccgcctgccaagagagaagagtgaagagctgatgagaaagcctggagtacagagttgaaagctattggcttccagcaagttcgaacaatgcagcatcttacactagcagcatctctgtctgctgctgttctctttgcatgcatcctgtatgctgaaagtgccgatctcaactcggacaagcaggctcttcttgcatttgctgcatccctgccccatggcaggaagctcaactggagctccacaacacctgtctgcacttcttgggttggagtgacatgcacaccggacaatagccgtgtacacacactacggttacctgcagtaggactctttggcccaataccctcggatacgcttggcaagcttgatgccctggaggtgttgagcctcaggtctaatcgccttactgttgacctccctcctgatgtaggatctattccttctcttcattccctctacctgcagcataataatctgtctggaatcataccaactacactttcatccagcctaacattcctagatctgtcctacaacacttttgatggggaaattccattgagagtacagaatctcactggacttactgcaatccttctccagaacaactctctttctggacccatccctgacttgcgtctccccaaattgaggcatttgaatatgagcaacaacaacctcagtggtccaataccaccttccttgcagaaattcccagctagttcattcttagggaatgcttttctgtgtgggttaccattagaaccatgtcctggaactgcgccttctccttcaccgacaccaccaccatcagtgcccagcaaacccaagaagagcttctggaaaaggatcaggacaggtgttctaattgcaattgctgctgcaggaggggtattgttgcttctcttgattcttgtactctgtatatgcatttgcaagagaaagaaatgcgcagaaccaaccgcagcttcgtcatccaaaggaaaagctgttgcaggtggaagggcagacacccctaaggaagattacagcagtagtgttcaggaggcagagagaaacaaactggttttcttcgagggttcttcatataactttgacctggaggatttgctgagagcctcggctgaagtacttggaaaaggaagctttggaactacctacaaggctgttcttgaggatagcaccacagttgtggtcaagagattaaaggagatggtggtggggaagaaagactttgaacagcagatggagatagttggcaggattggccagcatcagaatattgttccgctgcgtgcttattattactccaaagatgagaagctactggtgtatgactatgtcccagctggtagccttgctgctgttttgcatgggaacaaagctactggaagagctgcactggactgggagacgagagtaaagatatctctcggcatggctcgtggactcgctcatcttcacgccgagggaagcgggaagttcatccacggcaacctgaaatcgtcgaacatccttctgtcacagaacctggacggctgcgtctccgaattcggcctggcacagctcatgaccaccctacctgcccctgcgcggctcatcggataccgcgcgccggaggtcctggagacgaagaagccgacccagaagtcggacgtctacagcttcggcgtgctgctcctggaaatgctgaccggaaaggcgcccctgaggtcccccggccgcgaggactccgtcgagcacctgccgcggtgggtgcagtccgtggtccgggaggagtggaccgcggaggtgttcgacgtggacctgctccggcaccccaacatcgaggacgagatggtgcagctgctccaggtggccatggcgtgcgtcgccgtcgcgccggaccagcggccgaagatggacgaggtgatcaggcggatcgccgagatccggaactcgtactcggggccggcgagcccgccggaggagaccggcgcccaggcgccatgagggcgtggagataaaaaagagtcccattgtgtttagcatgcagaggtagctagctaagctaagctaggttgcatagttacttcttacttggttatatatatagctttgagcgaaagttgatagccgcttgcttggttgattagtggagtgcggtttctgttgatccctgattctttcttgtttcgggtaatttttctgtgccgttttcggagtagtgactggtgaggctactgatctggatatctgatggtactgctggtgtttgtgttgccctgtagtttggcatgcctttttttccccagagtgtgattaatgggattcattgagt

SEQ ID NO: 2276 - DNA, 2290 bp, Brachypodium distachyon
tgctagaagagtgaagagccgatttgtaaacttggactgtgaagttgaaacctattcgattccagaaaacctcaaccatgcagcatcttatacttgcagccttgtctgctgctgttctttctgcatgcctcctgcatgcggaaagtgctgatctgaactctgacaagcaggctcttcttgcatttgctgcatcactgccccatggcaggaagctcaactggagctccacaacacctctctgcacttcttgggtgggagtgacatgcacaccggacaacagtcgtgtacacacattacgcctacctgcagtagggctctttggccccataccctcggatacgcttagcaagcttgatgccctggaggtattgagcctcaggtccaatcgccttactgttgacctccctcctgatgtgggatctattccttctcttcattccctctttcttcagcataataacctgtctggaattataccaacttccctttcttccagtttaacatttctagatttgtcctacaacactttcgatggagaaatcccattgagagtgcaaaatctcactggacttactgcaattcttctccagaacaactctctttctgggcctatccctgacctccaactgcccaaattgaggcatttgaatgtgagcaacaacaacctcagtggtccaataccaccttccctgcagaaattcccagccagttccttcttggggaatgcttttctatgtgggtttccattggaatcatgtcctggaaccgcaccttctccttccccaacatcaccatcaccaatgcctagcaagaccaaaaagagcttctggagaaggattagaactggtgttctaattgctgttgctgctgcagcaggggtgttgttgctcattttgattatcgtactcttggtgtgtattttcaagagaaagaaacacacagaacctaccacaacttcgtcgtccaaaggaaaagctattgcaggtggaagggtagaaaaccctaaggaagactatagcagtagtgttcaggaagcagagaggaacaaactggtgttctttgagggttcttcatataattttgacctggaggatttgctgagagcttcagctgaagtgcttggaaaaggaagttatgggactacctacaaggctgttcttgaggatggcaccgtagttgtggtcaagaggttaaaggaggtggtggtagggaagaaagactttgaacagcagatggagatagttggcaggattggccagcaccaaaatgttgttccattgcgtgcttattattactccaaggatgaaaagttactggtgtatgactatgtcccatctggtagccttgccgctgttttgcatgggaataaaactacgggaagagctccattggactgggagaccagagtaaagatatctcttggtgtggctcgtggaatcgctcatcttcatgctgagggaagcgggaagttcacccatggcaatctcaaatcatcgaacatccttctgtcgcagaacctcgacggttgtgcctctgagtttggcctggcacagctcatgagcaatgtacctgctcctgcgcggcttatcggatatcgtgctccagaagtcatggagacgaagaagccaacccagaagtctgatgtctacagcttcggtgtgctactccttgaaatgctaactgggaaagcccctctcaggtctccgggacgcgatgattccgtcggcgaccttccgagatgggtgcagtccgtggtccgagaagagtggacggcagaggtcttcgacgtggacttgttaaggcatccaaacatcgaagacgagatggtccagctgctccaggtcgcgatggcgtgtgtcgccatcccccctgagcagcggcctaaaatggaggaggtggtcgggaggatcaccgagatccggaactcctactcgggggcgatgacgccgccggaggagacaaccctggcgccgccataagggcacaaagatataaccccttgtattcagcagatgtagctatagctaggtcgcttagttacatgcttatagataatagcctcagcaaagttgatagccgcttgcttttacctgttgatctctgatgattctttgttccaagtaacttttgctgtgccattttggcagtagcgaactagtgatcgggatgatggcccttgccgtcgttctcttttcggttaaaccggtaggtcttgtgatctggtcttcacagcgttcgtgctcttctgtaattcggcattgtttttcccgagtgtgattgagattcatcc

SEQ ID NO: 2277 - DNA, 2578 bp, Sorghum bicolor
cacacgccccgacactccggacagagggggcgcaggcacgagaacagctcagtcgcggcgagctcccgggtctccagcgaaagagccggaggcgagagtggcggctggcgcgggctccctccgaggctctacgcggcgcctcgccgcaatgctggccgtccctgggcgcagatcggcctgagtcgccgtcgctgctctcgaatcggcggcgtcttcctcgcatgcttccggccaaggcttggatcttgcggcggaagacgcgggaagggagagtgggagcctgtcgtttcttggttttctgctcgccaaagaggaatgaagttatgatggaaaagtttgtatagtagcgctgaatccagttctcttcaagcaagtgtcaaccatgcaacatcttacagtgatagcctttttggctgcttctctcctcattgcaagcattccacatgccaaaagtgctgatctgaactctgacaaacaggctcttctcgcatttgctgcatcactgcctcatggcaggaagctcaactggagctccaccacacctgtctgcacttcttgggtgggggtgacatgcacaccagataagagccgtgtacatacactgcgcctacctgctgtaggactttttggtccaataccatcagacactcttgggaagcttgatgccctggaggtattgagccttaggtcaaatcgccttactgtcgacctccctcctgatgtaggatctattcctgccctccattccctctaccttcagcataataacctgtctggaatcataccaacttccctctcttccagcttaacgttcttagacctttcatacaacactttcgatggagaaatcccattgaaagtgcaaaatcttactcaacttactgcattgcttctccagaacaactcactttctggacccattcctgacctccaacttcctaaattgagacatttgaatttgagcaacaataacctcagtgggccaataccaccttccttgcagaggtttccatcaagttccttcttagggaatgtttttctgtgtgggtttcctttggaaccatgttttggaactgcacctactccttctccagtatcaccaccatcaaccaataagaccaagaagagcttctggaaaaagatcagaactggtgtgctaattgcaattgctgctgttggaggggtattgttgcttattttgattatcacgctcttgatatgtattttcaagagaaagagacacactgaacctaccacagcttcgtccaaaggaaaggctattgctggtggcagggcagaaaaccctaaggaagactacagcagtggtgttcaggaagcagagaggaataaattggttttcttcgagggcagttcatataattttgacttggaggatttgttgagagcttctgctgaagtccttggaaaaggaagttatggaaccacctacaaagctgttcttgaggatggaaccacagttgttgtcaagagattgaaggaagtggtggttagcaagaaggattttgaacagcagatggagatagttggtagggttggccagcatcaaaatgtcattccattgcgggcttactattactccaaggatgagaagctgttggtgtttgattatgtcccatctggtagccttgctgctgttttgcatgggaataaagcttctggaagagctccattgaactgggagacaagagtcaagatatctctggatgtagcccgcggtattgcccatcttcatgctgagggaggagggaagttcatccatggcaacatcaaagcatcgaatgtccttctatcacagaacctcgacggctgtgtctctgagtttggcttggcacagatcatgaccactccacagactgcgccacggcttgttggataccgagcaccagaagtcctcgagactaaaaaatccactcagaagtccgacgtctacagctttggtgtcttgctccttgaaatgctaactggaaaagcccctctcagatcccctgggcgcgaggattccatagaacaccttccaagatgggtgcagtctgtggttcgtgaagagtggaccgctgaggtcttcgacgtggacttgttaaggcatcccaacgtcgaggatgagatggtccagatgctccagatcgcaatggcatgcgtggccattgcccccgagcagcggcctaagatggaggaggtgatcaggaggatcacggagatccggaattcttactcttctgggacaaggacgcccctggaggacaagccagagactgcacaagcaccatgagggggtacagcatagtttagcaagagatggtagctaggttgcatagcgaattgcttatagagcttcagcaaagttgataaccacctgcattcccgatcgtttccagtaaatctgttgtgcattttttttctgagtctagcgagctgattgataatccatgtcattgtattgttcagttaaatcagtagctcttctgattttcataggatagtgttgctctgtaatttgacataatctctgcagcgtgattaatgaattgaatttcccttctatttctgcccgtcatca

SEQ ID NO: 2278 - DNA, 2212 bp, Oryza sativa
atgccctgcagggcaccaccaccagccaggcaggggcagcagcggctgatctcgtcgtcgtcgtcgacgtcgacgtcggctcttcttgcatttgctgcctcactgccacatggcaggaagctcaactggagctctgcagccccagtctgcacttcatgggttggggtgacttgcacaccagacaatagccgcgtgcaaacactacgcctaccagcagtagggctctttggcccgctaccctcagacacgcttggcaagcttgatgccctggaggtattgagccttaggtccaatcgcatcactgttgatctccctcctgaagtaggatccattccttctctccattccctatatcttcagcataataacctatccgggatcataccgacttcccttacttccactttaacatttctagatctgtcatacaacacttttgatggagaaatcccattgagagtgcaaaatctcactcaacttactgcattgcttctccagaataactctctttctggacccatccctgacctccaactcccaaaattgaggcatttgaatttgagcaacaataacctcagtgggccaataccaccttccttgcaaagattcccagccaattccttcttggggaatgcttttctatgtgggtttcctttacaaccttgccctgggactgcaccttcaccttctccttctccaacatcaccatcacccggcaaggccaagaagggcttctggaaaaggatcagaactggtgttataattgcacttgctgccgcaggaggggtattgttgctaatcttgattgttttactcttgatatgtattttcaagagaaagaaaagcacagaacctactacagcttcttcgtcaaaaggaaaaactgttgctggtggaaggggagaaaatcctaaggaggagtacagcagtggtgttcaggaagctgagaggaataaattggttttctttgagggctgttcatataattttgacctagaggatttgctgagagcttcagctgaagtccttggaaaagggagttacggaactacttataaagctgttcttgaggatggcaccacagttgtggtcaagagattgaaggaggtggtcgtggggaagaaggattttgaacagcagatggagatagttggcagggttggccagcaccagaatgttgtcccattgcgtgcctactattactccaaggatgagaagctactggtgtatgactatatcccatctggtagccttgctgttgttttgcatgggaataaagctactggaaaagctccattggattgggagacgagggtaaagatatctcttggtgtggctcgtggaattgctcatcttcatgctgagggaggcgggaagttcatccatggcaacctcaagtcatcaaacatccttctgtcacagaacctcgacggctgtgtctctgagtttgggctggcacagcttatgaccattccaccagctccagcacgccttgtcggatatcgtgcaccagaagtcctcgagactaaaaagccaacccagaagtctgatgtctacagcttcggtgtgttggtcctcgaaatgctgacaggaaaagcgcctctgagatctcctggacgagaggactccattgagcacttgccaaggtgggtgcagtctgtggtccgggaagaatggaccgcggaggtttttgacgtcgacttgttaaggcatcccaacattgaggatgagatggttcagatgctccaggttgcaatggcatgtgttgccgccccccctgatcaacggccaaaaatggacgaggtgatcaggaggatcgttgagatccggaattcctactccgggtcaagaacaccaccggaggagaagcagaaggatgaatctgcagcgccatgagcgccattgtttagcaaaggtagctgctagctaggctgcatagttactggcttatagagagcttcagcaaagttgatagccgcttgctttagtgaggtttttctgctgatttctgatcttctttagataattttttttgggatttaattctcacagtagtgatctgttggtcattaccattgttccattccagttaaatcagtagctcttctgatttttcatagggtgatgttcagtgttctgtaatttgacatgcctttttttccagtgtgattaatgaattgagttttccttgcgatttcggctttgtcagaaa

SEQ ID NO: 2279 - DNA, 2219 bp, Zea mays
aagcaagtctcagccatgcaacatcttacagtgatagccttcgtggctgcttctctcattgcaagcattccacatgccaaaagtgctgatctgaactctgacaaacaggctcttctcgcatttgctgcatcactgcctcgtggcaggaagctcaactggagctccaccacacctgtctgcacttcttgggtgggggtgacatgcacgccagataagagccgtgtacatacactgcgcctacctgctgtaggactttttggtccaataccatcagacacccttgggaagcttgatgccctggaggtattgagccttaggtcaaatcgccttactgtcgacctccctcctgaggtaggatctattcctgccctccattccctctaccttcagcataataacctgtctggaatcataccaacttccctctcttccagcttaacattcttagacctgtcatacaacacttttgatggagaaattccattgaaggtgcaaaatcttactcaacttactgcattgcttctccagaataactcactttctggacctattcctgacctccaacttcccaaattgagacatttgaatttgagcaacaataacctcagtgggccaataccaccttctttgcagaggtttccattaagttccttcttagggaatgcttttctgtgtggctttcctttggaaccatgttttggaactgcacctattccttctccagtatcaccaccatcacccaataagatcaagaagagcttctggaaaaagatcagaactggtgtgataattgcaattgctgctattggaggggtattgttgcttattttgattctcatgctcgtgatatgtattttcaagagaaagggacacactgaacctaccacagcttcgtccaaaggaaaagctattgcaggtggaagggcagaaaatcctaaggaagactacagcagtggtgttcaggaagcagagaggaataaattggttttcttcgggggtagttcatataattttgacttggaggatttgttgagagcttctgctgaagtccttggaaaaggaagttatggaaccacctacaaagctgttcttgaggatggaaccacagttgttgtcaaaagattgaaggaagtggtggttagcaagaaggactttgaacagcagatggagataattggcagggttggccagcatcaaaatgtcattccattgcgggcttattattactccaaggatgagaaattgttggtgtttgattatgtcccatctggtagccttgctgttgttttgcatgggaataaagctgatggaagggctccattgaactgggagacaagggtcaagatatctctggacgtagcccgtggaatcgcacatcttcatgctgagggaggagggaagttcatccatggcaacatcaaagcgtcgaacgtccttctatcgcagaacctcgacggtcgcgtctccgagttcggcttggcacagatcatgaccactccacagacgtccctgccacagcttgtcggataccgagcaccagaagtcctcgagacgaaaaaaacgatccagaagtccgacgtctacagctttggtgtcttgctccttgaaatgctaaccggaaaagcccctctcaggtctcccggtcgcaaggattccgtagagcacctcccaaaatgggtgcggtctgtggttcgcgaggagtggaccgcggagatcttcgacgtggacctgctgaggcaccccaacgtcgaggacgagatggtacagatgctccagatcgcgatggcgtgtgtggccgccgaccccgagcagcggcctaggatggacgaggtgatcaggaggatcacggagatccggaattcttactcttcttcttctgggacaaggacgcccctggaggacaggccagagaccgcgcaagcaccgtgatagtagtttagcaagagatgttagctaggttgcatagtgaattggttatagagcttcggcaaagttgatagccacctgcatagcgcagtttccgtcggttccatatcgtttccagtaaatctgttgtgcattttcttttttccgtcggttccagtaaatctgattgacagtccatgccattgtattgctaagttaaatcagtatctcttctgattttcataggatagtgtcgttctgtaatttgacataatctcctgaggccgtgattaatgatttgaatttcccttcta

SEQ ID NO: 2280 - DNA, 2204 bp, Zea mays
atgcaacatcttacagtgatagccttcgtggctgcttctctcattgcaagcattccacatgccaaaagtgctgatctgaactctgacaaacaggctcttctcgcatttgctgcatcactgcctcgtggcaggaagctcaactggagctccaccacacctgtctgcacttcttgggtgggggtgacatgcacgccagataagagccgtgtacatacactgcgcctacctgctgtaggactttttggtccaataccatcagacacccttgggaagcttgatgccctggaggtattgagccttaggtcaaatcgccttactgtcgacctccctcctgaggtaggatctattcctgccctccattccctctaccttcagcataataacctgtctggaatcataccaacttccctctcttccagcttaacattcttagacctgtcatacaacacttttgatggagaaattccattgaaggtgcaaaatcttactcaacttactgcattgcttctccagaataactcactttctggacctattcctgacctccaacttcccaaattgagacatttgaatttgagcaacaataacctcagtgggccaataccaccttctttgcagaggtttccattaagttccttcttagggaatgcttttctgtgtggctttcctttggaaccatgttttggaactgcacctattccttctccagtatcaccaccatcacccaataagatcaagaagagcttctggaaaaagatcagaactggtgtgataattgcaattgctgctattggaggggtattgttgcttattttgattctcatgctcgtgatatgtattttcaagagaaagggacacactgaacctaccacagcttcgtccaaaggaaaagctattgcaggtggaagggcagaaaatcctaaggaagactacagcagtggtgttcaggaagcagagaggaataaattggttttcttcgggggtagttcatataattttgacttggaggatttgttgagagcttctgctgaagtccttggaaaaggaagttatggaaccacctacaaagctgttcttgaggatggaaccacagttgttgtcaaaagattgaaggaagtggtggttagcaagaaggactttgaacagcagatggagataattggcagggttggccagcatcaaaatgtcattccattgcgggcttattattactccaaggatgagaaattgttggtgtttgattatgtcccatctggtagccttgctgttgttttgcatgggaataaagctgatggaagggctccattgaactgggagacaagggtcaagatatctctggacgtagcccgtggaatcgcacatcttcatgctgagggaggagggaagttcatccatggcaacatcaaagcgtcgaacgtccttctatcgcagaacctcgacggtcgcgtctccgagttcggcttggcacagatcatgaccactccacagacgtccctgccacagcttgtcggataccgagcaccagaagtcctcgagacgaaaaaaacgatccagaagtccgacgtctacagctttggtgtcttgctccttgaaatgctaaccggaaaagcccctctcaggtctcccggtcgcaaggattccgtagagcacctcccaaaatgggtgcggtctgtggttcgcgaggagtggaccgcggagatcttcgacgtggacctgctgaggcaccccaacgtcgaggacgagatggtacagatgctccagatcgcgatggcgtgtgtggccgccgaccccgagcagcggcctaggatggacgaggtgatcaggaggatcacggagatccggaattcttactcttcttcttctgggacaaggacgcccctggaggacaggccagagaccgcgcaagcaccgtgatagtagtttagcaagagatgttagctaggttgcatagtgaattggttatagagcttcggcaaagttgatagccacctgcatagcgcagtttccgtcggttccatatcgtttccagtaaatctgttgtgcattttcttttttccgtcggttccagtaaatctgattgacagtccatgccattgtattgctaagttaaatcagtatctcttctgattttcataggatagtgtcgttctgtaatttgacataatctcctgaggccgtgattaatgatttgaatttcccttcta

SEQ ID NO: 2281 - DNA, 2707 bp, Zea mays
ataatcgcgccgcgcaggcggcatcacactccagtacagctctcactgcgccctgcccgcatcggctccaccacgctccacgccccacgcccccctacacacacacacaccccgacaccccggacagagggggcgcaggcacgagaacagctcagtcgcggcgagctcccgggtctccagcgaaagtgccggaggagagagtggtggcggctggcgcgggctccctccgaggctctacgcggcgcctcagcgtaatgctggccttccccggggacagatcggcctgagtcgccgttgccgctctcgaatcggcgtcttcctcgcatggttccggccagagcttggatctcgcggcggaagacgcgaggcggaaaagtggggagggtgtcgttccttggttttcttctcgccaaagaggattgaagttatgatggaaaagcttgtatagtagcgctaaatctaattctcttgaagcaagtctcaaccatgcagcgtcttacagcgatagtcttcgtggctacttctttccttattgcaagtgttccacatgccaaaagtgctgatctgaactctgataagcaggctcttctcgcatttgctgcatcactgcctcatggcaggaagctcaactggagctccaccacacctgtctgcacttcttgggtgggggtgacatgcacaccagataagagtcgtgtacatacactgcgcctacctgctgtaggacttttcggtccaataccatcagacactcttgggaagcttgatgcactggaggtattgagccttaggtcaaatcgccttactgttgacctcccacctgatgtaggatctattcctgccctccattccctctaccttcagcataataacctgtctggaatcataccaacttccctctcttccagtttaacattcttagacctgtcatacaacactttcgatggagaaatcccattgaaagtgcaaaatcttactcaacttactgcattgcttctccagaataactcactttctggacccattcctgacctccaacttcccaaattgagacacttgaatttgagcaacaataacctcagtgggccaataccaccttccttgcagaggtttccatcgagttccttcttagggaattcttttttgtgtgggtttcctttggaaccatgttttggaactgcaccttctccttctccagtatcaccaccatcccccagtaagaccaagaagagcttatggaaaaagatcagaactggtgtgataattggaattgctgttgttggaggggtattgttgcttattttgattctcgtgctcttgatatgtattttcaagagaaagggacacactgaacctaccacagcttcgtccaaaggaaaggctattgcaggtggcagggcagaaaaccctaaggaagactacagcagtggtgttcaggaagcagagaggaataaattggttttcttcgagggcagttcatttaattttgacttggaggatttgttgagagcttctgctgaagtccttggcaaaggaagttatggaactacctacaaagctgttcttgaggatgcaaccatagttgttgtcaagagattgaaggaagtggtggttagcaagaaggattttgaacagcagatggagataattggtagggttggccagcatcaaaatgtaattccattgcgggcttactattactccaaggatgagaagttgttggtgtttgattatgtcccatctggtagccttgctgctgttttgcatgggaataaagctgctggaagagctccattgaactgggagacaagagtcaagatatctctggacgtggcccatggaatcgcccaccttcataccgagggaggagggaagttcatccacggcaacatcaaagcatcgaacgtcctcctatcgcagaacctcgacggctgcgtctccgagttcggcctggcacagatcatgaccaccccacagaccccgccgcggcccgtcgggtaccgggcgcccgaagtcctcgagaacaagaaatcgacccagcagtccgacgtctacagcttcggcgtcctgctcctcgaaatgctcacgggaaaagcccccctcaggtctcccgggcgcgaggacccctccgtcgagcaccttccgaggtgggtgcagtccgtggtccgtgaggagtggaccgccgaggtcttcgacgtggacttgctacggcaccccaacgtcgaggacgagatggtccagatgctccaggtcgcgatggcgtgcgtggccgctcaccccgaggagcggcccaagatggaggaagtgatcaggagggtcacggaggtccggaattcttactcttctgggacgaggacgcccctggaggacaagccatcggagactgcacgagcgccatgagggggtacagcgtagtttagcaggagacggtagctaggttgcatagtggattccttatagagcttcagcaaagttgatagccacctgcatagcgcagtttccctcgcgattcccgatcgtttccagtaaatctgttgtgttgtttcctctctttttttccccctgattctagcggtctggttgtcgatccatgccattgtattgttgttcagttaaatcagcagctcttctggttagtgttgcactgtaatttgacataatctttgcagcgtgattaatgaatttcatttgccttctgtttctgcca

SEQ ID NO: 2282 - DNA, 1295 bp, Brassica rapa
  misc_feature (21)..(21): n is a, c, g, or t
ttgaaagcaaatagcaaatantaaattcgaacattgcagctatggctcccacattgcaaggcgagtggatcaaggtgcagcagaaaggaggagagggacctggagcaagaagctcacacggcatagccgtggtcggagacaagctctactctttcggtggcgagcgtactccaaacatttccatcgacaaacacctttacgtctttgacttcaacactcacacatggtcaatcgccccggccaacggacaagcccctaacgtccaggctctgggcacccgcatggtggccgtgggaactatgctctatctattcggaggccgtgatgagaagaaacagttcgacgacttttactcgtacgatacggtgaaacaggagtggaagttcatcaccaagctcgatgaagagggaggacccgaggctcgtacttaccactcgatggcttcggatgaaaaccacgtgtatgttttcggtggggtgagcaaaggcgggaccaacaagacccccttcaggttcaggaccatcgaggcgtataacattgctgatgggaagtgggctcagctacctgatcctggggagcagttccctaggttcgagagaagaggaggagctggattcattgtggtggaaggaaagatttgggtggtttacgggtttgcaacttcgcctgatcctaatggaaaaaacgactatgagtctgatcttgtgcactactttgatcctgctactcaaaagtggaccgaagtggagactaaaggagagaaaccttctccgaggagcgtgtttgcgcatgcggcagtagggaaatacataataatatttggaggtgaggtctggccggacccaaacggacatttgggtcctggaacattgaccaatgagggttacgcgttgaacaccgagactctggtgtgggagaagtttggaggaggagctgagccgggtgaactcggttggcctgcctacacgactgctaccgtctatggaaagcaaggcctcctcatgcatggagggaagcgtccaaccaacaaacgtaccgatgaaatgtacttctacgcagtccattccgcctaagcaatgctctctcactactctcaaaggttcgtttgtgtggtgagtattattactatttgtgttgtgtctcataatatgtaagataaaataaaggtctgtgaaacctatgaaaatcagccaactgtacgtggcttattatcaagttaaactatgtgtgtttctcgtttgcaaaactgtactggttggaataatatgtactactactacttgtgtgtttaataa

SEQ ID NO: 2283 - DNA, 1313 bp, Brassica napus
aagcaaatagcaaatacataaattcgaacattgcagctatggctcccacattgcaaggcgagtggatcaaggtgcagcagaaaggaggagagggacctggagcaagaagctcacacggcatagccgtggtcggagacaagctctactctttcggtggcgagcgtactccaaacatttccatcgacaaacacctttacgtctttgacttcaacactcacacatggtcaatcgccccggccaacggacaagcccctaacgtccaggctctgggcacccgcatggtggccgtgggaactatgctctatctattcggaggccgtgatgagaagaaacagttcgacgacttttactcgtacgatacggtgaaacaggagtggaagttcatcaccaagctcgatgaagagggaggacccgaggctcgtacttaccactcgatggcttcggatgaaaaccacgtgtatgttttcggtggggtgagcaaaggcgggaccaacaagacccccttcaggttcaggaccattgaggcgtataacattgctgatgggaagtgggctcagctacctgatcctggtgagcaattccctaggttcgagagaagaggaggagctggattcattgtggtggaaggaaagatttgggtggtttacgggtttgcaacttcgcctgatcctaatggaaaaaacgactatgagtctgatcttgtgcactactttgatcctgctactcaaaagtggaccgaagtggagactaaaggagagaaaccttctccgaggagcgtgtttgcgcatgcggcagtaggaaaatacataataatatttggaggtgaggtctggccggacccaaacggacatttgggtcccggaacattgaccaatgagggttacgcgttgaacaccgagactttggtgtgggagaagtttggaggaggagctgagccgggtgaactcggttggcctgcctacacgactgctaccgtctatggaaagcaaggcctcctcatgcatggagggaagcgtccaaccaacaaacgtaccgatgaaatgtacttctacgcagtccattccgcctaagcaatgctctctcactactctcaaaggttcgtttgtgtggtgagtattattactatttgtgttgtgtctcataatatgtaagataaaataaaggtctgtgaaacctatcaaaatcagccaactgtacgtggcttattatcaagttaaactatgtgtgtttctcgtttgcaaaactgtactggttggaataatatgtactactactactacttgtgtgtttaataaatgatatgaagttatcta

SEQ ID NO: 2284 - DNA, 1121 bp, Brassica oleracea
gacgcgtggggcaaaaacaacaaaaaaaaattgaacattgcagctatggctcccacattgcaaggcgagtggatcaaggtgcagcagaaaggaggagagggacctggagcaagaagctcacacggcatagccgtggtcggagacaagctctactctttcggtggcgagcgtacgccaaacatttccatcgacaaacacctttacgtctttgacttcaacactcacacttggtcaatcgccccggccaacggacaagcccctaacgtcaaggccctgggcacccgcatggtggccgtgggaactaagctctatctattcggaggccgcgatgagaagaaacagttcgacgacttttactcgtacgatacagtgacaaaggagtggaagttcctcaccaagctcgatgaagagggaggacctgaggctcgtacttaccactcgatggcttcggatgaaaaccacgtgtatgtattcggcggggtgagcaaaggcggggttatgaagaccccctttaggttcaggaccatcgaggcgtataacattgctgatgggaagtgggctcagctacctgatcctggtgagcagtaccctacgttcgagagaagaggaggagctggattcattgtggtgcaagggaagatttgggtggtttacgggtttgcaacttcacctgatcctaatggaaaaaacgattatgagtctgatcttgtgcactactttgatcctgctactcaaaagtggaccgaagtggagactaaaggagagaaaccttctccaagaagcgtgtttgcgcatgcggcagtaggaaaatacataataatatttggaggtgaggtcgggccggatccaaacggacattatggtcccggaacattgaccaatgagggttacgcgttgaacaccgagagtttggtgtgggagaagtttggaggaggagctgaaccgggtgaactcggttggcctgcctacacgactgctaccgtctatggaaagcaaggcctcctcatgcatggaggaaaacgtcccaccaacaaccgtaccgatgagatgtacttctacgcggtccattccgcctaaacaatgcgctctcactactctctaaggttcgtttgtgaagtttc

SEQ ID NO: 2285 - DNA, 1303 bp, Brassica napus
ccacgcgtccgaaaagattgaatatcgtagctatatggctccgactttgcaaggggagtggatcaaggtgcagcagagaggaggacaaggacctggaccaagaagctcacacggcatagctgtggttggagacaagctctattctttcggcggggagctgaccccaaacatttccatcgacaaagacctttacgtctttgactcaacactcacacttggtcaatcgctccagccaagggagacgttcctaacgtcaaggccttgggcacccgcatggtggctgttggaactaaactctatctcttcggaggccgcgatgagaataaacaatttgaggacttttattcatacgataccgtgaaaaaggagtggaagttcctgacgaagctcgatgaagagggaggacctgaggcccgcacttaccattcgatggcttccgatcaaaaccatgtgtatgtgttcggtggagtgagcaaaggtgggacgaacaaaacccctgtgcgtttcaggacgatcgaggcctataacattgctgctgggaaatgggttcagctaccagatcctggagtgcagtttgagaagttcgagaaaagaggtggagctggattcgctgtggtgcaaggaaagatttgggtgatttacgggtttgcgacttcgcctgatcctaatgggatgaacgactacgagtctgatcttgttcactactttaatcccgctactcaaaaatggaccgaagtggagaccaaaggacagaaaccttctgcgaggagcgtgtttgcgcatgcggtagtaggaaaatatatactaatatttggaggtgagacctggccggacccaagggcacatttgggtcccgggacgttgtccagtgagggttttgcgttgaacactgagacattggtgtgggagaagtttggaggaggaaatgaaccggggcaacttggttggcccgcctacacggctgccaccatctatggaaagataggcctcctcatgcatggaggaaagcgtcctaccaataaccgtaccgatgagatgtacttctacgcagtcaatcgcgcctaatcaatgctctcattactctcagtctcagggtttgtttgtttgtgtggtgagcattgctaataggtgtctcaaattatgtactgtctaataaaggttggtgagacatataccaaaaacaaccaactatgattggcttattataagtcaaattatgtgtgtttgtgattgcaaaactacttatcgcttgaataatatgtactgttcacgtgtgtgtttaataaaagatatgaagttatct

SEQ ID NO: 2286 - DNA, 1304 bp, Brassica napus
tttagtagtacgtcgggggacgacaaaacaaaataacaacaaaaaactgaatagtgcagctatggctccgagtgtgcaaggcgagtggatcaaggtcgagcagaaaggaggacagacaccaggaccgagaagctcacatggcatagccgtggtcggagacaagctctactctttcggtggcgagttaactcccaacatttccatcgacaaagacctttacgtctttgacttcaacactcacacttggtcaatcgctccgtccaagggagtagcccctgacgtcaaggccttgggcacccgcatggtgtccgtgggaactaagctctatctattcggaggccgcgacgagaataaaaagttcgatgacttttactcgtacgatacggtgacaaatgaatggacaaaactgaccattctggatcaagagggaggacccgaggctcgaacttaccactccatggcttcggatgaaaaccatgtgtatgtattcggtggagtgagcaaaggagggaccgacaagacaccctttaggttcaggaccatcgaggcctataacattgctgatgggaaatgggctcagcttcctgatcctggtgagcagttcccaaggttcgagagaagaggaggagctggattcgttgtggtgcaaggaaagatttgggtggtttacgggtttgcaacttctcctgatcctaatgggaaaaatgactatgagtccgaccaagtgcagttttatgacccggctactcagaaatggaccgaagtggaaactaaaggagacaaaccttctgcgaggagcgtgtttgcacatgcggttgtggggaaatatatactgatatttggaggagagacctggccggacccaaaggcacatttgggaccagggacgttgtctgatgaagggtttgcgttggacactgagacactggtgtgggagaggtttggaggaggagctgaaccgggtcaactcggttggcccggttacacgactgccaccgtgtatggaaagaaaggtctcctcatgcatgggggaaaacgtccgaccaacaaccgaaccgatgagctctacttctacgcagttaattccgcgtaactaatgctctcactctcgtggtgtgtttgtgtggttaaaggtttgtgagacctacgaaaacagccaatttatctacctgtggctgattatggtatcttattaaatcgaattatgtgtgtttgtggtttggaaattgctgtctttgggataatatatttcctagtgtgtaattctaataataattatatgatagtatgaaattatctataaa

SEQ ID NO: 2287 - DNA, 1278 bp, Brassica oleracea
acgcaaacaaatacacaaaaactgaatagtgcagctatggctccgagtgtgcaaggcgagtggatcaaggtcgagcagaaaggaggacagacaccaggaccgagaagctcacatggcatagccgtggtcggagacaagctctactcgtttggtggcgagttaactcccaacatttccatcgacaaagacctttacgtctttgacttcaacactcacacttggtcaatctctccgtccaagggagtagcccctgacgtcaaggccttgggcacccgcatggtgtccgtgggaactaagctctatctattcggaggccgcgacgagaataaaaagttcgatgacttttattcgtacgatacggtgacaaatgaatggacaaaactgaccattctggatcaagagggaggacccgaggctcgaacttaccactccatggcttcggatgaaaaccatgtgtatgtattcggtggagtgagcaaaggagggaccaacaagacaccctttaggttcaggaccatcgaggcctataacattgctgatgggaaatggtctcagcttcctgatcctggtgagcagttcccaaggttcgagagaagaggaggagctggattcgttgtggtgcaaggaaagatttgggtggtttacgggtttgcaacttctcctgatcctaatggaaaaaatgactatgagtccgaccaagtgcagttttatgacccggctactcaaaaatggaccgaagtggagactaaaggagacaaaccttctgcgaggagcgtgtttggacatgcggttgtggggaaatatatactgatatttggaggagagacctggccggacccaaaggcacatttgggaccagggacgttgtctgatgaagggtttgctttggacactgagacactggtgtgggagaggtttggaggaggagctgaaccgggtcaactcggttggcccggttacacgactgccaccgtgtatggaaagaaaggtctccttatgcatgggggaaaacgtccgaccaacaaccgaaccgatgagctctacttttacgcagttaattccgcgtaactaatgctctcactctcgtggtgtgtttgtgtggttaaagagtttgtgagacctacgaaaacagccaatttatttacctgtggctgattatggtatcttattaaatcgaattatgtgtgtttgtggtttggaaattgctgtctttgggataatatatttcctagtgtgtaattctaataataattatatgatagtatgaaattatcatat

SEQ ID NO: 2288 - DNA, 1224 bp, Brassica napus
aaacaaaaatggatattgcagctgtgactccgactttgcaaggcgagtggatcaaggtggagcagaaaggaggagagggaccaggaacaagaagctcacatggcatagccgtggtcggagacaagctctactctttcggcggcgagttaacgccaaatatttccatcgacaaggacctgtacgtgtttgacttcaaaacccacacttggtcgatcgaaacgggcagcggagacctccctaacgtcaaagccttaggcaccaggatggtgcccgtgggaactaagctctatatattcggaggccgcgatgagcataaacagttcgacgacttttactcgtacgacacggtgaaaaaggagtggaagttcctgacgaagctggatgaagtgggtggacccgaggctcgtactttccattccatggcttgggatgataacgacgtgtatgtattcggtggggtgagcaaaggcggggcgaataaaactcccgtacggtttagaaccatcgaggcgtataatatagctgaagggaaatggactcagctaccagatcctggggagcagcttgctaggttcgagaaaagaggaggagctggattccttgttgtgcaaggaaagatttgggttgtttatgggtttgcgacttctcctgatcctaatgggaaaaatgactacgagtctgatcacgtgcagttttatgatcccgttactcaaaaatggaccgaagtggagactagaggagagaaaccttccgccaggagtgtgtttgcgcatgcagttgtgggaaaatatatacttatatttggaggtgagacctggcccgacccaagggcacatttgggtccagggacgttgtccgatgagggttacgcgttggacacggagacactggtgtgggagaggtttggaggaggagatgaaccgagtacacgaggttggtcggcgtacacaactgccaccgtatatggaaagaaaggtctcatcatgcatggaggaaaacttccgacaaacaaccgaaccgatgagctctacttctacgcagtcaattccgcgtaattacaatactttcactttcaagctctgtgttgtgtaataaatatcatatatgtaccaataaaaggtttgtgaaattaaatcagattatctatgtactgtgtgggttggcggcttggaaactgccgtcggtggaatcaataactgtacttgtgtccaataaatggtatga

SEQ ID NO: 2289 - DNA, 1513 bp, Solanum phureja
aaataatataatactagtgtttagttaaagagctgaagagctcacaaaattgaaatggatctctgaaaagccatcaatcttgtcctttgcacaactccaaaggatcacctacctattggccttgccaacttctctattggaaaacccccaatatataaacccttctccatctttctcctttcagagtttttctccctacacacaaattgatagaatcatttgatctgatcatggctcattcagctatctctcaggtgtcagttgctgttcctctccaaacggattcctctttccgaagatctacgtttaaggctacaagcttaacattcagtgataaatcatgcatctctatgccatctatcgatctaaaagcgactcgatccagaagccaatacattgtttgcatgtcagtgcaacatgctagcaaagccaaggtttcagtttcacctttatcacttgaagatgcaaaagaaccacccttgaatatctacaagcccaaggaaccatacacagcgacaattgtctctgttgaaaggattgtaggcccaaaagctcctggggagacttgtcatattgtcattgatcatgatggcaaccttccttactgggaaggacaaagttatggtgtcgttcctcctggtgaaaaccctaagaaaccagggagtccccacaatgttcgtctatattcaattgcatccaccagatatggggactcttttgatgggaaaacggccagcttgtgtgtcagacgagctgtctactatgatcctgagacaggaaaagaagacccatccaaaaatggtgtttgcagtaacttcctatgcaatgcgaaatctggtgacaaagtgaagatcacaggtccttctggtaagataatgcttctacctgaaaataatcctaatgccacacacatcatgattggaactggaactggtgtggctcccttcagaggctaccttcgtcgtatgttcatggagtcagttccaatgaagtttaatggccttgcttggcttttccttggggttgcaaacactgacagccttctatacgacgatgagttcaccaagtatctcaatgactacccaggcaatttcagatatgaccgtgctcttagccgagaacaaaagaacaataaaggggggaagatgtatgttcaggataaaattgaggaatacagcgatgagatcttcaaacttctggatgaaggggcccacatctatttctgcgggttgaagggtatgatgcctggcatccaggataccctgaagagagttgctgaagagagaggtgagagctgggagcagaagctttcacaactcaaaaagaacaagcaatggcatgttgaagtctactaaataggaaatgttaattgttgcatttgtttgtgattgttgattgttgtcaactgaacttagcaagcagtttagatgacacattgtattgctagttgacatacaaattgttcatgttgcatgggaaatgaaataataactgttgctgcttgaggcagttt

SEQ ID NO: 2290 - DNA, 1509 bp, Solanum tuberosum
tgaaatggatctctgaaaagccatcaatcttgtcctttgcacaactccaaaggatcacctacctattggccttgccaacttctccattggaaaacccccaatatataaacccttctccatctttctcctttcagagtttttctccctacacacaaattgatagaatcatttgatctgatcatggctcattcagctatctctcaggtgtcagttgctgttcctctccaaacggattcctctttccgaagatctacgtttaaggctacaagcttaacattcagtgataaatcatgcatctctatgccatctatcgatctaaaagcgactcgatccagaagccaatacattgtttgcatgtcagtgcaacatgctagcaaagccaaggtttcagtttcacctttatcacttgaagatgcaaaagaaccacccttgaatatctacaagcccaaggaaccatacacagcgacaattgtctctgttgaaagaattgtaggcccaaaagctcccggggagacttgtcatattgtcattgatcatgatggcaaccttccttactgggaaggacaaagttatggtgtcgttcctcctggtgaaaaccctaagaaaccagggagtccccacaatgttcgtctatattcaattgcatccaccagatatggggactcttttgatgggaaaacagccagcttgtgtgtcagacgagctgtctactatgatcctgagacaggaaaagaagacccatccaaaaatggtgtttgcagtaacttcctatgcaatgcgaagcctggtgacaaagtgaagatcacaggtccttctggtaagataatgcttctacctgaaaataatcctaatgccacacacatcatgattggaactggaactggtgtggctcccttcagaggctaccttcgtcgtatgttcatggaatcggttccaatcaagtttaatggtcttgcttggcttttccttggagttgcaaacactgatagccttctgtacgacgatgaattcaccaagtatctcagtgactatccaggcaatttcagatatgaccgtgctcttagtcgagaacaaaagaacaataaagggggaaagatgtatgttcaggataaaattgaggaatacagcgatgagatcttcaaactgttggatgaaggagctcacatctatttctgtgggttgaagggtatgatgcccggaatccaggataccttgaaaagggttgctgaggagagaggtgagagctgggagcaaaagctttcacaactcaaaaagaacaagcaatggcatgttgaagtctactaattaggaaatgttaattgctgcatttgtttgtgattgttgattgttgtcaactgaacttagcaagcagttgttatacaatgtgccatcttaactgcagcttaagatggcacattgtattcagttaagatgcagtgcttgattgttgtcaactgactgctgcagttaagatggtacattgtattactagttgatatacaaattgtt

SEQ ID NO: 2291 - DNA, 1400 bp, Solanum phureja
gttaatcttcctacccacaaagttgtagaatcagacccacaaggagagaatcatttgatccgatcatggctcattcagctatctctcaggtgtcagttgcggttcctctccaaacggattcctctttccgaagatctacgtttaaggctacaagcttaacattcagtgataaattatgcatctctatgccatctatcgatctaaaagcggcacgatccagaagccaatacatagtttgcatgtcagtgcaacaagctagcaaagccaaggtttcagtttcacctttatcacttgaagatgcaaaagaaccacccttgaatatctacaagcccaaggaaccatacacagcgacaattgtctctgttgaaaggattgtaggcccaaaagctcctggggagacttgtcatattgtcattgatcatgatggcaaccttccttactgggaaggacaaagttatggtgtcgttcctcctggtgaaaaccccaagaaaccagggagtccccacaatgttcgtctatattcaattgcatccaccagatatggggactcttttgatgggaaaacggccagcttgtgtgtcagacgagctgtctactatgatcctgagacaggaaaagaagacccatccaaaaatggtgtttgcagcaatttcctatgcaatgcgaagcctggtgacaaagtgaagatcacaggtccttctggtaagataatgcttctacctgaagataatctaaatgccacacacatcatgattggaactggaactggtgtggctcccttcagaggctaccttcgtcgtatgttcatggagtccgttccaatcaagtttaatggtcttgcttggcttttccttggagttgcaaacactgatagtcttctgtacgacgatgaattcaccaagtatctcagtgactatccaggcaatttcagatatgaccgtgctcttagtcgagaacaaaagaacaataaagggggaaagatgtatgttcaggataaaattgaggaatacagcgatgagatcttcaaactgttggatgaaggagctcacatctatttctgtgggttgaagggtatgatgcccggaatccaggataccttgaagagggttgctgaggagagaggtgagagctgggagcagaagctttcacaactcaaaaagaacaagcaatggcatgttgaagtctactaattaggaaatgttaattgctgcatttgtttgtgattgttgattgttgtcaactgaacttagcaagcagttgttatacaatgtgccatcttaactgcagcttaagatggcacattatattcagttaagatgccaatcagtgcttgattgttgtcaactgaactgctgcagttaagatggcacattgtattactagttgatatacaaattgtt

SEQ ID NO: 2292 - DNA, 1450 bp, Nicotiana tabacum
ctagaaccctctatttatataaacccttctccatctttctcatttcagagtttttctccatagccacaaacatagaatcacacccacaaggagagaatcatttgatcccatcatggctcattcagctctctctcaggtgtcagttgctgttcctctgcaaacggattcatcttttagaagatctacttttaaggctacaagcgtaacttttagtgatagatcatcatggatctctatgccgcctatcgatctaaaagcaccacgatcgagaaaccaacacattgtttgcatgtcggtgcaacaagctagcaaagccaaagtttcagtttcacctttatcacttgaagatgcaaaagaaccaccattgaatatttacaagcccaaggaaccatacacagcgacaattgtctcagttgagaggcttgtaggcccaaaagctcctggggagacttgtcatattgttattgatcatgatggcaaccttccttactgggaaggacaaagttatggtgtcattcctcctggtgaaaatcctaagaaaccaggcagtccccacaatgttcgtctatattcaattgcatccaccagatatggggactcttttgatgggaagacggccagcttgtgtgtcagacgagctgtctactatgatcctgagacaggaaaggaagacccttccaaaaatggtgtttgcagcaacttcctgtgcgactcaaagcctggtgacaaagtgaagatcacaggtccttctggtaagataatgcttctaccagaagagaatccaaatgccacacacatcatgattggaactggaactggtgtggctcccttccgaggctaccttcgccgtatgttcatggaatcggttccaactaagtttaatggccttgcttggcttttccttggggttgcaaacactgacagccttctatatgacgatgagttcaccaagtatctcaatgactacccaggcaatttcagatatgaccgtgctcttagccgtgaacaaaagaacaataaaggggggaagatgtatgttcaggataaaatagaggaatacagcgatgagatcttcaaactgctggatgaaggggcccacatctatttctgtgggttgaaggggatgatgcccggaatccaagatacgctgaagagggttgctgagaggcgaggtgagagctgggaacagaagctttcacaactcaaaaagaacaagcaatggcatgttgaagtctactgatcaagaaacgtcaatccttgcatttgtttatgattgttgattgttgtcaagtgaactttggatgacacattgttgtactgctagtagacataaaaagtattcaatgctgcaaggaaaatgaaataataactgttggtaccttggggcagtcagtcttctgtatttctttgcaaatgtctctctgataggcatttcacagctgctctattg

SEQ ID NO: 2293 - DNA, 1539 bp, Nicotiana benthamiana
  misc_feature (917)..(917): n is a, c, g, or t
gcaccaacaaaggagagaatcatttgatcccatcatggctcattcagctctctctcaggtgtcagttgctgttcctctgcagacggattcatcttttagaagatctacttttaaggctacaagcataacatttagtgatagatcatcatggatctctatgccgcctatcgatctaaaagcattacgatcgagaaaccagtacattgtttgcatgtcggtgcaacaagctagcaaagccaaagtttcagtttcacctttatcacttgaagatgcaaaagaaccaccattgaatatttacaagcccaaggaaccatatacagcgacaattgtctcagttgagaggcttgtaggcccaaaagctcctggggagacttgtcatattgttattgatcatgatggcaaccttccttactgggaaggacaaagttatggtgtcattcctcctggtgaaaatcctaagaaaccaggcagtccccacaatgttcgtctatattcaattgcatccaccagatatggggactcttttgatgggaaaacggccagcttgtgtatcaggcgagctgtctactatgatcctgagacaggaaaagaagacccttccaaaaatggtgtttgcagcaactttctgtgcgactcaaagcctggtgacaaagtgaagatcacaggtccttctggtaagataatgcttctaccagaagataatccaaatgccacacacatcatgataggaactggaactggtgtggctcccttccgaggctaccttcgtcgtatgttcatggaatcggttccaactaagtttaatggccttgcttggcttttccttggggttgcaaacactgacagccttctatatgacgatgagttcaccaagtatctcaatgactacccaggcaatttcagatatgaccgtgctnttagccgtgaacaaaagaacaataaaggggggaagatgtatgtccaggataaaatcgaggaatacagtgatgagattttcaaactactggatgaaggggcccacatctatttttgtgggttgaaggggatgatgcctggaatccaagataccctgaagagggttgctgaggggagaggtgagagctgggagcagaagctttcacaactcaaaaagaagaagcaatggcatgttgaagtttactgatcaagaaaaacattaatcgttgcatttgtttatgattattgattgttgtcaagtgaacttagcaagcagtttagatgacagattgtactgctagtagacataaaaaatattcggtgctgcaagggaaaggaaataataactgttgataccttcagggagttgatactttgcacttttgtattttttttgcaaatgtttttgataggcatttcacagctgctttattgcacttaaaattgctagagtgcttattgttgcctgtgtttttgcaaaggcttggttgttaatatattgttagctgaaatgaagccaggagagggactaagctgtaccacatgtttcagcttattttatcctcaggatggaaaaagttcttg

SEQ ID NO: 2294 - DNA, 1504 bp, Solanum melongena
aaatactccaacatgaacagcttgaagctctcatgattgaaatgaaaagccattgatctgtcctttgccaaactccaaaggttcactataatccctggcagcagccccaattgacctgcccatttcttcttcccagaaaaacccaaatatatataaaccctcctccatctttctcctttcagagttttatctcgcacccacaaggagaggagacaatcatttgatccgatcatggctcattcagctgtatctcaggtgtcagttgcggttcctctccaaacggattcctctttcccaagatctatgtttaagactacgagcttaacattcagtgataaatcatgcttctctatgccatctatcaatctaaaagcggcacgatccagaagccaatacattgtttgcatgtcagtgcaacaagctaccaaaggcaaggtttcagtttcacctttatcacttgaagatgcaaaagaaccacccttgaatatctacaagcccaaggagccatacacagcgacaattgtctctgttgaaagaattgtaggcccaaaagctcccggggagacttgtcatattgtcattaatcatgatggcaaccttccttactgggaaggacaaagttatggcgtcattcctcctggtgaaaaccctaagaaaccagggagtccccacaatgttcgtctatattcaattgcatccaccagatatggggactcttttgatgggaaaacggcgagcttgtgtgtcagacgcgctgtctactatgatcctgagacaggaaaagaagacccatccaaaaatggtgtttgcagcaactacctatgcaactcaaagcctggtgacaaagtgaagatcacaggtccttctggtaagataatgcttctacctgaagataatccaaatgccacacacatcatgattggaactggaactggtgtggctcccttcagaggctgccttcgtcgtatgttcatggagtcagttccagtcaagtttaatggccttgcttggcttttccttggggttgccaacgctgacagtcttctatacgatgatgagttcaccaagtatctcagtgactacccagacaatttcagatatgaccgtgctttcagccgagaacaaaaaaacaaaaaaggtgggaagatgtatgttcaggataaaattgaggaatacagcgatgagatcttcaaactgctggatgaaggggcacacatctatttctgtgggttgaagggtatgatgcccggaatccaagataccctgaagagggttgctgaggagagaggtgagagctgggagcagaagctttcacaactcaaaaagaacaagcaatggcatgttgaagtttactaattaggaaaatgttaattgctgcatttgtttgtgattgttgattgttgtcaactgaacttagcaagcagtttagatgacacattgtattgttagttgacattgcaagagaaatgaaataataactgttggtgcgtgatgcagtttaccc

SEQ ID NO: 2295 - DNA, 1588 bp, Capsicum annuum
gcacgcgaaatcaaaatgtgaagagccaccaactgtgccttttgctaaaacccccaaattgattccattaaacccacttataaaaacctttgtttattttcctttgctcttttgagagttgcccaattttaattccaaagcttcattggatctgatcatggctcattcagctatttctcaggtctcagttgctgctcctcttcaaacagagtcctcttttcggagatctaccattaaggctacaaatgtaacatttactgataaaacatggatctctatgcttcatgttaatctacaagcctcaagatccagaagtcaacaaattgtttgtatgtcagtgaaaccggcaagtaaagacaaagttttagtatcgcctttatcacttgaagatgcaaaagaaccgccattgaatatctacaagcccagggaaccatacacggcgaagattgtctctattgagaggattgtaggcccaaaagctcctggggagacttgtcacattgtcattgatcatggcggcaatcttccttactgggaaggacaaagttatggtgtcattcctcctggggagaatccaaagaaaccaggtagtccccacaatgttcgtctatattcaattgcatcaactaggtacggggactcctttgatgggaaaactgccagcttgtgtgtcagacgtgctgtctactacgatcctgaaacaggaaaagaagacccgtccaaaaacggtgtttgcagcaatttcctatgtgattccaagccaggtgacaaggtacagattacaggtccttctggtaagataatgcttctgcccgaagataatcctaatgccacccacatcatgattggaactggaactggtgtggctccctttagaggataccttcgtcgtatgttcatggaatctgttcccactttcaagttcaatggcctcgcttggctcttccttggggtggcaaatagggatagcctcctttatgacgaagagttcaccagctatctccatgaatacccagataatttcaggtatgatcgcgccctcagccgagagcataagaacaagaaagggggaaagatgtatgttcaggataagattgaggaatacagcgacgagatcttcaaacttctggatgaaggggcgcacatatatttctgtgggttgaagggaatgatgcccggaattcaggataccttgaagagggtcgcggaagaaagaggtgagagctgggaacagaagctctcaaaactcaaaaagaacaagcaatggcatgttgaagtctattgattaggaaatgcagattcttggcgcttggtgtagtgcatttatttgtcattgttgccaacagaaactttatttgcactttaaatgctgttgtactgccagtcttcaacatagaagttcgctgctcagtggcactcagagaataaatgtgggtaattagaatcttgcactctttatctttatttttcaaatgcctataatagggcattctgagataaaaactgtcctctttaatgatggggaatatgcttattgtttatgttcatttcagcaaatactattagttgttccttgaatctcgattat

SEQ ID NO: 2296 - DNA, 1570 bp, Cucumis sativus
atctaattccttccctttgctgacttacttcacttctgggtatgatccaccatttcctataagaagcactcatcttcgacaactttaaaatcgctttcttcctcataaacagcctctgcaatttggaaatggcccactccaccttttctcaggttgctgttgctgttccagttggaagtgatttgtctgttaagagatcagtgttcaagacaagaagcctaaacttccatgataagtcatggtcgtcacctgtgatagccctgaactcgaacctgaggggcactcgggcaagaggttggcaaacagtatgcatgtcagtgcagcaagcaagtgcaccaaaggtatctgttgcacctctagaccttgaggatgctaaagagcctccattgaatttatacaaaccaaaagaaccgtatactgcaactattgtttctgttgaaagacttgttggtccaaaagcaccgggagagacttgtcatattgttatcgatcatggtggcaatgtcccctattgggaaggtcagagctatggtgttattcctccaggtgaaaacccaaagaaacctgggaatccacacaatgttcgtctctactccattgcatcaactaggtacggagattcttttgatggcaacactgctagtttatgtgttcgccgggccgtttattatgaccctgaaactggaaaggaggatccttcaaagaacggaatatgcagcaactatttatgcaactcaaagcctggagataaagttctgatcacaggtccatctggcaagataatgcttcttcctgaagacaacccaaatgccacccacataatgattgctactggcaccggtgtcgctccattcagaggttatctccgtcgaatgttcatggagtctgtaccgacattcaaatttggtggccttgcttggctttttctaggagtggcaaacactgatagtcttttatacgacgatgaattcagcaagtatcttaaggactatccagataacttccgttacgatcgagctcttagcagggagcaaaagaacaggaatggaggaaaaatgtatgtccaggacaagatcgaggagtacagcgatgagatctttaaactcttggatggcggggctcacatatacttctgcggattgaaagggatgatgccaggaattcaggacacactgaaaaaggttgcagagcaaaggggtgagaaatgggaagagaaactttcacagcttaaaaagaacaaacagtggcatgttgaagtttactgaagtgtagttgcatagaaacgtgtgcattgatgtctgtttagaagatgtagcagcacatgatctcttgttctgtgttactccttgcattgctcatctttcagtttcatagcttaagattacgaataaggtggcctccgttattgatactcagatttgtgtttaattgaactacaggaacttgcttagatttttttttcccctcttgcgtaaggaacccatttagcaccttaatctgtgagtattgatgcttggaaatggaataaacttcattttaaaatccaactgcaaagatgatcaagtttctc

SEQ ID NO: 2297 - DNA, 1438 bp, Phaseolus coccineus
cctctttagaacttctctctttttcaaacctacccttttccaatcacatcttcttctctgatagccactgcagattctttgttcttgatctcaggatgtttcatttgactttgtctcaggtggctgtaactgttcctgttagcagtgatttgtctctcagaagatctgcgttcaaggcccctaacttaaacttttgggataagtcatggtcaccagtattaactttggacttgaaggctaacagctctcgtttaagaagtcagaatgtggtatgcatgtcagtgcaacaagcaagtgtacccaaagtttctgtctcacctttagatctggaagatgctaaagaaactccattgaacttgtacaagcctaaagaaccctatacagcaacaattgtttcggttgacaggcttgtgggaccgaaagctcctggggaaacttgtcatattgtgattgatcatggtggaaatgtcccctactgggaaggacagagttatggtgttattcctccaggcgaaaatccgaagaaacccggggcaccccataatgttcgactatattcgattgcttccacgaggtatggagatttttttgatggtaaaacagccagcttgtgtgtgcgtcgtgctgtttattatgatcctgagacaggaaaggaagatccgtccaagaatggcatttgtagcaattttctgtgtaactcaaagcctggagacaaaattaaaatcacaggcccttcagggaagataatgcttttgcctgaggaagaccctaatgctacccatataatgattgccactggcactggtgttgctccattcagaggctatctacgtcgaatgttcatggaatctgtccctacatacaagttcggtggactagcatggcttttccttggcgttgccaactctgacagtcttctctatgatgacgaattcagtaaatacctcaaggattatccaaacaatttccgctttgatcgagcccttagcagagaacaaaagaacaagaaaggggggaaaatgtatgttcaggataagattgaggagtatagtgatgaaatcttcaaactcctggataacggggcccacatctatttctgtggtctaagagggatgatgcctgggatccaagacacactgaagagggttgctgagcaaagaggagaaagttgggaagagaagctttctcaacttaagaagaacaaacaatggcatgttgaagtctactgagattctctagtgcagattgcagagtagtagtcccatttgtctgaaaaaatacaaaacattttcatttggtgcttttaataatattcatccagcagcttcagtagctgtagctattctgtattagtaaattgcaatgatacattgtgttcttgatctatacagaattgaacaaccaagcaagtggcaatctggtagagtccactttgttg

SEQ ID NO: 2298 - DNA, 1691 bp, Vigna unguiculata
  misc_feature (1045)..(1045): n is a, c, g, or t
  misc_feature (1243)..(1243): n is a, c, g, or t
aaaggatcatcgaaaaacccaaatcaagaccagtttgaacagtctttggtgtgctaccttctttatattacacccttctaacaacttctctgtttttcaaatctaccctttttccaatcacatcttctgctctgatagccactacagcttctttcttctcgatctcaggatgtttcatttgactttgtctcaggcggctgtaactgttcctgttggcagcgatttgtctctcagaagatctgcgttcaaggcccctaacttaaactttcgggataagtcatgggcaccagtattaactttggacttgaaggctaacagctcttgtttaagaagtagaaatgtggtatgcatgtcagtgcaacaagcaagtgtaccaaaagtttctgtctcacctttagaactggaagatgctgaagaacctccattgaatttgtacaagcctaaagaaccctatacagcaacaattgtgtctgttgagagacttgtgggaccgaaagctcctggggaaacttgtcatattgtgattgatcatggtggaaatgttccctactgggaaggacagagttatggtgttattcctccaggtgaaaatccaaagaaacccggggctccccacaatgtacgactatattcgattgcttccacgaggtatggagactcttttgatggtaaaacagccagcttgtgtgtgcgccgtgctgtttactatgatcctgagacaggaaaggaagatccgtccaagaatggcgtttgtagcaattttctgtgtgactcaaaacctggagacaaaattaagatcacaggcccttcagggaagataatgcttttgcctgaggatgaccctaatgctacccatataatgattgccaccggcactggtgttgctccatacagaggctatctacgtcgaatgttcatggaatctgtccctaactacaagttcggtggactggcatggcttttccttggcgttgccaactctgacagtcttctctatgatgaggaattcagtaaatacctcaaggattacccaaataatttccgntatgatcgagcccttagcagagaacaaaagaacaagaatgggggaaaaatgtatgttcaggataagattgaggagtatagtgatgaaatcttcaaactcctggataacggggcccacatatatttctgtggtctgaaaggtatgatgcctgggatccaagacacactgaagagggttgctgagcaaagaggagaaagntgggaagagaagctttctcagcttaagaagaacaaacagtggcatgttgaagtctactgagaagattctttagtgcagattgcagagtagtagtcccctttgtctgaaacaagaaaaatgcaaaacattttcatttggtgcttttaataaaaataatattcatccagcagcttgctttagtagctgtagctgttctgtatcagtaaattgcaatgatacattgtgttcttttgatcgatacagaattgaaaaacccagcaagtactatatggtagagtccttttgttaagggtagcagaatgttttcttttgccaaattctgaattatgttaagaaggattgtcaatcctataaaaggataagcctaacctagaatcatgaatgaagaaacatgtgagcccctttcagttattgtcttatttaattgtgacatttctttcctatttca

SEQ ID NO: 2299 - DNA, 1654 bp, Cucumis melo
atctaattccttcccttgctgacttacttcacttctgggtatgatccaccatttcctataagaagcattcatcttcgacaactttaaaatcgcttccttcctcatacacggcctctgcaattcggaaatggcccactctaccttttctcaggttgctgttgctgttccagttggaagcgatttgtctgttaagagatcagtgttcaagacaagtagcctaaacttccatgataagccatggtcacctgtcatagccctgaacttgagcctgaggggcactcgggcaagaggttggcaaaggcaaacagtatgcatgtcagtgcagcaagcaagtgcaccaaaggtatctgttgctcctttagacctcgaggatgctaaagagcctccattgaatttgtacaaaccaaaagaaccttataccgcaactattgtttcggttgaaagacttgttggtcccaaagcaccgggagagacttgccatattgttatcgatcatggtggcaatgtcccctattgggaaggtcagagctatggtgttattcctccaggtgaaaacccaaagaaaccggggagtccacacaatgttcggctctactcaattgcatcaactaggtatggagattcttttgatggcaagactgctagtttatgtgttcgccgggccgtttattatgaccctgaaactggaaaggaggatccttcaaagaacggaatatgcagcaattatttatgcaactcaaagcctggagataaagttctgatcacaggtccatcgggcaagataatgcttcttcccgaagacaacccaaatgccacccacataatgattgctaccggcactggcgtcgctccatttagaggttatctccgtcgaatgttcatggagtctgtaccgacattcaaatttggtggccttgcttggctttttctaggagtggcaaacactgatagtcttttatatgacgatgaattcagcaagtatctcaaggactatccagataacttccgctacgatcgagctcttagcagggagcaaaagaacaagagtggaggaaaaatgtatgtccaggacaagatcgaagagtacagtgatgagatctttaaactcttggatggcggagctcacatatacttctgcggattgaaagggatgatgcctggaattcaggacacactgaaaaaggttgcagagcaaaggggtgagaaatgggaagagaaactttcacagcttaaaaagaacaaacagtggcatgttgaagtttactgaagtgttgttgcatagaaacgtctacgttgatgtctgcttaaaagatgtagcagcacatgatctcttgttctgtgttactctttgcattgctcatctttcaacttcataggttaagatgacgaataaggtggccacagttattgatactcagatttgtctttaattgaactacaggaacttgctgagatttttttttctcttgcgtaaggaacctattcagcaccttaatctgtgagtattgttgcttggaaatggaataaacttcattttagaatccaactgcaaagattatcaagtttcttgtgtaggagttttgataatgccttcctctattataatctatcttttatcgttgtttattctagatatgtaacaattttttttttt

SEQ ID NO: 2300 - DNA, 1690 bp, Eucalyptus grandis
agagactcagcaacagagattggagagccaattgagaccggcggtgttcttgaggagccaaaatccaaaaccccaacttgtctcttgccgctctccaagggatcactgtccggtccctacttaaacaagatcgcatgttctttgtcagctcgtagtttcttgcataccccaccgtagtcgattccgccgcgctcgatccacccaatggcgcactcggctgtgtctcaggtttctgttgctgttcctgttggtagcgattcatccattagaagatcggtgtttaaggcacatactctcagtttctgtggtacattacgggcacctgtattgacattggacttgagtaccaagaatgcaagatccaagaaagggtatacaatatgcatgtcagtgcagcaagcaaatgcaccaaaagttgctgtctcaccattgcaacttgaggatgccaaagagcccccattaaatacattcaagccaaaggagccttatacagcaaccattgtgtctgttgagaggcttgtaggcccaaaagcacctggtgaggtttgtcatgttgttattgatcacggcggcaacgtcccctattgggaaggacagagctatggtgtaattcctcctggtgaaaatccaaagaaaccagggaaccctcacaacgttcgtctttactcgattgcatctaccaggtatggagattctttcgatggtagaacggccagcttgtgtgtccgccgagctctctattatgatcctgagacaggaaaggaggatccttctaaaagtggagtgtgcagcaacttcctttgcaatgcaaagcctggagataaagttaaaatcacaggcccttctgggaagatcatgcttttgcctgaagacaacccaaacgccactcacataatgatcgcgaccggtactggcattgccccattccgaggctaccttcggcgcatgttcatggaatctgtccccacgtacaagtttgggggccttgcctggctcttcctcggtgttgccaactcagacagcctgctctatgacgacgagttctccaagtacctccgagattatccagacaacttccggtatgacacagcactcagcagggagcagaataacaagaaggggggcaagatgtacgtccaggacaagatcgaggagtacagtgatgagatcttcaagctgctggacgaaggggctcatatttacttctgtgggctgaaaggaatgatgccgggtatccaggacaccctgaagagagttgcggtggagaggggcgagagctgggaagagaagctgtcgcagcttaagaagaacaagcagtggcatgtcgaagtctactagagctggagtctctccgccctcgcatgacggattaattcagctgcgttggttctgttgattactggttagtggtgtcatctaccatctgttacccgattgattaggatttgaccaagaagaccgagtatttagagacagatttgtatcatcgaataataaacccaaatcatcattgttattttcattatggccaaaagttaaaaaggccttatttgccgtctggtaggttaattctctcttcttcttttttccaaagtttctaaagttcatgtctacatgatggtgctgtgattttttattttttatttttggtgtgaactaggaggaagaaaatgatggttgagttatattt

SEQ ID NO: 2301 - DNA, 1571 bp, Momordica charantia
acacaccatcaagcgaatttgatctacacctccctttgctgacttccttctacttctgggcatgatccagcagctcctataagaacctcctcctttcgataatcttaccatcgctttcttcctgatactcagcctccgcgattcggaaatggcccactccaccttttctcaggtttctgttgttgttccagttggaagtgatctgtctgtcaagagatcagtgtttaaggcaaatagcctaaactttcatgataagtcatggtcacctgtcttagctctggacttgaatcgaaggagcactagggtgagaggttggcaaacagtatgcatgtcagtgcaacaagcaagtgtaccaaaggtatctgttgcacctttacaacttgaagatgtcaaagagcctccattgaatttatacaaaccaaaagaaccttacaccgcaactattgtttcggttgaaagactggttggtcctaaagcaccaggagagacttgtcatattgtaattgatcatggcggcaatgttccctattgggaaggacagagctacggcgtcattcctccaggtgaaaaccctaagaaaccagggaatccacacaatgttcgcctttactcgattgcatcaactaggtatggcgactcttttgatggcaagactgctagtttatgtgttcgtcgtgccgtttattatgacccggaaactggaaaggaggatccttcaaagaacggagtatgcagcaatttcttgtgcgactcaaagcctggagataaaattcagatcacaggcccatctggcaagataatgcttcttcctgaagatgacccaaatgccacccacataatgattgctactggcactggcgttgctccatttagaggttatctccgtcgaatgtttatggagtctgtaccaacattcaaatttggtggccttgcgtggttgtttctcggagtggcgaacaatgatagtctattatatgatgatgaattcagcaagtatctcaaggactacccagataacttccggtatgatcgagctcttagtagggagcaaaagaacaagaccggaggcaaaatgtatgtccaggacaagattgaggagtacagtgacgaaatctttaagctcttggatggcggagcccacatatacttttgtggactgaaggggatgatgcctggaattcaggaaactctgaaaagggttgcagagcaaagaggtgagaaatgggaagagaagctttcacaacttaaaaagaacaaacagtggcacgtagaagtttactgaagttgcatagatgtagcaacacatctcttgttctgtgttactctcggcattgctcatctttcaatttcataggttaagacgaggaataaggtggctaccgctactgctaccgccatcgtattcagctcgtctctattgaactacaggaacgctgatatttctttcttgattacatagactaaggaacctatgcagaaccttaatctgtgatagtgtttgaatatgcttggaattggtatagacttcaaattttagaattcaactgtcagcaagccttctgagttcaata

SEQ ID NO: 2302 - DNA, 1583 bp, Cucumis melo
  misc_feature (13)..(13): n is a, c, g, or t
  misc_feature (677)..(677): n is a, c, g, or t
  misc_feature (1268)..(1268): n is a, c, g, or t
  misc_feature (1374)..(1374): n is a, c, g, or t
atctaattccttnccttgctgacttacttcacttctgggtatgatccaccatttcctataagaagcattcatcttcgacaactttaaaatcgcttccttcctcatacacggcctctgcaattcggaaatggcccactctaccttttctcaggttgctgttgctgttccagttggaagcgatttgtctgttaagagatcagtgttcaagacaagtagcctaaacttccatgataagccatggtcacctgtcatagccctgaacttgagcctgaggggcactcgggcaagaggttggcaaaggcaaacagtatgcatgtcagtgcagcaagcaagtgcaccaaaggtatctgttgctcctttagacctcgaggatgctaaagagcctccattgaatttgtacaaaccaaaagaaccttataccgcaactattgtttcggttgaaagacttgttggtcccaaagcaccgggagagacttgccatattgttatcgatcatggtggcaatgtcccctattgggaaggtcagagctatggtgttattcctccaggtgaaaacccaaagaaaccggggagtccacacaatgttcggctctactcaattgcatcaactaggtatggagattcttttgatggcaagactgctagtttatgtgttcgccgggccgtttattatgacnctgaaactggaaaggaggatccttcaaagaacggaatatgcagcaattatttatgcaactcaaagcctggagataaagttctgatcacaggtccatcgggcaagataatgcttcttcccgaagacaacccaaatgccacccacataatgattgctaccggcactggcgtcgctccatttagaggttatctccgtcgaatgttcatggagtctgtaccgacattcaaatttggtggccttgcttggctttttctaggagtggcaaacactgacagtcttttatatgacgatgaattcagcaagtatctcaaggactatccagataacttccgctacgatcgagctcttagcagggagcaaaagaacaagagtggaggaaaaatgtatgtccaggacaagatcgaagagtacagtgatgagatctttaaactcttggatggcggagctcacatatacttctgcggattgaaagggatgatgcctggaattcaggacacactgaaaaaggttgcagagcaaaggggtgagaaatgggaagagaaactttcacagcttaaaaagaacaaacagtggcatgttgaagtttactgangtgttgttgcatagaaacgtctacgttgatgtctgcttaaaagatgtagcagcacatgatctcttgttctgtgttactctttgcattgctcatctttcaacttcanaggttaagatgacgaataaggtggccacagttattgatactcagatttgtctttaattgaactacaggaacttgctgagatttttttttctcttgcgtaaggaacctattcagcaccttaatctgtgagtattgttgcttggaaatggaataaacttcattttagaatccaactgcaaagattatcaagtttctcgtgtaggagttttg

SEQ ID NO: 2303 - DNA, 1696 bp, Cajanus cajan
ggaattaagtattcctaaattcataggaagtagcaaccttacatcacatgggtaggtgaaggcgagagagaggcagtgacactacgaggagccaaggaaaaactaaaaaacctgacctttccctttcgccaaaggatcatcaaactgacccaaatcaaagcagtttgacacagttgttgttgttggtgtgccaccttccttatattacacatttacacccattcttatcattctcaattctcaatattattacacttgttcacttttcaaacccatcccttcttctgctgtcacaacttcaacaccctcgatcttaagatggctcctttggccttgtctcagatggctgcaactgttcctgttggcaacgatttgactctcagaagatctgcgtttaaggcccctagcttaaacttctccaataaatcatgggcaccagtatttactttggacttgaaggcaaacaactcttgtttgagaagtcgacaagtgatatgcatgtcagtgcaacaagcaagtgcacccaaagttactgtctcacctttagaattggaagatgctaaagaacctcccttgaacctatacaagcctaaagaaccctatacagcaacaattgtttctgttgagaggctagtgggaccaaaggctcctggggaaacttgtcatattgtgattgatcatggtgggaatgttccctactgggaaggacaaagttatggtgtcattccaccaggtgaaaatccaaagaaacctggggctccccataatgtccgactatattcaattgcttccacaaggtatggagacttttttgatggtaaaacagcgagcttgtgtgtgcgccgtgctgtttattatgatcccgagacaggaaaagaagatccatccaagaatggcatttgtagcaactttttgtgtaactcaaagcctggagacaaaattcagatcacaggcccttcaggaaagataatgcttttacctgaggatgaccctaatgctacccacatcatgattgccaccggtaccggtgtcgctccattcagaggctatctgcgtcgaatgttcatggaatcagtccctacattcaagtttggtggactggcatggcttttccttggagttgccaattctgacagtcttctctatgatgatgaattcagcaaatacctcaaggatcacccgaacaatttccgctatgaccgagcccttagcagagaacaaaagaacaaaaatggaggcaaaatgtatgttcaggataagattgaggagtatagtgatgaaatcttcaaactcctggataatggggcccacatttatttctgtggtctaaaagggatgatgcctgggatccaagacacactgaagagggttgctgagcaaagaggggaaagctgggaagagaagctttcacagcttaagaagaacaaacaatggcatgttgaagtctattgagattctctagtgcagattgcagagtagtcccctttgtctgaaaggagaaaaaaacaaaaaaaaacagaaacattttcatttggtacatttcattaataatattcattaagctgcttgagtagctgtacttgttctgtattagtaaattgcaatgatatattgtcttcttatggatacagaattgaaaatccatgtcaatggtggtggcaatattgtagagtccattttgttaagggttttcata

SEQ ID NO: 2304 - DNA, 1658 bp, Arachis hypogaea
ggcctacagcctactgtttaccctcacaaaagggtgggagtgacactctgaggagtcaagaatgtgacgaagcaacgacttctcccattctcgaaaggatcacgaaacccaactttactttacaagttcaaatttgattaatcttatataatacactcatctaccacttttcattgttcaaatctaatcaaaaatttatttattattaaatcccttttcctttctccaatcacttcctgttgctgctgagattactggtccaatttttgttgttgttgatcttgtgatggctcatttgattgcgtcacaggtagctgtggctgttcctcttggcaacgatttgtctctcaaaagaactgcgcttaaggtatctaacttaaacttccaggataaatcatgggcactggtcttaactttcgacctgaaagcaagcaactctcaactaagaagtctgcgtgtgacatgcatgtcggtgcaacaagctagtgtacccaaagttacagtctcccctttagaattggaagatgctaacgaacctccattgaatatatacaagcctaaagagccatacacagcaactattgtttctgttgagagacttgttggcccaaaggctcctggtgaaacatgtcatattgtgattgatcatggtggcaatgttccctactgggaaggacagagttatggtgtcattccacctggagaaaatccgaagaaacctggaagtcctcataatgttcggctatattccattgcttcgacgaggtatggagacaattttgatggtaaaaccgccagcttgtgtgtgcgtcgtgccgtttattatgattctgagattggaaaggaagatccttctaagcaaggcgtttgcagcaactttttgtgcaactccaagcccggagacaaaattaagatcacagggccctctgggaagatcatgcttttgcctgaagatgatccaaatgctacacacataatgattgcaactggtactggtgttgctccatttagaggctatctgcgccgaatgtttatggagttagttcctaaattcaagtttggtggactagcctggctcttccttggtgttgccaataccgatagtcttttatatgatgacgaattcactaaataccttaaggactatccggacaacttccgctatgacaaagctctcagcagagagcagaagaataggagccgaggcaagatgtatgttcaggataagatcgaggaatatagcgatgagatcttcaaacttcttgacaatggagctcacatttacttctgtggtctaaaggggatgatgcctggaatccaagatacactgaagaaggttgcagagcaaagaggagaaaattgggaagaaaagctttcacaacttaagaagaacaaacaatggcatgttgaagtctattgataattctgcagcgcataataatcacatgcttgcatttatttaccttaagtctcagttaggtgttttaattaagggttgcttttgttttgattaataatcttcattagatagcttgagtgaactgtacattgttatcttgatgaatacaaatttaaagaaccaagtaaaggtggcggtagagacatggtttgaccattttgcaataaagatgcatcatagttaattaatatgatgttca

SEQ ID NO: 2305 - DNA, 1843 bp, Glycine max
aggggagggtgagtgagagagggagtgacactccaaggagccaagggaaaaacaaaaaacctgacctttccctttctccaaaggatcatcgaactaaaccaaatcaaaatcaaactttgtcacagttattggtgtgctacctccgttagttatataagacccttttataaactccttttaaggcttttcaatctccaatcacttcttcttgtgttgtcataacttcaacaacttctttcttctcgatctcacgatggctcatttggccctgtctcagatggctgtaactgttcctgttggcaacgatttgtctctcagaagatctgcagttaaggcccctaacttgaacttttgggataaatcatgggcaccagtatttactttggacttgaagccaaacaacccaagtttaagaagtcgtcatgtggtatgcatgtccgtgcaacaagcaagtgtatccaaagttaatgtctcacctttagaattggaagatgctaaagaacctccattgaacttatacaagcctaaagaaccctatacagcaacaattgtttctgttgataggctagtggggccaaaggctcctggggaaacttgtcatattgtgattgatcacggtggaaatgttccctactgggaaggacagagttatggtgttattccaccaggtgaaaatcctaagaaacctggggctcctcataatgttcgactatattcaattgcttccacaaggtatggggacttttttgatggaaaaactgccagcttgtgtgtgcgtcgtgctgtttattatgatcctgagacaggaaaggaagatccttccaagaatggcatttgtagcaattttttgtgtaactcaaagccaggagacaaaattcagatcacaggcccgtcggggaagataatgcttttgcccgaggatgacccaaatgctacccatataatgattgccacaggcactggtgttgctccattcagaggctatctacgccgaatgttcatggaatcagtccctgcatacaagtttggtggattagcatggcttttccttggagttgccaacactgacagtcttctctatgatgatgaattcagcaaatacctcaaggattatccggacaatttccgctacaatcgagccctcagcagagaacaaaagaacaagagtgggggcaaaatgtatgttcaggataagattgaggagtacagtgatgaaatcttcaaactcctggataatggggcccacatatatttctgtggtctgaaagggatgatgccagggatccaagatacgctgaagaaggttgctgagcaaagaggagaaagttgggaagagaagctttctcaacttaagaagaacaaacaatggcatgttgaagtctattgagattctctagttcagatttgcagagtagtccccctttgtctctgaaaggaaacaaaacaaaaaaagaacatttttcgtttggtgcatttaatcaataaaattcattaagcagcttgagtattgtagctgttctgtattagtaaattgcaatcatatattgtgcacttgatggatactgaatcgaaaaaccaagccattggtggtggcaatctggtagagtacattttgttaagggcagcaacatattttcttttgccaaattttgaattattctgtcaataaggataatcatcctctgaaatatcagcaaggcctagagtaatttcaagaagtacaagttatttttttatttaatattgtgagaattctgtcatatttcacaataacatcaaagtcttatcccttcaagggaagttgtatttcacaacgattggcaataaacagtggtccacagtt

SEQ ID NO: 2306 - DNA, 1748 bp, Glycine max
aggggagggtgagtgagagagggagtgacactccaaggagccaagggaaaaacaaaaaacctgacctttccctttctccaaaggatcatcgaactaaaccaaatcaaaatcaaactttgtcacagttattggtgtgctacctccgttagttatataagacccttttataaactccttttaaggcttttcaatctccaatcacttcttcttgtgttgtcataacttcaacaacttctttcttctcgatctcacgatggctcatttggccctgtctcagatggctgtaactgttcctgttggcaacgatttgtctctcagaagatctgcagttaaggcccctaacttgaacttttgggataaatcatgggcaccagtatttactttggacttgaagccaaacaacccaagtttaagaagtcgtcatgtggtatgcatgtccgtgcaacaagcaagtgtatccaaagttaatgtctcacctttagaattggaagatgctaaagaacctccattgaacttatacaagcctaaagaaccctatacagcaacaattgtttctgttgataggctagtggggccaaaggctcctggggaaacttgtcatattgtgattgatcacggtggaaatgttccctactgggaaggacagagttatggtgttattccaccaggtgaaaatcctaagaaacctggggctcctcataatgttcgactatattcaattgcttccacaaggtatggggacttttttgatggaaaaactgccagcttgtgtgtgcgtcgtgctgtttattatgatcctgagacaggaaaggaagatccttccaagaatggcatttgtagcaattttttgtgtaactcaaagccaggagacaaaattcagatcacaggcccgtcggggaagataatgcttttgcccgaggatgacccaaatgctacccatataatgattgccacaggcactggtgttgctccattcagaggctatctacgccgaatgttcatggaatcagtccctgcatacaagtttggtggattagcatggcttttccttggagttgccaacactgacagtcttctctatgatgatgaattcagcaaatacctcaaggattatccggacaatttccgctacaatcgagccctcagcagagaacaaaagaacaagagtgggggcaaaatgtatgttcaggataagattgaggagtacagtgatgaaatcttcaaactcctggataatggggcccacatatatttctgtggtctgaaagggatgatgccagggatccaagatacgctgaagaaggttgctgagcaaagaggagaaagttgggaagagaagctttctcaacttaagaagaacaaacaatggcatgttgaagtctattgagattctctagttcagatttgcagagtagtccccctttgtctctgaaaggaaacaaaacaaaaaaagaacatttttcgtttggtgcatttaatcaataaaattcattaagcagcttgagtattgtagctgttctgtattagtaaattgcaatcatatattgtgcacttgatggatactgaatcgaaaaaccaagccattggtggtggcaatctggtagagtacattttgttaagggcagcaacatattttcttttgccaaattttgaattattctgtcaataaggataatcatcctctgaaatatcagcaaggcctagagtaatttcaagaagtacaagttatttttttatttaatattgtg

SEQ ID NO: 2307 - DNA, 1851 bp, Citrus sinensis
ggtcactgtcccagtggcagcctgagaagccaaagttgtcttttgccaatctccaaagaccaaccgcagttcaattgcatcattaaaccaaactctgtatataataagtgcttagctttctctttttctcttgaaaaacatttaaaaaaaaaaaaccttttaattgatcagtcactcattgaattgatctgatcatggctcattcagccgtctctcaggttgctgtggctgttcctgttgggactgactctactctcaggagtgctcctctgtttaagacacaaaatttaagattgggtgaaaaatcatgggctcctgtgttatctctggacctgaaatcaaggaatccacggttgagaaatcgttatgtagtatgcatgtcagtgcaacaagcaagcaaatccaaggttgcagtttcaccattggaactggaagagcggagccagcccccactaaatttatacaagcccaaggaaccctacacagcaactattgtttctgttgagagagttgttggcgcaaaagccccaggagagacttgccatatagtgattgaccatggtggaaacgtcccctactgggaaggacagagttatggagttatccctcccggtgaaaacccaaaaaaacctggaaatccccacaatgtccgtctttattcaattgcatctactaggtatggagattcctttgatggcaagacagccagtctgtgtgttcgtcgtgctgtgtattatgaccctgagtctggaaaggaggatccttcaaagagtggtatatgcagcaatttcctatgcaactcaaagcctggagacaaagttctgatcacaggaccctctggtaagattatgcttttgcccgaagacaatcccaacgccacccacataatgatagctacaggcactggtatagcacctttcagaggctacctacgtcgtatgttcatggaatctgtgcctacatacaagtttggtggccttgcatggcttttccttggagtggccaatccagacagcctcctttatgatgacgaattcaccaagtatcttcaggactatccagataacttccgttatgacaaagcactcagcagagagcagaagaacaagaaggggggcaagatgtatgttcaggacaagatcgaggaatacagcgacgaaatcttcaaacgcttggatggcggagcacatatatacttctgtgggcttaaaggaatgatgccagggatccaggaaacactgaagagagttgcggaacagagaggagaaagctgggatcagaagctttcgcaactgaagaagaacaagcagtggcatgtggaagtctattgatttttcatttttcataattatgatcctccgtcattcatccatgcttttatcacaaaaccatgcaatggtcacctccttttcggtaatgtttcggtttttcgggtagcctggaattattattatttacttaaaaaattaaataccaactgtttaaagactcaattagttgtaaccattcatccgtctgattaaatgatttcgcgatcctcgtgattattccaaggtaggaaccaaactcattgtattttatgcaaagggatgttatcatagaccttgttgcagttatataccaaacatcaatcttaagttgccatcactaacatacttgtaagtttttgttgggtctatttttacgttactgagataacaatggtggggttgatgtatgcgtggtccatgataatgtaccttaataattccctatcatacataactctcttgagttctgaggaaacttcggtgagatggggttaaatgaaaatgaatgtttattcgcggccccattgatggccccaaaact

SEQ ID NO: 2308 - DNA, 1618 bp, Arachis hypogaea
agtgacactccgaggagccaagtgtgaagaagcaacgacctttcccattctccaaaggatcaccacccccaaacccacatccaacttcaactttgattactcttatataatacactcatctaccactttctattgttccaatctaatcaaatatttattttttattattaaattccttctcctttctccaatcactttgctgttgctcagattattgttcctactttctttgttgttgatctcgtgatggctcatttggctctgtcacaggtggctgtggctgttcctgttagcagcgatttgtctctcagaagatctgcgtttaaggtatctaacttaaacttccaggataaatcatgggcaccggtgttaactttcaacctgaaagcaaacaattcaaggtcaagaagtcggcgtgtgacatgcatgtcggtgcaacaaacaagtgcacccaaagttactgtctcccctttagaattggaagatgctaatgaacctccattgaatatatacaagcctaaagagccatacacagcaactattgtttccgtcgagaggctcgttggtccaaaggctcccggtgaaacatgtcatattgtgattgatcatggtggcaatgttccctattgggaaggacagagttatggtgtcattccacctggagaaaatccaaagaaacctggaagtccccataatgttcggctatattcaattgcttcgacgaggtatggagacaattttgatggaaaaaccgccagcttgtgtgtgcgccgtgctgtttattatgatcctgacactggaaaggaagatccttctaagcaaggtgtttgcagcaattttttgtgcaactctaagcctggagacaaaattaagatcacagggccctctgggaagatcatgcttttgcctgaggatgatccaaatgcggcacacataatgattgccaccggcactggtgttgctccatttaggggctatctacgtcgaatgtttatggaatcagttcctaaatttaaatttggtggactagcctggctcttcctcggtgttgccaatagcgatagtcttctgtatgatgatgaattcaacaaataccttaaggactatccagacaacttcctctatgacaaggctctcagcagagagcagaagaacaggagcggaggcaagatgtatgttcaggataagatcgaggaatatagcgatgagatcttcagacttctcgacaacggggctcacatttatttctgtggtctaaaggggatgatgcctggaatccaagatacactgaagaaggttgcagaccaaagaggagaaaattgggaagaaaagctttcacaacttaagaagaacaaacagtggcatgttgaagtctactgataattctgcattgcagaataaacacatgcttgcatttatttaccttaagtctgagttaggtgttttaattaagggttgtttttgttttaattaataatcttcattagacagcttgagtaagctgtacattgttttcttgatgaatacaaaattgaagaaccaagtaaacgtggtagtagagacatattttgaccattttgaaataaagatgcatcatagttaattaatatgatgttca

SEQ ID NO: 2309 - DNA, 1519 bp, Prunus persica
acaaggcgagcatcgcagtgagagagagaaagtccgaggagccaaggcaaaagcaaaactcgacctttgggacactcggaaggataattttacacaccatttttgcctccaacaactcttcctctgcatgatcttagtcccctaacccctatattaagtccctcgcgtcacctaaagccctctcataccatcctttgatccaatcatgtctcatttggctatctctcagggttcacttactgctcctgttggaagcgatttttctatcagaagatcagtgttcaaggcacaaagcataaactttaatgataaatcatgggcacctcttttatctttggacttgaaaacaaagaatggggggctgagaaatcagcggatagtatgcatgtcagtgcaacaagcaagtgttcctaaagttgctgtatctcctctacaacttgaagatgctaatgagcccccattgaatacatacaagcctaaggaaccttatactgcaaccattcgttctgttgagaggattgtaggcccaaaggctcctggagagacctgccatattgtaatcgatcatggtggtaatgttccctactgggaagggcaaagttatggtgtaattcctcctggtgaaaacccaaagaaacctggggctccacaaaatgttcgtctttactcaattgcatcctcaaggtatggagactattttgatggcaagacgaccagtttgtgtgtccgccgtgctgtctattacgaccctgagacaggaaaggaggatccttccaagaatggtgtgtgcagcaattttttgtgcaactccaaaccaggagataaaattaagatcacagggcctgctggcaagatcatgcttttgcctgaagacaacccaaatgccacccacattatgattgccaccggcactggtgtcgcaccatacagaggttaccttcgacgcatgttcatggaatctgttcccaaattcaagtttggcggccttgcatggctattccttggtgtggccaatactgatagtctcctctatgatgaagagttcaccaagtatctcaaggactaccctgataatttccggtacgacatagcgctaagtagagaacataagaacaatagaggagggaagatgtatgttcaggataaaattgaagagtacagtgatgagatcttcaagctcttggataatggagcccacatatatttctgtgggctcaggggaatgatgcctgggattcaagaaaccttgaagagggttgcggatggaagaggggagaactgggaggagaagctttcacaactgaaaaagaacaagcaatggcatgtggaagtctattgatatggcatgaagcctcccatgttaggtaaattttcttttggttagccaatcatcagcttttacataaggaacttttgagttagtaatagcattgatatgtatcagcaaacaaagagacaagcccatcttcttttggttgaaccaatttgaggaaccctttgattgttgattgatgtttca

SEQ ID NO: 2310 - DNA, 1263 bp, Manihot esculenta
atggcccattcggcagcagtctcgcaggtttcttttgctgttcctattgggagcgattccactctgcgaagatcagttctgaagccacacagtataagattcagtgataaatcatgggccccttcattagctgtggacttgaaaccaaggaatgctcaattgcaaagtcgatacatagtatgcatgtcagtgcaacaagccaggagatctaaagttgcagttttaccttcagatcttgaagatgctaaagagcctccattgaatacatacaagcctaaggaaccttacacggctaccattgtctctgttgagaggcttgtagggccaaaagctccaggagagacctgccatattgtgattgatcatggtggaaatgttccttactgggaagggcaaagttacggtgttattcctcctggtgaaaacccaaagaagccaggtgcacctcacaacgtacgtctctattcaatagcatctagcaggtatggagacaatttcgatggaaagacagctactttatgtgttcgtcgtgctctctattatgatcctgagactgggaaggaggatccctcaaagagtggtatatgcagcaatttcctttgcaactcaaagcctggggataaagttcaaatcactggaccctctggcaagataatgcttttgcctgaagataacccttctgcaacccatataatgattgcaactggtactggcgtggctcctttcagaggctacctccgacgtatgttcatggagaatgtttcattcaagtttagcggtctggcatggcttttccttggggtagcgaacactgacagtctcctctatgacgatgaatttacaaagtatcttcaagactacccagaccagttcctctatgacaaggcacttagcagagaacaaaagaacaagagcggaggaaagatgtatgtgcaggataagatcgaggaatacagcgatgaaatcttcaaactcttggatggtggagctcacatttacttctgcgggctcaagggaatgatgcctgggattcaagataccctgaagagagttgcagagcagagaggagaaagctgggagcagaagctctctcagctcaagaagaacaagcaatggcatgtggaggtgtattgattttgcatattgttaatctggttctcaggtggacaacaagtagcaggcccatgtggcatttttcaattgttatttgatcagctttgcataaactaaagattagctgttaaattcatctgtattattaaa

SEQ ID NO: 2311 - DNA, 1614 bp, Ricinus communis
ggcaacatataatagagagcagagcagccagcaggttggtagtaccactatagtaaactggagaggcacacccaaagatccgtcttttgctactctccaaagggtcactctgaactactcaagttcttcatcatcatcttttcttttttactttctcatgatccaatcttatagaccctataaaaccaattaaatcccgtattttacaaactcactacactctctctacctctttctctgatctgatcatggcccattctgcagcagtttcacaggtttctttagctgtccctgttgggagcgattcgactctcaagagatcagtttttaagacacacagtataagcttcagtggtaaatcatgggccccttccttggctttggacttgaaatcaagaaaggttcaattgaagaatcaatatgtagtatgcatgtcagttcaacaagccagcagatcgaaggttgcagtttcaccattagaacttgaagatgccaaagagcctccattgaatttatacaagcccaaggaaccttacactgcaactattgcttctgttgagaggcttgtaggcccaaaagctcctggagagacgtgccacatcgtgattgatcatggtggtaatgttccgtattgggaagggcaaagttatggtgttatccctcctggtgaaaatccaaagaagccaggggctcctcacaatgtacgtctttattcgattgcatcaaccaggtatggagacaattttgatggcaagaccgctactttatgcgttcgccgtgctctgtactatgatcctgagactggaaaggaggatccttcaaagatgggcatatgcagcaatttcctttgcaactcaaagccaggagataaagttcagatcactggaccctctggcaaaataatgcttttgcctgaatctgaccctaatgctacccacataatgattgctactggcactggtgtggctccctttagaggttacctccgacgtatgttcatggaggatgttcccacattcaaatttggtggtcttgcttggcttttccttggggtggcaaacactgacagtctcctctatgatgatgaattcacaaagtaccttgaggactacccagatcacttccggtatgacaaggcacttagcagggaacagaagaacaagaatgggggaaagatgtatgttcaagataagattgaggaatacagtgacgagatcttcaaactcttagatggtggagctcatatatatttctgtgggcttaagggaatgatgcctgggattcaagatacactgaagaaagttgcagaacaaagaggagaaagctgggaccagaagctctcacagcttaaaaagaacaagcaatggcacgttgaagtttactgatatttgcatattatgaacctggttcttgcctgtttttccttcagaagaaaattagcagccccatcaggcaatgtggagattgttggatattgaatttggtcagctttgcagaaacttgattagctgttcccattcatctgtatcatttaataatcaaatgattctcttaatcagaacaaattagcagtccttctggcttttatagtttaaagattattatattagtcca

SEQ ID NO: 2312 - DNA, 1667 bp, Quercus alba
atggggggagcacaaaacaatttggcagcaaaagaaagggacagtatatatgatatgaatgactctgaatgagagcgtcctttgacagtatcgaaaggatcattcacagagtcacacctcgtagtgttgtcagcttataaatactattgacaacacttctctttctcaaagcgttctctcagctttctctcaaatatctctaaattgatctctcatcaatggctcaattggccgcatctcaggttgctgttactgttcctgttggaagcgatttgtccactaggagatctgtgtttaagactcatagcataagctttcatgataaatcatgggcaccttccttatcattggacttaaaaacgaagaatgcacggttgagaaatcgacacataatttgccaatcagtgcaacaagccagtgtacctaaagttactgtttcccctttaaaccttgaagatgctaaagagcccccactaaatacatacaagcctaaggaaccttatactgcaaccattgtttctgtggagaggattgttggccctaaagcccctggagagacttgccatattgtgattgatcatggtggcaatgttccatactgggaaggacagagttatggtataattcctcctggtgaaaacccaaagaaaccagggagtccacaaaatgttcgtttgtactcaattgcctccactaggtatggagacacttttgatggcaaaacagccagcttttgcgttcgtcgtgctgtttattatgaccctgagactggaaaggaggatccttccaagaatggtgtatgcagcaattttttatgcaactcaaagcctggagataaagttagggtcacaggtccctctggcaagataatgcttttgcctgaagacaacccaaatgccacccacataatgattgctactggaactggcgttgctccatatagaggctatcttcgtcgtatgttcatggaggctgttcctacattcaagttcaatggccttgcttggctgttccttggggttgccaattctgacagtctcctctacgatgatgaatttaaaaagtatcttaaggactatccagataacttccgctatgacctggcccttagtagagagcaaaagagtaagagtggaggcaagatgtatgttcaggacaagattgaggaatacagtgatgaaattttcaaactgttggatactggtgcccacatttatttctgtggtcttaagggaatgatgcctgggatccaagaaacgcttaagagagttgcagaccaacgaggggagaattgggaagagaagctctcacagctcaaaaagaacaaacaatggcatgttgaggtctactaagcttgatgctatgacttcctgtttcatgaaaattgcatcagccttttgatgttaggaacttggccctttttttttaaaatattttttttattgaccagttttttagatggagcttgaatggtagttatcatttttctgtgttattaaatgacaaatgagacaagtttgattcccttggttaatacaaattaagaagccctttcaatgggattcttgcagcattacatatttttaaagtttgtaatggccaaagccaaaagatgctctactttgtcaagtgtagttgtccttttgttgtggcactatagtagccag

SEQ ID NO: 2313 - DNA, 1525 bp, Manihot esculenta
gggggaggaagaggcaaagagaaaaagcccaaagagccgtcctttgccgcttctcaaaggatcacactcctccaagtaccccaattgtccaagctcctcttctattcgtcatctctcgcatgatccactcttaaaacctataaatcaactcaattccggctttttacaacgtctctgcgccccttctgatctgaccatggcacattcggcagctgtctcgcaggtttcttttgctgttcctgttgggagcgattctacccttggtagatcagttcttaagccacacattataagcttcagcgataaatcatggggcccttcattagctttggacttgaaatcaaggaatgctcgattgcaaaatcgttttatagtttgcatgtcagtgcaacaagccagcagatctaaggtttcagtttcaccgatagaatatgaagatgacaaagagcctccattgaatttatacaaacccaaggaaccctacacagcaactattgtatctgttgagaggcttgtaggaccaaaagctcctggagaaacatgccatattgtgattgatcatggtggcaatgttccttactgggaaggacaaagttacggtgttattcctcctggtgaaaacccgaagaagccaggggcacctcacaatgtacggctctattcaattgcatccaccaggtatggagacaattttgatggcaagacagctactttatgtgttcgtcgtgctctttactacgatcctgagactggaaaggaagacccttcaaagggtggtatatgcagcaatttcctttgcaactcaaagcctggggataaagttcagatcactggaccctctggaaagataatgcttttgcctgaagataaccctaatgccacccacataatgattgctactggtactggtgtggcgccttttagaggctatctccgacgaatgttcatggaggatgtccctaggtataagttcggcggtcttgcttggctcttccttggagtagcaaactctgacagcctcctatatgatgatgaatttaccaagtatcttcaagactacccagatcattttcgctacgacaaggcgcttagcagagaacaaaagaacaagagcggaggaaagatgtatgtgcaggacaagattgaggaatacagtgatgaaatcttcaaactactggatggtggagctcacatttatttctgcgggctcaagggaatgatgcctgggattcaagatacactgaagaaagtcgcccagcagagaggagaaagctgggagcagaagctctcacagctcaagaagaacaagcaatggcacgtggaggtgtactgatctcgcgtattgttaacctcccgtttcttcaaacgagaagtagcgatccatacgttagtgaatgtagcatttctccattgttgtttcgtcagcttaccatgaactcagattagctgttgccattcatctgtatcactaaataatcaaatgatctgcatgattaaaacagattaagaatccatttggttttat

SEQ ID NO: 2314 - DNA, 1695 bp, Glycine max
ctagcataggtgaaggtcagtgcgagggagtgacactccaaggaggcaagggaaaacaaaccaaaaagtctgacctttccctttctccaaaggatcatcaaactaaactaaatcaaatcaaaatcaaactttgtcacggttatattagacccttttataaacctctttcaaggcttttcaatcacaccctttctctaatcacttcttcttgtgctggcataacttcaacaacttattctttgttctcgatctcacgatggctcatttggccctgtctcagatggctgtaactgttcctgttggcagcgatttgtctctcagaagatctgcggttaaggcacctaactttaacttttgggataaatcatgggcaccagtatttactttgtacttgaaggcaaacaactcaagtttaagaagtcgtcatgtggtattcatgtcagtgcaacaagcaagtgtacccaaagttaatgtatcacctttagagttggaagatgctaaagaacctccattgaacttacacaagcctaaagaaccctatacagcaacgattgtttctgttgataggctagtgggaccaaaggctcctggggaaacttgtcatattgtgattgatcatggtggaaatgttccctactgggaaggacagagttatggtgttattccaccgggtgaaaatccaaagaaacctggggctcctcataatgttcgactatattcaattgcttctacaaggtatggagacttttttgatggaaaaactgccagcttgtgtgtgcgtcgtgctgtttattatgatcctgagacaggaaaggaagatccttccaagaatggcatatgtagcaattttttgtgtaattcaaagcctggagacaaaattcagatcacaggcccttcagggaagataatgcttttacccgaggatgacccaaatgctacccatataatgattgccaccggtacaggtgttgctccattcagaggctatctacgccgaatgttcctggaatcagtccctacatacaagtttggtggactagcatggcttttccttggagttgccaacactgacagtcttctctatgatgaagaattcagcaaatacctcaatgactattcggacaatttccgctatgatcgagccctcagcagagaacaaaagaacaaaaatgggggcaaaatgtatgttcaggataagatagaggagtacagtgatgaaatcttcaaactcctggataatggggcccacatttatttctgtggtctgaaagggatgatgcctgggatccaagatacactgaagaaggttgctgagcaaagaggagaaagttgggaagagaagctttcacaacttaagaagaacaaacaatggcatgttgaagtctattgagattctctagtgcaggatttgcagagtagtagtccccttctgtctctgaaaggaaacaaaacaaaaaagaacattttgcgtttggtgcatttagtcaataaaattcattaagcagctgagtaactgtagctgttctgcattagtaaattgcaatgatatattgtgttcttgatggatacagaattgaaaaaccaagtcattagtgtagtgacaatcttggataatggggcaatctttgttaacatattttcttttgctaaattttgaattattattttaataaggattatcatcctctgcaatgc

SEQ ID NO: 2315 - DNA, 1379 bp, Glycine max
gtcagtgcgagggagtgacactccaaggaggcaagggaaaacaaaccaaaaagtctgacctttccctttctccaaaggatcatcaaactaaactaaatcaaatcaaaatcaaactttgtcacggttatattagacccttttataaacctctttcaaggcttttcaatcacaccctttctctaatcacttcttcttgtgctggcataacttcaacaacttattctttgttctcgatctcacgatggctcatttggccctgtctcagatggctgtaactgttcctgttggcagcgatttgtctctcagaagatctgcggttaaggcacctaactttaacttttgggataaatcatgggcaccagtatttactttgtacttgaaggcaaacaactcaagtttaagaagtcgtcatgtggtattcatgtcagtgcaacaagcaagtgtacccaaagttaatgtatcacctttagagttggaagatgctaaagaacctccattgaacttacacaagcctaaagaaccctatacagcaacgattgtttctgttgataggctagtgggaccaaaggctcctggggaaacttgtcatattgtgattgatcatggtggaaatgttccctactgggaaggacagagttatggtgttattccaccgggtgaaaatccaaagaaacctggggctcctcataatgttcgactatattcaattgcttctacaaggtatggagacttttttgatggaaaaactgccagcttgtgtgtgcgtcgtgctgtttattatgatcctgagacaggaaaggaagatccttccaagaatggcatatgtagcaattttttgtgtaattcaaagcctggagacaaaattcagatcacaggcccttcagggaagataatgcttttacccgaggatgacccaaatgctacccatataatgattgccaccggtacaggtgttgctccattcagaggctatctacgccgaatgttcctggaatcagtccctacatacaagtttggtggactagcatggcttttccttggagttgccaacactgacagtcttctctatgatgaagaattcagcaaatacctcaatgactattcggacaatttccgctatgatcgagccctcagcagagaacaaaagaacaaaaatgggggcaaaatgtatgttcaggataagatagaggagtacagtgatgaaatcttcaaactcctggataatggggcccacatttatttctgtggtctgaaagggatgatgcctgggatccaagatacactgaagaaggttgctgagcaaagaggagaaagttgggaagagaagctttcacaacttaagaagaacaaacaatggcatgttgaagtctattgagatt

SEQ ID NO: 2316 - DNA, 1871 bp, Malus domestica
atcgaattccgttgctgtcgggacttaaagggaaagcaaaaacccgacctttgggactctcggaaggatcacttttatccccatttttttctcaacgactcttctgcttgtgattctcctgcatgatccaactcccgcatcacctatattaactcctcggccctcacatcaccagaagccctctcaattcattcgtaccaccctcgatcatccaatcatgtctcatttggctctctctcagggttcactgactgtgactgttccgcttggaagtgatttctccctccgaagatctgtgttcaaggcacgaagtgttagctttaatgataaatcatggactcctattttacctttggacttcaaaacgaagaatggacggctgagaaatcagcgcattctatgcatgtcagtgcaacaagcaagtgcgcctaaagttaatgtagctcctctacaactcgaggatgctaatgagcccccattaaatacatacaagcctaaggaaccttatactgcaaccattctttctgttgagaggattgtcggcccaaatgctcctggagagacttgccatattgtgattgatcatggtggtaatgtgccttactgggaagggcaaagttatggtgtaattcctcctggtgaaaaccctaagaaacctggggctccgcaaaatgttcgcctttactcaattgcatccacaaggtatggagactattttgatggcaagacaactagtttgtgtgttcgtcgtgctgtctattacgaccctgagacaggaaaggaggatccttccaagaatggtgtatgcagcaactttttatgcaactccaaacctggtgataaaattaagatcacagggcctgctggcaagatcatgcttttgcctgaagacaacccaaatgccacccacattatgattgccactggcaccggtgtagccccgtacagaggttacctccgtcgcatgttcatggaatctgttcccaaattcaagtttggcggccttgcatggctattccttggtgtggccaacactgatagtctcctctatgatgaagaattcaccaagtatctcaaggactaccctgataatttccggtacaacatagcacttagcagagaacagaagaaccagagaggagggaagatgtatgttcaggataaaatcgaggagtacagtgacgagatctttaagctattggacaacggggcccacatatacttctgcgggctcaagggaatgatgcccgggattcaagaaaccttgaagagggttgcggttgaaagaggggagagctgggaggagaagctttcacaactgaaaaagaacaagcaatggcatgtggaagtctactgatgatgcattgtttcagaactgattcgtgtctctttctcgaggaaatgctctcaagcatcttatgctaggtaaaattttcggtttctttttgctttgtaagttgcccatttatcagctttagctaaggaacttgagcagcaatagcattcatctgtatctttactctttagacaaggcaagctatcatcttggctgaaccattttgagaaaccctttttattgtcgattgatgttttatcttctgctgctgtttagtactttaagcatttataaatgtaacaatcagaaagatcgtctactctcgtatgatctgtagctgtccaattgtcctctcaactttctctggatgatttattcgattcctgaatcacgtttgaggttaggtgattctaacgtcgtttactcgttaaacgacactcttgaattgaaagtggccaagccttgcggtcgcagaaatgcttccgttgtaatacctcagcctttgattgcattagccattgagattttctgtttt

SEQ ID NO: 2317 - DNA, 1603 bp, Actinidia deliciosa
aattcggaacgaggtttaaattaacctctctctctctgtctctctctctctgtctctctcggaagttcttctgatccgatcatggctcaatcggctgtctctcaggtctctctcactgtccctctcaatagcgatttgtctttcaggaaatctgtccttaaggtgcacaacataagtttccgtgaaaagtcaagggtagctgtctcaccattggaagtgaatgccaggaatgtacggtcgagaaatcagtttgtagtttgcatgttagtgcaacaagccagcaaacctaaagtttttgtttcacctttagcacttgaagatccaaaagagcctccaataaacttgcacaagcccaaggaaccttatactgcaaccattgtctctgttgagaggattgtaggcccaaaagctccaggagagacttgtcatattgtgattgatcatggtggcaatgttccctactgggaaggacagagttatggtgtgattcctcctggtgaaaaccccaagaaaccaggggctccccacaacgttcgcctttactccattgcatccaccaggtatggagactttttcgatggtaagacagctagcttgtgtgttcggcgtgctatctattacgatcctgagactggaaaagaagacccttcaaagaatggggtatgcagcaattttctatgtgactcaaagcctggggacaaaattgaagtcacaggtccttctgggaaaataatgcttttacctgaagacgactcaaatgccgcccacattatgattgccactggtactggcgtggctccattcagaggctatctccgacgtatgtttatggaatctgtcccttcattcaagttcggtggtcttgcctggctatttcttggggtggccaacactgacagtctcctttatgatgaagaattcactaagtatcttcaagactaccctgaaaacttccggtatgaccgtgctctgagccgagaacaaaagaaccagagtggaggcaaaatgtacgttcaggataagatcgaagaatacagtgatgagatattcaagctcttggatggcggggcccacatttacttctgtgggcttaaagggatgatgcctgggatccaagatacgctgaagagggttgcggagcagaggggggagagctgggaagagaagctctctcaacttaaaaagaacaaacaatggcatgtcgaagtctattgatatcatattacgttggagctcggtattacccgactttaaggtaatggttcatttcctcctgttgggtaatttgggaattggttgtattattgatgtcctgaagaacttgactagcatttgctattcatcgcttgttggtgtcaaggaatgcggattgttttctatttaatgcagaataagaacccctttggatagtttgagactattcctggtctgttcttcttagtgttaatccatttgtaacgcgtgccaagatatgtatctcttaataaacagatgagatatgtatctcttaataaacagatggttgtaagttgtaacttgatatgcgtctactacgcgaaaggattgctggttgaacaggtttgagagtcggatattttcaaga

SEQ ID NO: 2318 - DNA, 1678 bp, Aristolochia fimbriata
tagaagcgcgattgggcaagcggcgccaccgctgctggctgtctcttccatgccaccaagggatcaatcactctcctcctgcctatgcatgttctgaaccctataaaaccccattaacgtctcccctcttcgctctccaaggagtcgtcccgccatccccttctcggagtcccgtgatcgtcgatccgatcatggcgcatttggccgttgctcaggcttctgtgtctgttccaatcagcaatgatacatttccaaggtcgcatggatttaaggcatataatttacggattcaagacaaaccatggggcccactagtgaatttgaaggccaactatgcatcatcaagaagtcaatggagaatctgcatgtcagtacaacaagccacgagaagcaaagtcactgtttcaccattgacacttgaagatgcaaaagaccctcccatcaatacattcaagccaaaggaaccatacaccgcaactattgtctctgttgagaggatcgtgggtcctaaagctcctggtgagacttgtcatattgttattgaccacggtggcaatgttccctactgggaaggacagagctatggtgtaatccctcctggtgaaaatcctaaaaagcctggatctcctaacaatgtccgcctttattcaatcgcatcaactaggtatggcgacgcttttgatggcaaaacagccagcttgtgtgtgaggcgtgcagtttactatgaagcagagactgggaaggaggatccttcaaagaaaggtgtctgcagtaatttcctatgcgactcaaaacctggagacaaagtaaagataactggcccatcaggcaaggtgatgttgctgcctgaggaagaccccaatgcaacccatatcatgattgccactgggactggtgtggctccattccgaggctatctccgcaggatgtttatggagtctgtccccacattcaagtttaacggcttagcttggcttttcctaggcgttgccaacacagacagtttactctatgatgaggaattcaccaaatacctcgaggactatcctgacaacttcagatacgacaaggcactgagtagggagcagaagaatcgaaatggtggcaagatgtatgttcaggataagatagaagaatacagcgatgaaatcttcaagcgcttggatggaggagcccatatctacttctgtggattgaagggcatgatgcccgggattcaagaaacactgaagagagtagcggaggagagaggggagagctgggaggagaagttatcacagctgaagaagaacaagcagtggcatgtcgaggtctattgatttaggagaggcatctcaaaactcaaatgggtatttatttttcgtactaaagccatggtgtatccttttaaaattcgactttagcctcagccaaccggatatctgcacaactgttgctctccgtggcccattcttgacgtattttgattgagatgaactgcatatgtagttttacctttatatgaactgttgtatcaacatggacattcaactcagaaaataattagaatattggacccttcttgggtggaaattgaatctgtttactttgggtgtgtccgtgtttttctaggctcttgtgattataaaacggatgtcgagatgtagtgccagaagagcagaaattgaaaatggtcaag

SEQ ID NO: 2319 - DNA, 1573 bp, Tropaeolum majus
ggagccaggggaagaaatccatgctgtctttagcgactacccaaacgctcactttctccacttttactccccttttatactctttccagagatccaatcataatatcccaaatcctctataattataaaaaccctgtaatttggtctcaccaaaaaattgataaaaccctgaaagaaatcatctacaaatacatttgatctccacaggatggctcaatcagctgcatctcaggttgctatagctgttcctgctgttggcagcgagacctctctcaggagatctgtgtttaagacacatagtgtaaactttagcaacaagtcatgggttcttgccctaactttcgacttaaactcaagaaatgcacggatgaaaaatcagttcacagtgtgcatgtcagtgcaacaagcgagcccaacaaaggttgcagtttctcctatagatttagaagatgccaaagagcctcccctaaacctacacaagcctaaggaaccttacacagcaacaattgtttccgttgagaggattgtaggccccaaagctccgggtgagacttgccatattgtgattgatcatgatggtaacgttccatattgggaaggacaaagctatggcgtaattcctccgggtgaaaaccctaagaagccaggagctccccacaatgtgcgcctttattcaattgcatcaaccaggtatggagataattttgatggcaaaacaggaagcttgtgtgttcgacgtgctgtttactatgaccctgagactggaaaggaggatccttcaaagaatggtgtatgcagcaattacctatgcaactctaagcctggagataaaatcaaaatcacaggccccgctggcaagatcatgcttttgcctgaagatgacccgaaagcaactcacataatgattgctaccggtaccggtgtagcaccatacagaggctaccttcgtcgtatgttcatggaaaacgttcctacgtacaagtttggtggccttgcatggcttttcctcggagtggccaacaacgacagtctcctctacgacgatgagtttaccaagtatcttcaggactacccagacaacttccggtatgacaaggcacacaggcagggaacagaagaacaagagcggaggtaagatgtatgtccaagataagatcgaggaatacagcgatgaaatcttcaaactattagatggtggtgcccacatttatttctgcggacttaagggaatgatgcccgggattcaagacacactgaagcgagttgcggagcagagaggcgaaagctgggaccaaaagctttcgcagctgaaaaagaacaaacaatggcatgtcgaagtctattgatcgttaggtagttgagaacctcgaaaaaaacacactagtattttaatatttggaccttacatttgtatgattaaaataatttgaggtgattcacttgatgaaaatggaatttaatctttgattatcatgaacttccatggaaatattgatgatcaagtgttgtggttattgtactactactggctattagttttctttacatggagaatgaccaataaaatattgat

SEQ ID NO: 2320 - DNA, 1681 bp, Gossypium hirsutum
aggcaaagcaaagaaagaggaagaaaagcgtcttttggcagtcgccaaaggatcatcgttcgaatcatttcattgctcactctcatcgatcaaaaatttatttttaaaaccccactcccatcctttaaatcctaacactagagaagacaactgaaacgcaaagcagagatccccctaaatttgctctcttctcaaagttttttctttcatctctgcttcatggctcagtctactgtatcccaggtttctgtagctgttcccgttggaaacgacatttctctgaggagatctgtaactaacaggaacattataagctttggtaacaagtcatgggcttccaccttgtcttttgatttgaaatcacgaaatgcacagaagaacaaaccgtacatagtatgcatgtcagtgcaacaagccagcaaatccaagattgcagtttcacctttggagttggaaattgcaaaagagcccccactaaatacattcaagcccaaggagccttacacagctaccatcgtttctgttgagagacttgtcggtccaaaagctccaggcgagacttgtcatattgtcattgatcatggcggtaatgttccatactgggaagggcagagctatggtgttatccctcctggtgaaaatccaaagaaaccaggttctccccacaatgttcgtctgtattccatagcatcatccaggtatggagattcttttgatggcaagacaaccagtttgtgtgtccgtcgtgctgtctattataaccctgagaccggaaaggaggatccgtcgaaaagtggtgtttgtagcaatttcctatgcaattgtaagcctggagataaagttcagatcactggcccttctggcaagataatgcttttgcctgaagataacccaaaagccaaccacataatgatagccactggaactggtgtagctcccttcagaggctacctccgccgcatgttcatggaagatgttactttcaagttcaaaggccttgcatggcttttcctcggggtggccaacaaggacagtctcctttatgatgatgagtttaccaaatacctcgaggactaccctgatcaattccggtacgatctagctcttagcagagagcaaaagaacaagagtggaggcaagatgtacgttcaggacaagattgaggaatacagtgacgaaattttcaagctcttggacgatggagcccatatatatttctgtgggctcaggggaatgatgcccgggatccaagaaacattgaagagggttgcggagcagagaggagagaactgggatgagaagctttcacagctgaagaagaacaaacaatggcatgtagaagtatattagttttggtttgcgtgatttgaccccacactcctccatgcatgccctatttgaagcagtttaccgtagccatgttaagtcaagctggtatttttcaatttgtttagggggttcacatgtaaacctgatttatcttagttgtcatcttacttttctttgattaaataattgaagctagtttcagactttatgaagaaaacttgagaacatcccaacatttatgattgttagaattagatgttttaaataccatccatccggaattatttccattcttcaagttttactttggaagatagaaataaagtacaaccagcccttgcaagtttgaaat

SEQ ID NO: 2321 - DNA, 1472 bp, Tragopogon dubius
atttccagttgaaggtgaagaatctgcaatattttgatctcttacgctcatttcagaaggtttactcgatccgatcatggctgctgcacattgtggcgttgcatttcagggctcagtcactacccctcttaacagtgacacctcacttcacagatcaatattcaagactggaaagatcagctttactgataaaccatggatgtctttttcacctatggagctaaaaacgaagaacacacgatcaagatatcaatccatagtttctatgtcaaccccacaagctgttggcagtgctaaggtttcagttgcacctttagcacttgaagatgcaaaagaacctcctctgaatacatacaagcccaaggagccatatacagcaaccattgtctctgttgaaagaatagttggcccaaaagctccaggagagacgtgtcatgttgtgattgaccatggtggtaatgttccctattgggagggacaaagttatggtgtaattcctcctggtgagaacccaaagaaacccggggctcctcacaatgtccgactttattcaattgcatccacaagatacggcgattcattcgacggaaaaaccgctagtttatgtgttcggcgtgcagtctattacgaccccgaaaccggaaaagaagatccttcaaaaaacggcatttgcagcaactttctctgcaactccaaacccggagacaaagttaaaataacaggcccatctggaaaaatcatgcttttaccggaagacaacccaaacgcgacccacatcatgatcgccaccggcaccggagtagccccataccggggctacctccggcgaatgttcatggaagctgtacctaaatacaaattcaccggtctttcttggctgtttcttggggttgctaataaagatagtttactttatgatgatgagttccggaagtatctagaagataaccctgggaattttcgttacgatatagctcttagccgagaggaaaagaataaaaatggcgggaaaatgtacgttcaggataagatcgaagagtatagcgatgagatatttaagttgttggatgaaggggctcatatttatttttgtgggttgaaagggatgatgcccgggattcaagatacacttaagagagttgcggaggggagaggggagaagtgggaagataaactttcggttttgaagaaaaataagcagtggcatgttgaggtttattaggcctgatcgttacgcaggacaggatactgataatgatactgatactgattggactgatagtccagaaaggtgttggtcagttgtgtctggtcttgtactgtgtaagaaatgccagctttttagtatttgtttgagatggatttagagttgtgccctcttttgaggtgggaaaacttgaagaatttgaatttggtgtaacattactttggtatttatattccttggacacgttcctgctttctttgttact

SEQ ID NO: 2322 - DNA, 1572 bp, Aquilegia formosa
ctctgattctcttcttcttactggaaaggaaaggaaaggaaagaaagagaaaaaaatcaaagacagacagacagaaggagaagtaacaaaaactgggaatcatatatcattcattcattcattcatttgattgaatggctcatttggctttaactcaattccagctcgtttcttctccaactgatgcatctctcaaaacatcagttgctggatttaaacaaggattcattaagactcaaagtttaaggtttcaatacccatcagggatccctctgctatcttctgatttgaaatccaggaacctacactcaacaaacaaataccaagtatgtatgtccgtaggacaagccgtaacacccaaagttgctgtttcacctttggaacttgatgatgctatcgaacctcctctcaacacttacaagcccaagggaccttacacagcaaccattgtttcagtggaaagaattgttggcccaaaagctcctggagagacttgccatattgtaatagaccatgatggaaatgttccttactgggaaggacaaagttatggtgttattcctccgggtgaaaatcctaaaaaaccaggtgctccccacaatgtacgtctctactcaattgcatcgaccaggtatggagactccttcgatggcaaaacaggcagtttatgtgttcgccgtgctgtttactatgatccagaaactgggaaagaagatccatcaaagaatggtatttgcagcaattttctttgcaactcaaaaccaggagacaaagtacaaatcacaggaccatctggtaagataatgcttttgcccgaggataatccaaatgccacacacattatgattgctactggaacaggggtggccccgttcagaggttatcttcgtcgcatgttcatggaatctgtcccaaaattcaagtttggtggcctagcatggcttttccttggggtggccaacactgatagcctcctttacgatgatgagttctccaagtatctgcaggactacccagacaacttccgttttgaccgagcactgagcagagagcaaaagaacaagaatggggggaagatgtatgttcaagacaagattgaagagtatagtgacgagatattcaagttattggatgaaggggcacacatatatttttgtgggttgaaggggatgatgcctggaattcaagagacactgaaaagggtggctgatgagagaggtgagaattgggaaacaaagctgtctcagctgaaaaagaacaagcaatggcatgttgaggtgtattgattgattgattgattgaatgaagtaaatctggaggctcctagctactaataatatgtaggtattgggggatattttgggaactcaattgtggagctatttaataaattttaagtttgatacatggaataattggtcatagttattttacttatgtaagctatgtatgtagttgtttgagggaataatggttcaaaggcgttgattgttgtactaaaaggctgggaatgcattatgattccaggcatcaattctggtgtgctctcaagaatatatgttttttccatcc

SEQ ID NO: 2323 - DNA, 1567 bp, Populus trichocarpa
ccagggagagccgagagggcggaaagagagaggcaagaggcaaacccgccccgcccccgccccttgctaccctccaaaggatcactctcactcataaacctgcctcctcagtcaaccatcaactcttcttcacatgcatcatagtataaaaaacatttccaagacctcactaatcactctcttaatctctctgtctttctcgctcaattaatctcatcatctgctgctcatcatggctcatttggctgcactttctcaggtttcctttgctgttcctgctgggagcgataccaccctaaggagatctgcttttaagattcaaaatataagctttggtgataaatcatggcaccctgcctcatctttggatttgaaatcaaggaatactgggttgaaaaaacgattgttggtatgcatgtctgtgcaacaagccagtagatctaaggttgcagtttcacctttaggacttgaagatgccaaggaacccccattgaatacatacaagcccaaggaaccttacacagcaacaattgtctctgtagagaggattgtcggcccaaacgctcctggagagacttgccatgtagtgattgatcatggtggtaatgttccctactgggaaggacagagttatggcgtaataccccctggtgaaaacccaaagaaaccaggggccccccacaatgtacgtctatattcaatagcatctaccaggtatggagattcttttgacggcaagactgctagtttatgtgtccgccgtgctgtctattatgaccctgagactggaaaggaggatccttcgaagagtggagtgtgcagcaatttcctctgcaactcaaagcctggagacaaagttcagatcactggaccttctggcaagataatgcttttacctgaggatgacccaaatgccacccacataatgattgctacgggcactggtgtagctccatttagaggttatctccggcgcatgtttatggaggctgtcccaacatacaagtttggtggtcttgcgtggcttttccttggggtggccaacaatgacagtctcctctatgatgaggaatttgccaaatatcttcaggataacccagaccatttccggtatgacaaggcactcagtagagaacaaaagaacaagagtggaggcaagatgtacgtgcaggataagattgaggaatacagtgatgagatcttcaaacgcttggatgatggagcccacatatatttctgtggactcaaaggaatgatgcctgggatccaagatacgctgaagaaagttgcggaacagagaggagagaagtgggatgaaaagctctcacagcttaaaaagaaaaaacaatggcatgttgaagtgtactgatattgcatatttatgagcatcgagacagcagcagcagtgtggtcctgttaggtactgtggcatttttctgttgttggtcagcatcacatgaacttgattagctgaaaccattcatctgtgctgttaaataatcaaatggattaaaacaaattagaaaccttttgtttggtattgataaatgattcttgtatcctctca

SEQ ID NO: 2324 - DNA, 1965 bp, Prunus persica
  misc_feature (464)..(464): n is a, c, g, or t
  misc_feature (481)..(481): n is a, c, g, or t
  misc_feature (483)..(483): n is a, c, g, or t
  misc_feature (520)..(520): n is a, c, g, or t
  misc_feature (551)..(551): n is a, c, g, or t
  misc_feature (576)..(576): n is a, c, g, or t
  misc_feature (580)..(580): n is a, c, g, or t
  misc_feature (944)..(944): n is a, c, g, or t
  misc_feature (992)..(992): n is a, c, g, or t
  misc_feature (1765)..(1765): n is a, c, g, or t
acaaggcgagcatcgcagtgagagagagaaagtccgaggagccaaggcaaaagcaaaactcgacctttgggacactcggaaggataattttacacaccatttttgcctccaacaactcttcctctgcatgatcttagtcccctaacccctatattaagtccctcgcgtcacctaaagccctctcataccatcctttgatccaatcatgtctcatttggctatctctcagggttcacttactgctcctgttggaagcgatttttctatcagaagatcagtgttcaaggcacaaagcataaactttaatgataaatcatgggcacctcttttatctttggacttgaaaacaaagaatggggggctgagaaatcagcggatagtatgcatgtcagtgcaacaagcaagtgttcctaaagttgctgtatctcctctacaacttgaagatgctaatgagcccccattgnatacatacaagcctaangnaccttatactgcaaccattcgttctgttgagaaggantgtaggcccaaaggctcctggagagacctgncatattgtaatcgatcatggtggtnatgntccctactgggaagggcaaagttatggtgtaattcctcctggtgaaaacccaaagaaacctggggctccacaaaatgttcgtctttactcaattgcatcctcaaggtatggagactattttgatggcaagacgaccagtttgtgtgtccgccgtgctgtctattacgaccctgagacaggaaaggaggatccttccaagaatggtgtgtgcagcaattttttgtgcaactccaaaccaggagataaaattaagatcacagggcctgctggcaagatcatgcttttgcctgaagacaacccaaatgccacccacattatgattgccaccggcactggtgtcgcaccatacagaggttaccttcgncgcatgttcatggaatctgttcccaaattcaagtttggcggccttgcntggctattccttggtgtggccaatactgatagtctcctctatgatgaagagttcaccaagtatctcaaggactaccctgataatttccggtacaacatagcgctaagtagagaacataagaacaatagaggagggaagatgtatgttcaggataaaattgaagagtacagtgatgagatcttcaagctcttggatgatggagcccacatatatttctgtgggctcaggggaatgatgcctgggattcaagaaaccttgaagagggttgccgatggaagaggggagaactgggaggagaagctttcacaactgaaaaagaacaagcaatggcatgtggaagtctattgatatggcatgaagcctcccatgttaggtaaattttcttttggttagccaatcatcagcttttacgtaaggaacttttgagttagcaatagcatattagcattgatatgtatcagcattcagcaaacaaagagacaagcccatcttcgtttggttgaaccaatttgagaaaccctttgattgttgattgattttcatcttttgcctccatttagttttttatttattaatatttttcaatgtaataaccagaaaattcaaaattctggtaaatttgttcaaccgattttattatgaattgcaagcacactgttttcccctcgtgccgaattcggcacgaggcggagatattgcttataggatcactgctgaggcctctgatatcgctgacactgtgtttgctcttctcataccactgtccccagtgntttgcagctgttagctatggctgctcagatgttggctatcagccctttgctatctttgatttcagctgtggtgattccatgtatggctcttatcatcatcagacttggcggtaaactccgtaagatatctaacaaggcccatcttagcattgctgctctctctgcttatctcaatgaggtcctcccagcaattctttttg

SEQ ID NO: 2325 - DNA, 1375 bp, Artemisia annua
atctcacctcatctcacatggctgctgcttctgcacatttgggcgttgcatatcagggctctgttactacccaactcaacaatgataaatcactatttcttaagactcaaaaggttagctttggtgataaaccatgggctcgtttttcaccattggagctaaaatcaaatactacgccatcaagatatcaatccatagtttctatgtcagtgccacaagctgtaagcacacctaaagttgcagtttcacccttagatcttgaggatgcaaaagaacctcccctaaacttacacaagcctaaggagccatatactgctaccattgtgtctgttgaaagactcgtaggcccaaaagctcctggagagacgtgccatattgtgattgatcatggtggtaatattccgtactgggaaggacaaagctatggtgttattccaccgggtgaaaacccaaagaaacctggagctcctcacaatgttcgcctctattcaattgcatccacaaggtacggagattcttttgatgggaaaacagctagtttgtgtgttagacgcgctgtttactatgatcctgagacaggcaaagaagatccatcaaagaatggtgtatgtagtaacttcctctgtgactcaaagcctggagacaaagtcaagatagcaggcccatcaggaaagattatgcttttgccagaagacgacccaaacgccacccacattatgattgctacagggacgggtgtggctccatatagaggctatcttcgtcggatgtttatggaatcagttcccaataagttcaatggtcttgcctggctgttcctaggtgtggcaaacaatgacagccttctgtatgatgacgaattcagcaaatatcttgtggactaccctgataatttcaggtatgaccgagctcttagcagagagcaaaagaacaaaaatggaggcaagatgtatgtccaagataaaatagaagaatacagtgacgagatatttaaattgttggataatggtgcgcatatatatttctgtgggcttaaagggatgatgccaggaatccaagagacattgaaaagggtggctgttgaaagaggggaaagctgggatgaaaaactgtcacagctgaagaagaacaagcagtggcatgttgaagtttattgatggaatagttgaattgattgttggtttcggtttattgtttgaaatcgtttagatacttgagaaaacatgtaatattgtttgaataggttttgcctatttgccagattatctatttcgccaaacaaaataaaagtgcgagaatcatcgattttcgatggtatatcactatatctgttgtggatgattttagatgtgacaatttgcgacacattttcttg

SEQ ID NO: 2326 - DNA, 1346 bp, Orobanche aegyptiaca
tttgacctgaaaccttttgttgaatcgatcatggctcactccgccctttctcaggtccccatttgcgtccctctcaatactgatctctctctccccagattcgtgtttaagaacaataatgtgcctttgcgcggtaaatcattggcattgggcttatcttccgacccaaaaatcgcaaactctcggtccaaaaaccgattcgtggttcgcatgtcggtgcaacaagtcatcaaacccaaagttggaatttcacctttaagcttagaagattcgaaagagccaccgctacacttgttcaagaacaaggaaccatatacagcaactattgtttcagtcgaaaggctcgttggtccgaaggctcctggagaaacgtgtcatatagtaatcgatcatggtggcaatgttccttattgggaaggacaaagctatggagttattcctcctggggagaatcctaaaaagcctggtaatccccacaatgttaggctgtactcaatagcatctagcagatatggagactcttttgatggcaagacagcgagcttatgtgttcgacgtgctgtctattatgacccggagactggtaaagaagacccttcgaaaaacggtgtttgcagcaacttcttgtgtgattcaaagcctggtgacaaagttcagatcacaggtccatccggcaagataatgcttctccccgaagacgatccaaacgcaactcacatcatgatcggcacgggcaccggggtggcccctttcagaggctatctccgtcgcatgttcatggaggcggtccccacattcaagttcaacggtctcgcctggcttttcctcggtgtggccaacaccgacagccttctttacgacgaagaattctccaagtacctgcgggaccgcccggacaacttcaggttcgaccgtgcacttagcagggaacagaagaatcggaacggagggaaaatgtacgtccaggataagatcgaagagtacagcgacgagattttcaaactcctggatgacggggcccacatatatttttgcgggcttaaagggatgatgcccgggatacaagctacgttgaagaaggttgccgagaacagaggagagagttgggatgagaagctttcccagttgaagaagaacaaacagtggcatgttgaggtttattagatctgttggtccattttttatggagataattaattctgtggtttcttaatttatttttacttttttttttgtgttattgtgattggaatagccattgatgatttggatggatgaacacttaagccattgttatctgcaacaaaagtgggaatttgtaatctgattttgtgtgttcataactt

SEQ ID NO: 2327 - DNA, 1679 bp, Gossypium hirsutum
aaggcaaagcaaagaaagaggaagaaaagcgtcttttggcagtcgccaaaggatcatcgttcgaatcatttcattgctcactctcatcgatcaaaaatttatttttaaaaccccactcccatcctttaaatcctaacactagagaagacaactgaaacgcaaagcagagatccccctaaatttgctctcttctcaaagttttttctttcatctctgcttcatggctcagtctactgtatcccaggtttctgtagctgttcccgttggaaacgacatttctctgaggagatctgtaactaacaggaacattataagctttggtaacaagtcatgggcttccaccttggcttttgatttgaaatcacgaaatgcacagaagaacaaaccgtacatagtatgcctgtcagtgcaacaagccagcaaatccaagattgcagtttcacctttggagttggaaattgcaaaagagcccccactaaatacattcaagcccaaggagccttacacagctaccatcgtttctgttgagagacttgtcggtccaaaagctccaggcgagacttgtcatattgtcattgatcatggcggtaatgttccatactgggaagggcagagctatggtgttatccctcctggtgaaaatccaaagaaaccaggttctccccacaatgttcgtctgtattccatagcatcatccaggtatggagattcttttgatggcaagacaaccagtttgtgtgtccgtcgtgctgtctattataaccctgagaccggaaaggaggatccgtcgaaaagtggtgtttgtagcaatttcctatgcaattgtaagcctggagataaagttcagatcactggcccttctggcaagataatgcttttgcctgaagataacccaaaagccaaccacataatgatagccactggaactggtgtagctcccttcagaggctacctccgccgcatgttcatggaagatgttactttcaagttcaaaggccttgcatggcttttcctcggggtggccaacaaggacagtctcctttatgatgatgagtttaccaaatacctcgaggactaccctgatcaattccggtacgatctagctcttagcagagagcaaaagaacaagagtggaggcaagatgtacgttcaggacaagattgaggaatacagtgacgaaattttcaagctcttggacgatggagcccatatatatttctgtgggctcaggggaatgatgcccgggatccaagaaacactgaagagggttgcggagcagagaggagagaactgggatgagaagctttcacagctgaagaagaacaaacaatggcatgtagaagtatattagttttggtttgcgtgatttgaccccacactcctccatgcatgccctatttgaagcagtttaccgtagccatgttaagtcaagctggtatttttcaatttgtttagggggttcacatgtaaacctgatttatcttagttgtcatcttacttttctatgattaaataattgaagctagtttcagactttatgaagaaaacttgagaacattccaacatttatgattagaattagatgttttaaataccatccatccggaattatttccattcttcaagttttactttggaagatagaaataaagtacaaccagcccttgcaagtttgaaat

SEQ ID NO: 2328 - DNA, 1243 bp, Zea mays
aaaacagtgcactgactgagtgagtgtcatccagtgcaagctcccagtcccagtcccagtcccagtcccagggtagtagaggactagaggcaggctagagcaaagcacgcggattgcgtggctagcgcaacaatggcgatggccacggccaagctcgtccttctcatggtcctcgtggccggcagctccagcggcggcagcgcgtgggggccgctgatgagccgcctccggatgccgacggcgcggtcgcccgtcgaggtggcgaaggagcgcctccaggaggactacgtcgtatcggcggctgcgccgctgatccacgcgctgcggccgctgctgggctccgcgggggacctgggccggcgcgccggcgtgccgtgcgacagctggcgcctggccgtggagacgtacaacaagcgcgattggacgacggtgccggccagctgcgagcgctacgtcggccactacatgctcggcggccactaccgccgggactcccgcgtcgtcatcgacgaggccatcgcctacgccgagggcctcaagctgggcggcaacggcaaggaggtctgggtcttcgatatcgacgagacgtccctctccaatctcccctactatgccacccacggcttcggcactaagctatacaacgcgacgagcttcaacgagtacgtgctggaggggagcgcgccggtgctcccggagacgcagcggctgttcaagaagctcgtctcgctgggcatcaagccggtgttcctgacgggccgcaccgaggaccagagggccatcaccgtcaccaacctccgccgccaggggtactccggctggatgacgctgctgctcaagcccgtcggcctcaaggccaccgccatcgcctacaagtccggcgagcgccagaagctccaggacgccgggtacgtcatcgtcggcaacatcggcgaccagtggagcgacatcctcggcgcgccggagggcgcgcgcaccttcaagctgcctgaccccctctactacattggctaagcagcgatgccaacggcgcggcgcggctctccatcagcccatccatcaacccgtcacccggctccagtgcctgtgctcaactactctttgtttgttacccctcacttcttatcatcattaattcctaaggttaattccctgagctgagtggaaataaggccgactcggtggagagctgtcgacttctcaataaataattgctcatgaaaaccacgatggtttatgttat

SEQ ID NO: 2329 - DNA, 930 bp, Solanum phureja
tgttcatttttctcctttgggtattcaattttttgaaattcttggagagttttgtaagtttcttcacttgggttttcttcaaaacacagtctttttcatctctcaatcaaagaaattgctctgaactactactctgtactgcaaaagtgaagaaggcatgggtgttgttcatactctgcattttgtttttgggatatttggaaatgccactgctctgtttctgttcttggcaccaataatcacattcaagagggttattcaaaatcgatccactgaacaattttctggcttgccttatgttatgactttactcaactgcctgctttctgcatggtatggtttaccatttgtgtcaccaaataatctgttggtgtctacaatcaatgggactggagctgtaattgagaccatttatgtgctgatcttcattgcatttgcaccaagtaaagagaagaagaaaatctcagcacttcttctattagtccttactgtttttgctgctgtagcccttgtttccatgctcgctttacatggaagcaaaaggaagctcttttgtggtatcgctgccacgatcttctctatcattatgtatggatctcctctatccatcataagattggtaatcaagacgaagagtgtggagttcatgccatttttcttgtcgttgttcgtgttcttatgtggcgcttcctggtttgcctttggccttcttgggaaggacccttttgttgctattccaaatggttttggctttggtttaggaacagtgcaacttatcttatatgcaatctactgtgagaagaagggatttaccaagaaatcaacctttgatgagtcgttgacgacgggaaatgtcaagtctcaccaagaggagaagcaatctagcaacaataacaagtcaaagcttgagcaagtttaggatatgattgc

SEQ ID NO: 2330 - DNA, 1024 bp, Theobroma cacao
ccctcctcctctctctcctttcaaatctccctcttcatcatcaaagcaaaagaggaaccccagaaatatagaagcccaagatgtctcttacaatcccaactaatctctcaaaaccgcttttgaagccaaagctaaactcccaggttacccccaaagtttcaagatcgttggtggtgtgctcaagcactccatcctcagacaagagttcgacatcaccctcggcttcgccgctccaagccttctcagctgctcttgctctttcttccattcttctttcagctccacagcctgctgtagctgacatttcagggctcaccccatgcaaggagtccaagcagttcgccaaacgtgaaaagcagcagatcaagaagctcgagtcatcgttgaatctttacgcccctgacagcgctccagctctggctatcaaagcaaccatcgagaaaaccaagagaaggttcgacaactatgggaaatacgggctgctttgtggctctgatgggttgcctcatttgatagtgaacggtgaccagaggcactggggtgagttcatcacaccaggccttttgttcttgtacatcgctggatggatcgggtgggttggaagaagctacctcattgctataagggatgacaagaagccagccatgaaggagatcatcatcgatgtgcctttggctagcagtctgctctttagaggcttcatctggcctgtcgcagcctacagagaccttgtcaatggtgacctgattgccaaggacgtgtaatctcctcagagattgaatggaacgaacactgggatggtacggaagacggtgtgctttagactgaatattgtttgtggaagggaggcatcttgggaaatttcttgtacttaaaatgtaaatttttttcttactcgagtgaatgcaatgctagtgttaaacatttggagctcatcagctttccatttcaatcttttgttatccaaagtcatgtgactatatgttatataaatatctccttgtaaacagcaatcttagaattc

SEQ ID NO: 2331 - DNA, 1037 bp, Theobroma cacao
  misc_feature (834)..(834): n is a, c, g, or t
cggggcctttcaaatctccctcttcatcatcaaagcaaaagaggaaccccagaaatatagaagcccaagatgtctcttacaatcccaactaatctctcaaaaccgcttttgaagccaaagctaaactcccaggttacccccaaagtttcaagatcgttggtggtgtgctcaagcactccatcctcagacaagagttcgacatcaccctcggcttcgccgctccaagccttctcagctgctcttgctctttcttccattcttctttcagctccacagcctgctgtagctgacatttcagggctcaccccatgcaaggagtccaagcagttcgccaaacgtgaaaagcagcagatcaagaagctcgagtcatcgttgaatctttacgcccctgacagcgctccagctctggctatcaaagcaaccatcgagaaaaccaagagaaggttcgacaactatgggaaatacgggctgctttgtggctctgatgggttgcctcatttgatagtgaacggtgaccagaggcactggggtgagttcatcacaccaggccttttgttcttgtacatcgctggatggatcgggtgggttggaagaagctacctcattgctataagggatgacaagaagccagccatgaaggagatcatcatcgatgtgcctttggctagcagtctgctctttagaggcttcatctggcctgtcgcagcctacagagaccttgtcaatggtgacctgattgccaaggacgtgtaatctcctcagagattgaatggaacgaacactgggatggtacggaagacggtgtgctttagactgaatattgtttgtggaagngaggcatcttgggaaatttcttgtacttaaaatgtaaatttttttcttactcgagtgaatgcaatgctagtgttaaacatttggagctcatcagctttccatttcaatcttttgttatccaaagtcatgtgactatatgttatataaatatctccttgtaaacagcaatcttagaattcgatgtgctcttgtactatcagttg

SEQ ID NO: 2332 - DNA, 1055 bp, Populus trichocarpa
ccaagaatctaaaaaccatctctccacactctcccttcaatcctccttccttgtttcaactatcttttctttccgatttaacactagattgtaagaaaggaaggaaaaaaaccctaaggcaaaaatgtctcttactataccaagcaacctctccatgttgaagccaaaacttggggtctctcaaatgaccccaataaaaccaagatccatgattgtatgttcagcgtcacaaacaccatcaacacaagagaaatcatcatcaccactccaagcattctctgctgcacttgcactctcttccatcctcttatcagccccgcttcctgctgttgctgatatctctggcctaaccccatgcaaagattccaaacaatttgccaagcgtgagaaacagcagattaaaaagctagaatcttctctaaaactttattcaccagatagtgcacctgctttggctatcaaagctactgtcgagaagacaaaaagaaggtttgacaactatgggaagcaagggttgctatgtggctcagatgggctacctcacttgattgtgagtggtgaccaaaggcactggggtgagtttatcacaccagggattttgttcttgtacattgctggatggattggatgggttggtaggagttacttgattgctataagtgacgagaagaagccagcaatgaaggagatcattattgacgtgcctttggctactggtttgatctttagaggtttttcttggcctgttgctgcctacagagagtttgtcaacggtgatcttgttgtcaaggatgtttagatcaccgcccagatatatttgagggtctggctaaggaaaggagtgcaggagtggtgcattgcttgggatcgtgtgttgacgaggatggggaggtttcttgtgttttatttctgaacatttacttgtatgtatcgaatgcttatgttggacactgcgaaaatctcaagacaatgtttttttttcttgtgtggtaagaagttgactaatttatcaaaacttattttctataatactattaaacattaaaaaacaaaaa

SEQ ID NO: 2333 - DNA, 1097 bp, Quercus alba
ccttcaaagaatctaaaaaccttctctccacaccctttgcttcactcttcatcatcaactccttcccatttcccactcaacaaacacttccatagagacataaccaaaacaaacatgtctctaaccatccccacgaatctctcaaaacccattttgaagccaaagttgagctcttcacccatcccgaaatcaaggcctacgattgtatgcagctcccaaaacagcaaccaagatgagcaaaacacaacttcaccattgaaggccttctcagctgcactagctctctcttccattcttgtctcagccccagtactcccagccaatgctgacatcgcgggtctaaccccatgcaaagagtccaagcaattcgccaaacgtgaaaagcaacaaatcaaaaagcttgagtcctcattgaagctttacgcacccgacagtgcaccagctctggctatcaaagcctcagtagaaaagacaaagcgtaggttcgacaattatggaaaacagggtttgctttgtgggtctgacgggcttcctcatttgattgtgagcggtgaccagaggcactggggtgagttcatcactcctgggattctgttcctgtacattgctgggtggatcgggtgggtgggtcggagctacctgattgctataagggatgagaagaagccaacccagaaggagatcatcattgatgtgcctttggcttcgagtttgcttttcaggggtttcatttggcctgtggctgcttacagagagttggtgaatggtgatcttgttgtcaaggatgtctaaattcatcgtttcagtagcatgggatgaagagacgcagtagagggaggtggagtgcttgtcttgggaatttgtttgaaggagaggagtggtggaatatttcttgtatttaacttgtaaaatgttacttcattttatgagatattgcttgtgctggacattttaaactaatcttctttacatttttagccagtgtaatcaacaccaatgccaaatatcccactgaaccagcccgaacggcctaagtgttcattgtttaatttcttcacacgccttctgttttgtatgtgttgatcggttgagacaat

SEQ ID NO: 2334 - DNA, 1174 bp, Quercus alba
aactcagccttcttactccatccgccttatccaccctcttcttcttccctccaccaccaatctctcctaatccttcaaagaatctaaaaaccttctctccacaccctttgcttcactcttcatcatcaactccttcccatttcccactcaacaaacacttccatagagacataaccaaaacaaacatgtctctaaccatccccacgaatctctcaaaacccattttgaagccaaagttgagctcttcacccatcccgaaatcaaggcctacgattgtatgcagctcccaaaacagcaaccaagatgagcaaaacacaacttcaccattgaaggccttctcagctgcactagctctctcttccattcttgtctcagccccagtactcccagccaatgctgacatcgcgggtctaaccccatgcaaagagtccaagcaattcgccaaacgtgaaaagcaacaaatcaaaaagcttgagtcctcattgaagctttacgcacccgacagtgcaccagctctggctatcaaagcctcagtagaaaagacaaagcgtaggttcgacaattatggaaaacagggtttgctttgtgggtctgacgggcttcctcatttgattgtgagcggtgaccagaggcactggggtgagttcatcactcctgggattctgttcctgtacattgctgggtggatcgggtgggtgggtcggagctacctgattgctataagggatgagaagaagccaacccagaaggagatcatcattgatgtgcctttggcttcgagtttgcttttcaggggtttcatttggcctgtggctgcttacagagagttggtgaatggtgatcttgttgtcaaggatgtctaaattcatcgtttcagtagcatgggatgaagagacgcagtagagggaggtggagtgcttgtcttgggaatttgtttgaaggagaggagtggtggaatatttcttgtatttaacttgtaaaatgttacttcattttatgagatattgcttgtgctggacattttaaactaatcttctttacatttttagccagtgtaatcaacaccaatgccaaatatcccactgaaccagcccgaacggcctaagtgttcattgtttaatttcttcacacgccttctgttttgtatgtgttgattggttgagacaatggaaaa

SEQ ID NO: 2335 - DNA, 883 bp, Carica papaya
tcttccttcctctccccaaatccttctgaaacaattcatcagaaatcaacaatgtctctcacaattccttcaaatctctctaaacccattttgaaacccaggttaaactccccaaccaaacaacttagaccctccattgtttgctcctcctctggaacaacccaagagaaaacatcctctacatcgccgcttcaggctttctcagctgctctcgcactctcctccatcctcctctccgctcctcttcccgccgtcgccgacatctccggactcaccccatgcaaggagtcaaaacagttcgccaagcgcgagaagcagcagctcaagaaactcgagtcgtcgctaaagctatacgcacccgacagtgctccggctttggcaattaacgcgacgatcgagaagacgaagaggaggttcgataattatggaaagcaaggtttgctgtgcggatctgatggattaccgcacctgattgtgaacggagaccagagacactggggcgagttcataactcctggtattttgttcctgtacattgcgggttggatcgggtgggtgggtcggagctacctgattgcgattagcgatgacaagaagccagcgatgaaggagatcatcattgatgtgcctttggcttcgaggttgctcttcaggggatttagctggcctgttgcggcatacagagagttcgtcaatggcgatcttgttgtcaaggatgtttaaactctgaaaaatgggtggaaggaaggatttgggtgaggaagaagcgagaagagatggaagtagttgaagagggggatttgttgtatgttaaatatgtaaaagtgtatattttgtttcagacactaatttaattaagataagttgaaaaaaataactgttt

SEQ ID NO: 2336 - DNA, 946 bp, Manihot esculenta
caattctgcacactcttccaatatctctttctcttttttctttactgtaagaaaaccaagaaatcaattagaggaaaaatgtctcttacaatacctgccaatctctcaaaacccatgttgaagccaaagcttggctctccattgaatccatcaaagttatcttcttcatcaagagccacagttgtatgctctgctgctcaaaccccagagaaagactcctctaaatcaccactccaagctttctcggctgcgcttgctctctcttccatcctcttatccgccccactccccgccgttgctgacatctccggactcaccccgtgcaaagaatccaagcagttcgctaaacgtgaaaagcaacaaatcaagaagctggaaagttctctaaaactgtatgctcctgatagtgcacctgctttggcaatcaaggctacggtagagaagacgaaacgtagattcgacaactatgggaagcagggattgctatgtggggctgatgggcttcctcatttgattgtgagcggcgaccagagacactggggtgagtttatcactccagggatcctgttcttgtacattgcagggtggatcgggtgggttggcaggagttatttgattgctataagaggtgagaagaagcctgcaatgaaggagatcatcatcgatgttcctttggctactggtttgattttcagaggattttcttggcctgtcgctgcttatagagagtttgttaatggtgaactcgtggtcaaggatgtttaactctgtctattttaagagtaagacctcaggggccaaagggttatgaagagcacttcgttgcttttggagagagttgatgagtggtgagagatttcatggaagatttctcttattttacttgtaaacatttacattatgtgtaactaatgcttgtgttgaaagccagaaattgattgccact

SEQ ID NO: 2337 - DNA, 838 bp, Linum usitatissimum
gaagcagaagaacaacaaacacttccaagttccaaatcagtcttctctgaagaagcaacaaaaagagaagaaaaaccaaccatgtctctcacaatcccaaccaacctctcaaacccactcctaaagctcaacacaaaactaaccccaaaaccccaatcccgatccctaatcgtctgctccgcctcctccaatgacaactccaccaccaccgccaccccactcaaggccttctccgccgccttagccctctcctcaatcctcctcacctccgccccactcccagcaaccgccgacatcgccggactcaccccgtgcaaagactccaaacaattcgccaaacgagagaagcaatccttgaaaaaactggaatcctccctcaaaatctacgcccccgacagcgcccccgccctagcaatcaaggccaccatggagaagactaagcgccggttcgccaactacgccaagcaaggattgctctgcggatccgatgggctgccgcacttgatcgtgagcggcgaccagaaacattggggtgagttcatcactccggggattctgtttctgtacattgctgggtggatcgggtgggttgggaggagctacctgattgcgatcagcggggagaagaagccggctatgaaggagattatcatcgatgttccgttggctactgggattatctttaggggattctcctggcctattgctgcttacagagagttgattaatggtgatcttgttgtcaaggatgtttgaattcaggaaaaattgtaaggagatgagtaatggttgcttttgattttggaaggtgcttgtaattactttttatgatcggatt

SEQ ID NO: 2338 - DNA, 898 bp, Linum usitatissimum
gactccaagaaaaaagaagaagaagaaacacttcccaagttccaaatcagtcttcccagaagaaaaagaaaagagaagaaaaccccaaccatgtctctcacaatcccaaacaacctctccaacccactcctaaagctcaacacaaagctcaccccaaaaccccaatcccgatccctaatcgtctgctccgcctcctccaatgactccaccaccaccgccaccccactcaaggccttctccgccgccttagccctctcctcaatcctcctcacctccgccccactcccagcaaccgccgacatcgccggactcacaccgtgcaaggattccaagcaattcgccaaacgagaaaaacaatccctcaaaaaactcgaatcctccctaaaaatctacgccccggacagcgcccccgcactagcaatcaaggccaccatggagaagaccaagcgccggttcaccaactacgcaaagcagggtctgctctgtggctccgatgggctgccacacttgatcgtgagcggcgaccagaagcattggggggagttcatcactccagggatcctgttcctctacatcgccgggtggatcgggtgggttgggaggagctacctgattgcgatcagcggggagaagaagcccgccatgaaggagattatcatcgatgttcctttggctactgggatcatctttagggggttctcctggccgattgctgcctacagagagttgatcaatggtgatcttgttgttaaggatgtctgaatacacgacaaaatttgttaggagctgatcattggggtttgcttttgattttggaaggtgtatgtaattactcttatgatcggattaaagattgtgttgttgtctgaatttacaatgcctgattctcgctttctgt

SEQ ID NO: 2339 - DNA, 1107 bp, Tropaeolum majus
cggccggggaatgatctcattatctaaaagtttttggtattgagatagaaagagaatctatagccccaacaacaaaacttttctaaccaatcataatcatccaactcagcttcccttatttcctttcccttatccttccttacatccactaatcccttcttcactgaacctaaaaaaaccatcatctccttctttctcctttcaattttcatccaccccccaaaaaaagaagaacagaatcaaagattttcaaaaatgtctctcacaattcctgcaaatctctcaaaatcaatcctgaaaccaaaattaaactctcaattgagccataaacatggaaaaccaatgatcatatgctgtcaaaaccagagccaagacaaaccctcatccacatcaccactccagggattcacagctgcactcgctctctcctccatccttctctccgctccactccccgccgtcgcggacatctccggtctgactccatgcaaggactcgaagcaattcgcgaagcgcgagaagcagcagatcaagaagctcgaatcgtcgcttaagctgtacgctcccgacagtgcgccggctttggcgatcaatgcgacgatcgagaagacgaagaggagattcgataactacgggaaacaagggttgctttgtggagctgatggattgcctcatttgattgtgagcggagatcaaagacactggggtgagttcatcacaccggggattctgttcttgtacatcgcaggatggatcgggtgggttggtaggagctatttgattgcgattagcggtgagaagaaaccggcgatgaaggagatcatcattgatgttcctttggcttctaagttggtatttaggggattcagttggcctgttgctgcttacagagaatttctgaatggtgaacttattgccaaggatgtctaatcttcctctcagaattcaggaaatatgagagcattgtcttggggatgggggagaagaaaattgcttttgtatttgtatattgagaagtttgtgttggtggataattgtaatgtttgtttgaacagtaaccaagaccattctcctctctactctcatgttaaaaactcaatgataaca

SEQ ID NO: 2340 - DNA, 1038 bp, Bruguiera gymnorhiza
gcagaaggagaagaagaaggaagaggaagaggaagaggaagagaattacagaagaaaacccaagaggagcaaagaatgtctcttacaatacctatcaccaacctctccaagacactgttggcgccaaaacttggctcaccgacaaaatcatcgaggacctccgtctccacgaacgttgttgtttgctcggcatcaacccaagagaaggagaaggagaacgcgtcctccgcatccccactcccagcattctctgctgcactcgccctctcctccatactcttatcggccccactccccgcagtcgccgacatctcgggcctgacaccctgcaaagagtcgaagcagttcgccaagcgagaaaagcagcagatcaagaagttggaatcttccctcaagctgtatgctcccgacagcgccccggcgctggccattcaggcatcgatcgagaagacaaagcgccggttcgagaactacgggaaccaaggcttgctgtgtggctcggatgggctgccccatctgatcgtgagtggggaccaaaggcactggggggagttcatcactccggggatcttgttcctgtacattgccggctggatcggctgggttggtcggagctatttgattgccataagggatgagaagaagcctgctatgaaggaaatcattattgacgtgccattgccctccaggttgatcttcagaggcttctcttggcctgttgctgcttacagagagtttgtcaatggtgatcttgttgtcaaggacgtttaatctcttctacagccccaggtccagagttaccggaagaggagagggcaaggagacaaaagtgtagggttggctctagagtgcttcttcacttgggggactgtatcgtggggaggggactggtccaagagctcttttatgtgtttttgcaaaaaatgtgcctgtctgtactgtaatcatggcccttgctgttaagccctctgaattttgaattatcttttgccctttgaaagaagaggaaaagaatttttaaagggtttaagatagatt

SEQ ID NO: 2341 - DNA, 927 bp, Prunus persica
tcctccgagaatctaaaaacctgccctccacactatcccctccagatcttctccttcctctctgttcctcatcacaatcccataacccaaagaaaaatagagaggaaaaaaaacagaaaaaaaaaaaatgtctctcacaattcccacaaacctctcaaaacccatgttgaagccaaaattcagctccccattggccacaaaactgccaaggaccgtggtcttctgctcagcctctcaaactccaaaccctaccccagagaaaatatccactgcatcaccaatgcaggctttctctgctgcacttgccctgtcctccatcctcctgggctcagctcccatgcctgcagttgcagacatcgcaggcctcaccccatgcaaagactccaagcagtttgccaaacgtgagaagcagcagatcaagaagcttgagtcttcactgaagctctatgcacctgacagtgcaccagccctggccatcaacgccaccatagagaagactcagaggaggtttgccaactatggcaagcagggtttgctctgtggctctgatgggcttccccatttgattgtcagcggtgaccagaggcactggggtgagtttatcacccccggcattctgttcctgtacattgctgggtggattgggtgggttggcaggagctacttgattgccatcagggatgacaagaagccaacgcagaaggagatcatcattgatgtgcctttggccactagcttggttttcagaggcttcatctggcctgtggctgcttacagagagctcgtgaacggtgaacttattgccaaggacgtttaagcttttgggttggcttttatttgttctgaatttcttgtataatttgtaaaattttacttggaattattatatgtaccaaatgcttgtgtttcaaactgatccgcttaaca

SEQ ID NO: 2342 - DNA, 1157 bp, Cicer arietinum
attcctccaatttcacaaaaatgtctcttacaattccaactaacctctccaaacccatcacaaccctaagacccaaactcacccaaaaacctaaacattcatccaccataatccactgcagcacaaatcaagaatcaaattcaaattcaaattcaaatctaaaagcattctcagcagctttagcactctcatcaatcctaatctcatcaccactccctgcaacagccgatatctccggcctaacaccatgcaaagaatcaaaacaattcgcgaaacgcgaaaaacaacaaataaaaaaactggaatcatcactgaaactgtacggtccagatagcgctccggcgctagcgataaaagcgacggttgagaaaacgaagagaaggttcgagaactatgggaaacagggtttgttgtgtggtgcggatgggttaccgcatttgatagtgagcggagatcagagacattggggtgagtttattacgcctggggttttgttcctgtacatcgcgggttggattggatgggtgggtcgtagttacttgattgctattagagatgaaaagaaacccactcagaaagagattattattgatgttccacttgcttctagattggtttttagaggcttcagttggcctattgctgcttatagagagttcttgaatggtgaactcattgccaaggatgtttagtttctttttttccttcccacaacaagacaacaaaggatgatactggtcatagatgaaggaagggtgcttttattgttcacttatgttgatctttgggatacaatatttatttatgcgcttatattgtaaatttgaattagttaatgtaatgtgtgtgaaccgcaatcagactgatatgagtttttgttcgtttgtcacttcaatgtgaactgtatagtttttttttttttttttttagtaaatgaagttgattagttaacttaaaaaaaaaaaaaaaaaccttatggtggatacctaggcacccagagacgaggaagggcgtagaaagcgacgaaatgcttcggggagttgaaaataagcatagatccgaggattcccgaataggtcaacctttcgaactgctgctgaattcacaggcaggcaagagacaacctggcgaactgaaacatcttagtagccagagga

SEQ ID NO: 2343 - DNA, 1616 bp, Theobroma cacao
cattcaatacaagctctgagctttctctctttctcactctctccctttgcttgtttgtgtggtcgtacgtttcggtcttttcgtccacatggctgtggaaacgccgaaccacacgcaaacggtaggagggtgggcggcttatgattcctctggcaagatcgccccttacatcttcaaacgaagggagaatggcgtgaacgatgtgaccattaaagttttgtattgtgggatctgccacactgatctccatcacgttaagaacgactggggcatcaccatgtatcctgttgttcctgggcatgaaattactggggtgatcaccaaggtgggaagcaatgtcaagaatttcaaagtaggagacagggtaggggttgggtgcttggcagcatcctgtttggaatgtgagttctgtaaaagctcgcaggagaactactgtgaccagatccagttcacctacaatggcattttctgggatggtagcattacttatggtggatattccaaaatgttagtcgcagatcacaggtacgtggtccgtgtgccagataacctgccaatggatgcagcagcgcccctgttgtgcgcggggatcaccgtctttagccccatgaaagatagccaactacttgagtcaccagggaaaatggtgggaatagttggtctgggcggtcttggtcatgttgctgtcaaaatggcaaaggcatttggtcatcacgtaaccgtcatcagcacctctccatcaaaagaaaaggaggctagacagcgcttgggcgcagatggtttcatagttagcactaatgcagaacaaatgcagagaggtaagagaacgctagatgttatcttggacacagtttcagccaaacactcgctaggaccgattttggaactactcaaagtaaatgggactttagtggttgtgggggcaccagacaggccaatggatcttccttcttttccattaatattcgggaagagagcagtgaaggggagcatgacaggcggcatgaaagagacccaagaaatgatggatgtgtgtggcaagcacaacatcacatgcgatgtagaactcatcgagccagatcaaatcaatgaagccctggatcgccttgcgagaaacgatgttagataccgttttgtaatcgacattgctggaaggtctaagctttaaagattcaggatcactggtcttctgacctcttcctttggcaagcgacgcctacaattgtcaatcaccaccagctgtttaatgctcatcttcacgaaatgcttgctttgtaacgtttggtagtattataatttctttgtttgcttttagtattatttcgggcaaactagaagaatctatccttgtaaaatcaggcttgagcattttggcatgctatgcaaagtccaatcgatgagctgaaatgaacaggcaacccaccagaaatatttgaacccggaatgtcttctaggacttctttggcttcttcaatcgtactcacgcagttcattatttatacatgcacaagaacaaaagctacaagaacccaccatttcccacaccatcgtatctcttggcctatcaatgaccaagctacaaaataacccacttggaataattaatcaaatttctt

SEQ ID NO: 2344 - DNA, 1104 bp, Manihot esculenta
tacctctgaatctttaactcatggctcaaacaactccaaatcacacacagactgtttctggctgggcagctcacgattcctccggcaagatcactccttacatcttcaaacgaagagagaacggtgtcaatgatgtgacgataaagatcatgtattgtgggatatgccacacagatctccaccatgcgaggaacgattggggcattaccatgtttcctgtggttcctgggcatgaaattacaggactaatcaccaaggtgggaagcaatgtgaagaacttcaaggtgggagacagagttggagttgggtgcttagcagcttcttgcttggagtgtgagttctgcaagagctctcaagagaattactgtgaccaaatacagtttacttacaatggcattttctgggatggaagtatcacctatggtggctattcagaaatgttggttgcagatcataggtatgtggtgcacataccagacaacctggcaatggatgcagcagcgccactgctctgcgcaggaattactgtattttgccccatgaaagacaacgacctgctaaagtctccagggaaaagaataggtatagttggcttaggggggcttggacatgtagctgtgaagtttggcaaggcatttggtcaccatgtaactgtgattagtacctctccatctaaagaaagggaggccagagaacgtttgggggcagatggtttcatagtcagcacaagtcccaagcaaatgcaggcaggaaagagaagtctggatcttatcctggacacagtgtcagctaagcattcccttgggccaatcttggagttgcttaaagtgaatgggacattggtggttgtgggtgcaccagacaagcctattgacctaccttctttccctctgatatttgggaagagaacggtgaaaggaagcatgacaggaggaatgagagagacgcaagaaatgatggatgtgtgtggcaaatataacatcacctgcgacattgaggttgtgaaaccacacaagatcaatgaagccttccaacgactcgcacgaaacgatgttagataccgttttgtaattgacattgcaggaaactcttcacttctttaat

SEQ ID NO: 2345 - DNA, 1364 bp, Ricinus communis
aagcaacctcctttcaactttcagatctgttctttttcctctcctttctgtctagtcatgactcaaacaactccaaaccatacccaaactgtttctggctgggcagctcacgattcttctgggaagatcactccttacattttcaaaagaagagagaatggcataaacgatgtaaccataaagatcttgtactgtgggatctgccacactgatatccaccatgccaagaacgactggggcatcactatttaccctgttgtcccagggcatgagattactgggatcattacaaaagttggaagcaatgtaaagaacttcaaagtgggagacagggctggagttggatgcttggcagcttcttgcttgaattgtgagttctgcaacaatgatcaggaaaattattgcgaccagatacagttgacatataatggcattttctgggatggtagcatcacctatggtggctactctgagttcttggttgcagatcacaggtatgtggtgcatataccagaaagcctgccgatggatgcagcagcgcccttgctctgcgctggaatcactgtatttagccccatgaaagacaacaaactgctggattctccgggtaaaaagatagggatagttggtctagggggtcttggacatgtagcagtaaagtttggcaaggcatttggtcaccatgtcactgtcattagtacctctccatctaaagaaaaagaggcgaaagaacgtttgggcgcagatgatttcatagttagcaccaatcctgaacaaatgcaggaagggaagaagacattagatcttatattggatacagtatcagctaatcactcccttgggccaatcttggaattgctcaaagtgaatgggacattggtggcagtaggtgcaccagaaaagccatttgagctgccttctttccctttgatatttggcaagagatcagtgaaagggagcatgacaggaggaataaaagaaacacaagaaatgatggatgtttgtggcaagcacaacatcacttgcgacattgaggttgttaaaccagacaaaatcaatgaatccttagatcgacttgcaagaaatgatgttagataccgatttgtcattgacattgcaggaaactttaacccatcacatctttagagaagcaagagtagtcttggttctcatctacctatcttctagttcactttgcaggaaactttaacccctcacatctttagacaaacagagtagtcttggttctcatctacctatcttctagttcactttgttgtctcattcaagtctcagtaaactatttatctacttctgtgtatctcttaagagattaataaacaaacaaataacttttgattgaa

SEQ ID NO: 2346 - DNA, 1305 bp, Vitis vinifera
ggcacaagctcaaagaaaggggtaaacccacatctcaagcccctgttctttctttccatacatagatatatggctcagacaaccccgaatcacacacagactgtttctgggtgggcagctcatgattcctccggcaagatcaccccgtacgtcttcaagagaagagaaaacggccccaatgatgttaccattgaaatcttgtactgtgggatatgccacactgatctccaccatgtccggaatgactggggcatcaccatgtatccggttgtccccgggcatgaaattactggggttgtcaccaaggtaggaaccaacgtgacaaggttcaaaacaggggacagggtaggagtaggatgcttggcggcatcatgtttggagtgtgagttctgcaagagctctcaggagaactactgtgatcagattcagtttacctacaatggtattttctgggatggtagcatcacctatggtggatactccagaatgttggttgcagatcagaggtatgtggttcgggtgccggagaatttgccaatggatgcagtggctccaatgttatgtgcgggaataacagtgtacagccccatgaaagacaccaagatgctagagtcaccggggaagaagctaggaataatcggtttgggaggactgggtcatgttgcagttaaatttgcaaaggcttttggcctccatgtgaccatcatcagcacctctccctcaaaagagaaagaggcgaaagagcgcctgggtgcagaccatttcatagttagcaccaaccccaaacaaatgcaggcagggaagaggagcctggacttcatactggacacagtgtctgcgaaccactccctggggcactacttggaactgctgaaggtgaacgggacaatggtgatcgtgggcgcaccagagaagcccatggagctgccgtctttccctctgatattcgggaagagaacggtgaagggaagcatgacaggagggatgaacgagacgcaggagatgatggatgtgtgtggaaagcacaacatcacatgtgatattgaggtggtgaaaccagaccagattaatgaagccctcgagcgccttgcaaacaatgatgttcggtatcgtttcgtcatcgatattgctggccagtctccaaatctttagagatatgcggcacttggccttaccttaatttatgtcattgtacaacaacccatgggttgcaattatggcagctgaacctgcctaaatttgagaccaaaccaaacagttgcccaatttgtttttcagtttcccatctatcattttttattccta

SEQ ID NO: 2347 - DNA, 1451 bp, Citrus sinensis
attattttgaaagcaacagaagcctgtcctctctttatatcccaaccaaatatggccacacacattcatatgtagatgtatatcttaaaacagaagcaggaagacatatataatttccaatcctgagttctcaccatctctcgatctaattccggttcgcatggctcaaacaactccaaatcacacacagagcgttgttggttgggccgctcatgatccctccggcaagattactccttatatcttcaagcgaagggagaatggtgtgaatgacgtgaccataaaaatcttgtactgtggaatttgccacaccgacatccatcatgtcaaaaacgactggggaatcaccatgtatcccgttgttccaggacatgaaataactgggataataaccaaggtcggaagcaatgtgaagaatttcaaggtgggagatagggctgcagttgggtgcttggcggcggcgtgtatggagtgtgagttctgcaaagactcgcaagaaaactactgtgacaaaattcagttcacctataatggcattttttgggatgggagcatcacttacggtggctactctgaaatgttggttgctgattacaggttcgtggtgcacgtaccggagaacatagcaatggatgcagcagcaccgctactgtgtgcgggaatcacggtgttctgccccatgaaagacaataatttgatagactcaccggcgaagaagaggattggaatcgtgggtctaggaggtctgggacacgtggcagttaaatttggcaaggcctttggtcatcacgtgaccgtcatcagcacatctccgtccaaagagaaagaggctaaagagctcttgggtgcagatgagttcatactcagcaccaatgctatgcaaatgcaggcgggcaagagaaccctagattttatactggacacagtatcagctaagcactcacttgggccaatcttggaattgctcaaagtaaatggaactttgtcggtcgtgggtgcaccagaagccccttttgaactgccttctttcccactgatatttgggaagagaagtgtgaagggaagcatgacaggaggaatgagagagacacaagagatgatgaatgtgtgtggcaagtacaatattacatgcaacattgaagtcatcaaaccagaccaaatcaacgaagcattagaccgccttgcaagaaatgatgttagatatcgttttgtaatcgacattgccggcggcgccagggagtaagccactcgataaccttaatttattaattaaagacatacgtacgtatatgcatgtgccttgatttggcactttaatttgccatatattgagtatccttttatttgaaaattaagcaatgaattggtttgtaaattgtagttaagcagtgttttcagtttgttgagctatgtttcacgttgactaataaatgggaggtacttgagtttat

SEQ ID NO: 2348 - DNA, 1451 bp, Citrus clementina
attattttgaaagcaacagaagcctgtcctctctttatatcccaaccaaatatggccacacacattcatatgtagatgtatatcttaaaacagaaacaggaagacatatataatttccaatcctgagttctcaccatctctcgatctaattccggttcgcatggctcaaacaactccaaatcacacacagagcgttgttggttgggccgctcatgatccctccggcaagattactccttatatcttcaagcgaagggagaatggtgtgaatgacgtgaccataaaaatcttgtactgtggaatttgccacaccgacatccatcatatcaaaaacgactggggaatcaccatgtatcccgttgttccaggacatgaaataactgggataataaccaaggtcggaagcaatgtgaagaatttcaaggtgggagatagggctgcagttgggtgcttggcggcggcgtgtatggagtgtgagttctgcaaagactcgcaagaaaactactgtgacaaaatccagttcacctataatggcattttttgggatgggagcatcacttacggtggctactctgaaatgttggttgctgattacaggttcgtggtgcacgtaccggagaacatagcaatggacgcagcagcaccgctactgtgtgcgggaatcacggtgttctgccccatgaaagacaataatttgatagactcaccggcgaagaagaggattggaatcgtgggtctaggaggtctgggacacgtggcagttaaatttggcaaggcctttggtcatcacgtgaccgtcatcagcacatctccgtccaaagagaaagaggctaaagagctcttgggtgcagatgagttcatactcagcaccaatgctatgcaaatgcaggcgggcaagagaaccctagattttatactggacacagtgtcagctaagcactcacttgggccaatcttggaattgctcgaagtaaatggaactttgtcggtcgtgggtgcaccagaagccccttttgaactgccttctttcccactgatatttgggaagagaagtgtgaagggaagcatgacaggaggaatgagagagacacaagagatgatgaatgtgtgtggcaagtacaatattacatgcaacattgaagtcatcaaaccagaccaaatcaacgaagcattagaccgccttgcaagaaatgatgttagatatcgtttcgtaatcgacattgccggcggcgccagggagtaagccactcgataaccttaatttattaattaaagacatacgtacgtatatgcatgtgccttgatttggcactttaatttgccatatattgagtatccttttatttgaaaattaagcaatgaattggtttgtaaattgtagttaagcagtgttttcagtttgttgagttatgtttcacattgactaataaatgggaggtacttgagtttat

SEQ ID NO: 2349 - DNA, 1351 bp, Camellia sinensis
ggaaccaagttgctgtagcctatacgctatacattcaaggaatcaaccatcccaactccctctctctctctctctctctctcatggctcaaacaactccaaaccacacacaaactgtttctggctgggcagcccatgattcctctggcaagatcaccccttacaccttcaaaagaagagaaaatggcatcaacgatgtgaccatcgatatcttgtactgtggtatatgccatactgatcttcaccacgttcgcaacgattggggcatcaccatgtaccctgttgtccccgggcatgaaataacagggttgataagcaaggtgggaagcaatgtgagcaagttcaagataggggacagggtgggcgtgggatgcttggcggcgtcgtgtttggaatgcgagttctgcaaggactcgcaggagaactactgtgaccagattcagtttacatacaatggcattttctgggatggtagcatcacctatggtggctactccaaaatgctcgttgcagatcagagatatgtggtgcatgtgccagaaaacctaccaatggatgcagcagcaccattgttgtgtgctggtgtaactgtgttctgcccattgaaggacaacaacatgcttgagcttgactcccctcccaaaaagctcggagtggtcggactcggaggtctcggccatgtcgctgtcaaattcggcaaggcctttggtcaccatgtcactgtcatcagcacctccccatctaaagaagacgaggctaaacaccggttgggtgcagacgatttcattgtcagcactgatcttgctcaaatgcaggcaaagaagaggtcactagatctgattttggacacagtagcagcaaagcactcacttgggtcttacttagaactgcttaaagtgaatggaacattggtgattgtgggtgcaccagacaagcccattgaccttccttctttccctttgatttttgggaagcgagtagtgaagggtagcatgacagggagtatgaaagagactcaagagatgatggatgtgtgcgggaagtacaacattaaatgtgacattgaaaagactacgccaaacaagatcaatgaagctcttgatcggctttcaaagaatgatgtcaagtaccgtttcgtcattgacattgctagtgctgacaaatgatcaaatctttaaactagagcttttcatagctataaggtgttttggacttaaaactggttaacacttttaataattcttgtgtggttttacttctttgaacaaatgtatttgactcataaattttatcaacaataatttaactcaaattaaaaattgaataatcaaattgattgataaattataagt

SEQ ID NO: 2350 - DNA, 1177 bp, Prunus persica
gtcttgtctgagtgtctctcatggctcaaaccactccaaatcatacacagactgtttctgggtgggcagctcacgattcctccggcaagatcacccctttcatcttcaaacgaagagaaaatgggatcaacgatgtgaccatagaggtcttgtactgtggaatatgccacacagatctccaccatgttaggaatgactggggcattaccatgtatccagtagtccccgggcatgagattacaggggtgattacgaaagttgggagcaacgtgaaggaattcaaggtaggagatagagtgggggtgggatgcttggcagcgacatgtttggagtgtgacttctgtaaagactcccaagagaactactgcgatcaggtccagttcacctacaatggcatcttctgggatggtagtattacctacggtggttactccaaaatgcttgtcgcagatcataggtacgtggtgcacataccagcgaacctgccattggatgcaacagcaccgctattgtgcgctggggtgactgtgttcagccccatgaaagaccacaatctacaccaagcaccagggaagaagataggggtcgtcggtctgggaggtcttggacacgtggcagtcaaattcgggaaagcctttggtcatcatgtaaccgtcatcagcacttctccgtccaaagagaaggaggctaaagagcgtttgggtgctgacgacttcctagtcagcactgatgcacaacaacttaagaaaggcatgaggacgcttgacttcatattaaatacggtgtcagctaagcactctcttgggcccctcttagaattgctcaaagtgaatggaactatggtggtggtgggtgcaccagaccagccctttgaattgccttccttccctatgatatttggcaagagggcagtgaagggcagcgtgataggaggaatgagagacacaaaggagatgatggaactctgcgggaagcataacataacgtgtgacattgaggttacaacaccacacaaactcgacgcggccttggaccgcgttgcgaaaaatgatgttcggtatcgatttgtcattgacattactgctggattaccttccaatctttagaaataatcgtgtcaaaaatttgtatgcaatataatgtgatgtcattgattgtttacatttagtattgttgt

SEQ ID NO: 2351 - DNA, 1464 bp, Eucalyptus grandis
accgacgcagagtacggcacttagtcacggggttttagttgtaatagcgagggatccgaggtgaggaagcatcctcggcagcactgccgttattagggttcgacgtgtctctctctctctgatcgtccgatggctcaagagactcagaaccacacgctctcggtgtccggctgggctgcctacgactcctccggcgagatcaaaccctacaccttcaaacgcagagagaatggcgtgaacgatgtgacgatcaaggtcttgtactgtggaatttgccacaccgatctccactatgccaagaacgactggggcatcaccatgtaccctgttgtccctgggcatgaaataacgggggtggtgattaaggtgggatgcaacgcgggcaagttcaagatcggggaccgtgtcggggtgggctgcctggcggcctcctgcctcaagtgcgagttctgtgccgactcccaggagaactactgcgaccagatgcagttcacgtacaacggcatcttctgggacggctccatcacctatggtggctactccaacgtcatcgtcgccgattaccgatatgtggtgcgcatacccgagaacttacccatggactcggtggcaccactgctgtgcgcgggaatcacggtgttcagcccgctgaaggacaacggcatgctgggctcgccgggtaagaagatgggggtggtggggctcggcgggcttggccacgtggcggttaagttcgggaaggcgttcggccaccatgtcacggtcctcagcacatccccatcgaaagagacagaggcaaaggggcgcttgggtgctgatgacttcattgtcagcaccaattctcagcaaatgcaggccgggaagaggagcctggatttcattttggacacggtatcggctcagcactctcttgggcccatcctggagttgctcaaagtggatggaactttggtcatggtgggtgcacctgatcagcccctcgaattgccttccttccctctaattttcggtaaaaggagtgtcaaaggtagcatgacaggagggatgagagatacgcaggagatgatggatttgtgcggcaaacacaacatcacttgtgacgtcgaggtcatcgccccagacacgatcaatgaggccatggaccgccttgccaagaacgatgtgagataccggttcgtgatcgacatcgctgggaggatatcgaatatttgaagatggtgtgagccaggcttggggcttatcggatacaaatcactactcccataattgcagacactatttatctatatttgtctttgtcatctgttggcctttcagtcgtaatcattcacctcatcctagtcattcatcctacacttttagagcttatattgcaacaagcccttgtccgattttcataagaaacaataaaaaagaaatgacaagaaatgaaataaagcttcgcaagttctatatgggcttaaa

SEQ ID NO: 2352 - DNA, 2298 bp, Solanum phureja
aaaaacaacaaaaacctaagccgccaaacctgtagccacgtccctgccgagcttctcctctcttagctgctttaagaatttgtgatttaacgacccttttctcttctcccaattgggttttcgacaccattaacagaatttcaagaaatagtgtaaattgccctcaaaaatttggtttcagaaggcagttttgagcctgaaaaatccgattttgaatcaggattgcttgattgttggagtatattttcagcagggggagctaattagctaagttaattggctctctctgctttttgcaaaacccaagtcacttcattcgtcgaaagaactttattgtcatttatatccattttttggagcttccttagctgatttattatggcaacattgtcacatttttgtggggttaaaactccctacccttctgtactcaaaagaagcgtgcatttcccacaacttgattttgtgggtactgtcccctttgtttctacgccaagtaaatctgtgaaggcttcttgttgtgaaagagtgcagagactggtatgtaaagcacaagcagctgatgttaatcctaaagagaccaagaatgaatcttttggtgaggttcctgatgaattgacctgtgttatgaagtttggtggctcatcagtagcctcagccgaaagaatgagggaagtagctgatcttattcttagctttccagaagagagacctgttattgttctctctgcaatgggaaagacaacaaacaaccttttgctggctggtgaaaaggctcagagttgtggtgtttccaatgtttctgatctgcaagagctggattttataaaggagctccatcttaggacaatagacgaacttggagtagagagttctaccatttcaaagcatctactcgaactggaacaacttttgaatggaattgctttgatgaaagagttgactccacgagcaagggactacttggtgtcctttggagagtgtatgtccacaagaatatttaccgcatatctgaataaacttggtgtcaaatcccgccaatatgatgcatttgagatgggtattataactactgatgatttcactaatgcggatatattggaagcaacttatcctgctgttgcaaagagattaactggtgattggatgagtagtcctgcaatccctattgtcactgggtttcttgggaagggttggaggacttgtgctgtgactacactaggtaggggtggtagtgacttgactgctacaacaatcggtaaagcattgggattacgtgaaattcaggtctggaaggatgttgacggtgttttgacatgtgatcccaacatatatccacgtgctgagactgtgccatatctaacttttgatgaggcagctgaacttgcatacttcggcgcacaggtccttcatccacagtcaatgaggcctgctagagagggtgatattcctgttagggttaaaaactcgtataatcctaaagctcctggtactctcatcgttaaaacaagagatatgagtaaggcggtacttacaagtatcgttcttaaacgaaatgtaaccatgttggatatcgcaagtacccgtatgcttggtcaatttggcttccttgcaaaggttttctccatctttgaagacttggggatatctgttgatgtcgttgcgacaagtgaagttagtatttccttgacattggacccatcaaaactttggagcagagaactaattcaacaggcaagcgagcttgataacgttgtagaagaacttgagaaaattgcagttgtgaagctacttcaaaacagatcaatcatctctctgattgggaacgtccagaggtcctcgttgattttagaaaaggctttccacgttatgcataccaatggtgtcaacgttcagatgatctctcaaggtgcatccaaggttaatatctcattgatagtaaatgacagtgaagcggaacaatgtgtaagggctctccaccattccttcttcgagagtgatctttctgaactagtctgggaaagtccatctggaaatggctatgctgctactactactactactcccttgtccacgctgtccaattaattttccttcgatttctccttcgtatgattgttctttccaataatattttcgaggaaatgaacgaaattttgctagtacttttttggggtgtgggtgcagtttcgtcgttgtaacatttatcacttgtagcaagaagacacattttatgatctatctaagctacctttattatatctttaatggagcaaatttactttacaatgccaagga

SEQ ID NO: 2353 - DNA, 1048 bp, Zea mays
acacacaggcaccgaacgaacaggacaacgagagaaagcaaagcgagctgctgcttccttatccggttcttcgccgtgagcgctccgcagggaacggtacgggaactgggggatccggacgttcttgtgtgtattatcgaatatcgagcaagctaagcgccatgggcagcgagtgcaagggctacggcgtcggcgtcgccaccagcccgcagcaggagcaggagcaggctggcgccgccgtcgcaccgttcgtggccaagacgttccacatggtgagcgacccggccacggacgccgtcgtgcgctggggtggcgccagcaacaccttccacgtcctcgacccggccaccttctccgactacctgctgccctcctacttcaagcaccgcaacttcgccagcttcgtccggcagctcaacacctacgggttcaggaaggtggacacggaccggtgggagttcgcgcacgagtcgttcctgcggggccaggcgcgcctgctgccgctggtcgtgcgcaagaggaagaaggcgggcgccggcgccggcggcggcggccgggagctgtgcgaggccggggaggaggtgcgcgggaccatccgggccgtgcagcgcctgcgggagcagcagcgcggggtggaggacgagctgcgggccatggaccgccgcctgcgcgccgccgagagccggccggcccagatgatggcgttcctcgccaagctcgccgacgacccgggcctcgtgctgcgcgccatgctcgccaaggaggaggagctggccctgatcgacaaggggtcggaggcgcagccggccaagaggcggcggatcggggctgaagccgtggacctggcgcacagcaggggcgggggcgccgtgccgtttccgttctctgttctcggccaagtgttctactagggtagatagggactggtgtatatatgacttgcactgtattatagctttgcctcggtttcagcagttactgccttccgttttaccgtcggcttcatttttaaatttaaacgcgacaaataaaaaataagttcattttt

SEQ ID NO: 2354 - DNA, 1438 bp, Solanum melongena
agagggagagagagtctctctctttctttctctctattttttctttcaaccaaacagaccacaaacagtagagagagaaactgagttttatagagagagaaagtgtgaagcttttgcagataagaatcctcatctcttcttccatggctttatcgtttcatatcttttcctaaatctctttccagatctctaattttctcaaaaaaaaaaagtttttgaaaatcttcggccatgcggagaggtagagcagccgcggcggcaaggcaagttccggtgacggatgctccggtagcggcaccggtggctggagaaatcaacggatctggaggatccaaggagataaggttccgtggagtccgaaagagaccatggggaagatttgctgcagagattagagatccatggaagaaaactagggtttggttgggtacttttgattctgctgaagatgctgctcgtgcttatgatgctgcagctcgtactcttcgtggacctaaagctaaaactaatttccctttaccttcttctcatcatcttcctccatatcctcaccatcaccagttcaatcaaagcatcaaccctaatgatccctttgttgattcccgattataccctcaggatcacccgataatttcacagagacctacttcaagcagcatgagtagtacagtggagtccttcagtggaccacggccaccgccgcggcagcagacggcagcttcagtcccttccagaaagtatccaaggtcgcccccagttgtcccagacgattgccatagcgattgtgattcctcatcttctgttgttgatgacggtgaatgtgaaaatgacaacatcgcttcttcgtctttcagaaagccattgcctttcgaccttaacttaccggcgccgatggatgacgccggcgccgacgcatatgccgatgatcttcactgcacagcactatgtctttgactgaatgatggtttgtgacccacctgtcatttgataccattggcttacctagttttttatttttgggtgacaggagaaagcaaacaaaagaaaaaagaaccatagagataatctaaactatgtctgctatgagtatctgttgttggaagagaattcacttgtttaatttaattctcatattttatatcatgggatttcaggtggatgaagcagtgtatgccaaatttgttcttattgtgtatcttaaaaactatatgtgggttctcagctgaaggtgtcctttgtcgtttgaagtcgaatttatatatattgacatgcaagattagagggtaattcgtgttcttgctttgctggtagttgctatcatgtgtgtatgatgctatcttctgccctttcagtctatgtaacaattgccctcacagtctatgtaacaattgagactttatctgatcatatattaattgacaagtatccatattttggg

SEQ ID NO: 2355 - DNA, 1546 bp, Triticum aestivum
gggtcaacgccgcataattgtgtccgccgccggctcccgggacaccgcacagcgcacagacaacccaaggcctagcaccactctccttgtctcgcacctgcctgccggctgcgccgctagcgatcgagctaagtcgacgcgcgcgcgtgggcttttgcatgataaggaggaggatgggggcactgcacgtcggcgagccgcgggtcagcttccagcagcaggtcggcaagaacggcgggggccacggcgccgtcgtggaggagatacacgggctcatccgcgtgtacaaggacgggcacgtggagcgcctcccggcgatccccgacgtcccctgcacgtggggctcgacggccgccgcgagcggcgtcctcgcgcgcgacgtggcggtcgaccgcgccacgggggtgtgggcgcgcctgtacgcgccggccgccgcggcggggaaggtccccgtggtggtgtacttccacggcggcgggttcagcgtcggctccgccgcgtggagctgctaccacgagttcctcgcccagctccccgcgcgggcgggctgcgccgtgatgtccgtcgactaccgcctggcgccggagaaccgcctgcccgccgcgttcgacgacgggctcacggcgctgcggtggctgcggcagcaagcgagcagaaacgcggccgcctccgacgaggtctcgtggtggcgcagccggtgcaggttcgaccgcgtgttcctcatgggcgacagcgcgggcgccgccatcgcgttccacgtcgcggcgcgggccgggcagggccagctgggcgcgctggcgccgctctcggtcaagggagccatactgatccagcccttcttcggcggggaggcccgcacggcgtcggagaagagcatgccgcagccgccggggtcggcgctgagcctgtcgacctcggacagctactggcgcatggcgctcccggccggcgccgggcgcgaccacccctggtgcaacccgctggcccgcggcgccccccggctggagacgctggcgctgccgcccgtgctggtgtgcatctcggaggcggacatcctgcgcgaccggaacctggagctgtgcagggcgctgcgcaaggccggcaagagcgtggagcaggcgacgtacggcggcgtggggcacgccttccaggtgctccacaactgccacctgtcccagccgcgcacgcaggagatgctcgcccacatccgggccttcgtcagcgccaggtccagctgacaggcagacaccactcctccgccgtgccatgtcagtgtcacccgccgattaattacataatccactaccagttccagagtagatgccgtgtaagcagtattagcagtagcttgtggtactcgcccaagtgaaggaaaagacaagaagaaaagggtccaatgccgaacttggatcgtggtgtcggaaagcaaaagtgtggcgcaaaaataacactttctccatgtatgtatgtgtatcgtgttgttcattgtactcctacttacttgcaaaggcggatcaatatatatatataattattaaaaaaaaaa

SEQ ID NO: 2356 - DNA, 1535 bp, Avena sativa
aattgtgtccgccgccggctcccggtacaccacacagcgcacagacacacagagcgtagtactagtttccctgtcttgcacctgccggctgtgctgctaataagtcggcggtcgatcgcgggcttgctttgcatgagaaggcggaggatgggggcactgcacgtcggcgagccgcgggtcagcttccagccgcaggtcggcaagaacggagggggccatggcgcggttgtggaggagatccacgggctcatccgcgtgcacaaggaagggcacgtggagcgcctcccggcggtccccgacgtgccctgcgagtggggctcgacggccgcggggagcggcgtcatcgcgcgcgacgtggccgtcgaccgcgccacgggggtgtgggcgcggctttacgcgccggctgccgtctcagcggggaaggttcccgtggtggtgtacttccacggcggcggcttctgcgtggggtccgccgcgtggagctgctaccacgagttcctcgcccagctccccttgcgggcgggctgcgccgtgatgtccgtggactaccgcctcgcgcccgagcaccggctcccggccgcgttcgacgacggggtcgcggcggtgcggtggctgcggcagcaggcgggctacagcaggaacaatagcacctccgcctccgacgaggtctcgtggtggcgcagccggtgcaggttcgaccgggtgttcctgatgggcgacagcgcgggcgccagcatcgcgttccacgtggcggcgcgtctgggccagggccagctgggcgcgctggcccctctctgcgtcaagggcgccatcctgatccagcccttcttcggcggggaggcccgcacggcgtcggagaagacgacgccgcagccgccccggtctgcgctgagcctggcgacgtcggacagctactggcgcatggcgctccccgcgggcgggcgcgaccacccgtggtgcaacccgctttctcgcggcgcgcccaggctggaggccctggcgctgccgccgctgctggtgtgcgtggcggaggcggacgtgctgcgggaccggaacctggagctgtgcagggcgctgcggaagggcgggaagagcgtggagcaggcgacgtacggcggcgtggggcacgccttccaggtgctccacaactaccacctgtcccagccccggacgcaggagatgctcgcgcacatccgggccttcgtcagcgccaggtccaccagctaacgctcgccgtgtcacgtcgtcggctgttaattaattaagtaataatccaaaaaagtctaatccacaaccgatttcatcatcagagtagtagtagatgccgtgtaagcaggcagcagtagcttgcagtgctcgcccaggtcgggcggcaaagaaagacaaggaaaggaaagggtccaatacgaaacttggatcgttgtcgatcggaaagcgatcgaaagcgtttgtagtaggggataaataatactgcccgcccccctacgatgtgcgcgcggtggtgtttctctgcgtgtatctcgttgatattcatt

SEQ ID NO: 2357 - DNA, 1544 bp, Avena sativa
aattgtgtccgccgccggctcccggtacaccacacagcgcacagacacacagagcgtagtactagtttccctgtcttgcacctgccggctgtgctgctaataagtcggcggtcgatcgcgggcttgctttgcatgagaaggcggaggatgggggcactgcacgtcggcgagccgcgggtcagcttccagccgcaggtcggcaagaacggagggggccatggcgcggttgtggaggagatccacgggctcatccgcgtgcacaaggaagggcacgtggagcgcctcccggcggtccccgacgtgccctgcgagtggggctcgacggccgcggggagcggcgtcatcgcgcgcgacgtggccgtcgaccgcgccacgggggtgtgggcgcggctttacgcgccggctgccgtctcagcggggaaggttcccgtggtggtgtacttccacggcggcggcttctgcgtggggtccgccgcgtggagctgctaccacgagttcctcgcccagctccccttgcgggcgggctgcgccgtgatgtccgtggactaccgcctcgcgcccgagcaccggctcccggccgcgttcgacgacggggtcgcggcggtgcggtggctgcggcagcaggcgggctacagcaggaacaatagcacctccgcctccgacgaggtctcgtggtggcgcagccggtgcaggttcgaccgggtgttcctgatgggcgacagcgcgggcgccagcatcgcgttccacgtggcggcgcgtctgggccagggccagctgggcgcgctggcccctctctgcgtcaagggcgccatcctgatccagcccttcttcggcggggaggcccgcacggcgtcggagaagacgacgccgcagccgccccggtctgcgctgagcctggcgacgtcggacagctactggcgcatggcgctccccgcgggcgggcgcgaccacccgtggtgcaacccgctttctcgcggcgcgcccaggctggaggccctggcgctgccgccgctgctggtgtgcgtggcggaggcggacgtgctgcgggaccggaacctggagctgtgcagggcgctgcggaagggcgggaagagcgtggagcaggcgacgtacggcggcgtggggcacgccttccaggtgctccacaactaccacctgtcccagccccggacgcaggagatgctcgcgcacatccgggccttcgtcagcgccaggtccaccagctaacgccccgccggctcgccgtgtcacgtcgtcggctgttaattaattaagtaataatccaaaaaagtctaatccacaaccgatttcatcatcagagtagtagtagatgccgtgtaagcaggcagcagtagcttgcagtgctcgcccaggtcgggcggcaaagaaagacaaggaaaggaaagggtccaatacgaaacttggatcgttgtcgatcggaaagcgatcgaaagcgtttgtagtaggggataaataatactgcccgcccccctacgatgtgcgcgcggtggtgtttctctgcgtgtatctcgttgatattcatt

SEQ ID NO: 2358 - DNA, 741 bp, Saccharum officinarum
cgattccgtgcccgcctgctcgcagtcccctcctctccctcctgtcccacgcccccgctgagtcacgcgacgcgcgcgacgacgcggcagagaaagccaggaactccataaagtttcggtttcggaagccaagccactccacacctctccactgcttgcgaagggagccagcaatggcgcatcgcgggccgtgaccggcgtcgctggagacggggacaggaatggctgccgtggcgcgcgggcctgcgactgcgatggccccggcggccgggtcgggggcgacggcggcggcggaggagatgcggtggcggcagctagacagcggcgtgagcgcggtgtcgttcgggttcgtggccaccgccatcctcgtgtccatgttcctcgccatggccatcctggagcacttcctccgccccccggcccacgcgcccgggcacgcgccgccccgggggatcctccgccgcctccgcctcttcctcggccgcggcggcgagcgcggcgccgcccccggcgcggatctcgaggcggcgaggaagctccaaggccacgcgcccctcgagatacctgtctaccccaaaggcgtctcagttctgatgccagggcaagacatgccaacgttcatcgcgcatcctgtccctgctccctgccccccagagaggatccgatggccatcacaccagtcccctcctttcactggttcctcgtccaaccctagctagggttgctgtagcacacaccaca

SEQ ID NO: 2359 - DNA, 437 bp, Brachypodium distachyon
gagatgttctccggcgattggacgccgccgtgcggcagctgctgcaccaagaagtacgccaacctcgtccaaatcccatggagggtgttctgcaagaaggggtgcaacgcggacggcgacacttgggacgagtgcataggtaaatgcactgagatatgctacaaagatccagtgttggaagatcgccagtggagtgcttacatcgatcggtctccaggagaggatagttactccttggagtgcttcaatgcttgtatctctggatgtggatataggttcgatataccagcggaaaaagtcaaagaaatcaagccgaacaggccgtccaagccgccacctcccgtaatagaacgggctgcgggttcagaacctgctgtgaagggtgaagatgtgccttgcacatcagcgtagcttatgcaattttgtaaaactattcg

SEQ ID NO: 2360 - DNA, 946 bp, Oryza sativa
ctccctcgtctccgcctccaccctcaccggcgccacgccgacgcctccgccctcctcgaccacccccgcccccgaccgcgcgagctccggagcagttggcgtcgacaaggaagggaggtgaggcggcggagatgttctccggcgagtggacgccgccgtgcggcagctgctgcaccaagaagtacgccagcctcgtccaaatcccatggagggtcttctgcaagaaggggtgcgacgcggacggcgacacctgggacgagtgcataagtaaatgtacggaaatatgctacaaagatcctgttttggaagatcaccagtggagtgcatatatcgatcggtctccaggacaggatagctactccttggagtgcttcaatgcttgtgtttctggatgtggatataggtttgacataccagcggagaaagtggagcaaatcaaaccaaacaggccatccaagccaccaccaccaccacctcctgcagtagagcgggccacgaattcagaacctgctgtgaagggtgaagacgtgccttgcacatcagcataatagtaatctatgcagccccaaattttgtgtaacttttggtgcttctttccctcatactgcctccttttttttctcttttctgggctgtttctttgcaccatgtgcttgaaattcgcagtccaccttaggctgggctagatgctaacaagatcttaacgataaatcccaaaatcttatttatattttcatatgcttgttcatccacattgtatgttagtatgctccctccgttcctttgtggatggcgccgttgttaataatacttatagatggtttatcatatcataaacgaaagctttgtgattatatttaggatgcaacacacttggataatatagaatcatttgaagtgtaaatgatctttttattaaaaaaaagacaagctctaaagttttact

SEQ ID NO: 2361 - DNA, 798 bp, Panicum virgatum
cttcgccttccccccctaccggagacacaaccagcgtcctgggcagccgctgcagtctcgctgccgctcgcttcgccgaccaatccgggaggcaggccagggcggacgggacgggatgttctccggcgactggacgccgccgtgcggcagctgctgcaccaagaagtacgcgagcctcgtgcagatcccatggagggtgttctgcaagaaggggtgcaacgcggacggcgacacctgggaagaatgcataggaaaatgtactgaaatctgctacaaagatccagtgttggaagatcgccagtggagtgcttacattgatcgatctccagggcaggatagttactccttggagtgcttcaatgcttgtgtgtctggttgtggattcaggttcgagatcccaacagagaaggtcgaagagatcaagcccaacaggccgtccaagccgccacctcctgaagtgaagccaactacgggtccagcctctgctgctgggagccgtgaagacgtgccatgcacatcggcctagttgcctccaactccaaatctttgatgttctaattgctctgttctcctcactcgtcctcccccttctctttctggaaaacgtacggaatgttttctttgttatcatagctagtggtactcgccaaatttagagtgaagaatttgtagcactggcagtaagagatgacgaggggagtgcagcgatgtattgtacacaagtaacaggagttttacttgataaatggcatgacatgacatgtttcagagcttcacgagcgtgaagcatcatcgtcc

SEQ ID NO: 2362 - DNA, 1086 bp, Zea mays
attaagctgtgtccagcgcgccttagagagaatccatgtctataccagcgtctgcacatcgtgtgggtttttaaatcatcgaatctcttccgacgtcttcgtttcgtcgaagccgagcgagtcgtgttttataatggcaaaaatctctatccaaagagagccttgaaaaaaacacctccagaatttgctctttattatttgcagtataataaaacacctccccaatttgctccgcaccgaccagctgactgcgtgcgaaccgaatagcgcgccgccgccgctccctctccacctctattttctgcccctcgcctcccccataccggggcccggtaaccagcatccctcggcagccgctgccgaccgatccgtgtccgtgcgagacgcgggagggattggcgccggaggctgaccgggatgttctccggcgactggacgccgccgtgcggcagctgctgcaccaagaaatacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcttacattgaccgatctccagggcaggatagttactctttggaatgcttcaatgcttgtgtgtctggctgtggattcagatttgacatcccaacggagaaggtcgaagaaatcaagcccaataggccatccaaaccatcagctcctgaacctgaagtgaaacaaactaggaatgcagattgtaatgaagatgtgccgtgcacgtcagcctagtttgagtgttggcgtgcctcaaattttgtaaagccaatgtgcttctccgttgtatttctactcgtcctattttcccatggaaaactcacgggaaactttatctagcttagctctagtttggaaactcaaatcccttcgtggatggaaggggtttgagggacaaattagtttattttcatcttaatcccttccaatccccgggtgatttgagtttacaaactagcctttagagtaaagatttaccacattggcaatgaaagatga

SEQ ID NO: 2363 - DNA, 863 bp, Zea mays
aatttgctccgcaccgaccagctgactgcgtgcgaaccgaatagcgcgccgccgccgctccctctccacctctattttctgcccctcgcctcccccataccggggcccggtaaccagcatccctcggcagccgctgccgaccgatccgtgtccgtgcgagacgcgggagggattggcgccggaggctgaccgggatgttctccggcgactggacgccgccgtgcggcagctgctgcaccaagaaatacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcttacattgaccgatctccagggcaggatagttactctttggaatgcttcaatgcttgtgtgtctggctgtggattcagatttgacatcccaacggagaaggtcgaagaaatcaagcccaataggccatccaaaccatcagctcctgaacctgaagtgaaacaaactaggaatgcagattgtaatgaagatgtgccgtgcacgtcagcctagtttgagtgttggcgtgcctcaaattttgtaaagccaatgtgcttctccgttgtatttctactcgtcctattttcccatggaaaactcacgggaaactttatctagcttagctctagtttggaaactcaaatcccttcgtggatggaaggggtttgagggacaaattagtttattttcatcttaatcccttccaatccccgggtgatttgagtttacaaactagcctttagagtaaagatttaccacattggcaatgaaagatga

SEQ ID NO: 2364 - DNA, 814 bp, Saccharum officinarum
caccacgcctacgtttcgcccctgcccctcgcctccccctttaccggtgcccgcccaccagcatccctcggcagccgccgcggtcccgctgccgctcgcttcgccgaccgatccatccgtgcgagacgcgggaggggttggcgccggaggcaggccgggatgttctccggcgactggacgccgccgtgcggcagctgctgcaccaagaagtacgcgagcctcgtgcagatcccatggagggtgttctgcaagaaggggtgcaacgcggacggggacacctgggacgagtgcataggaaaatgtactgaaatatgctacaaagatccggtgttagaagatcgccagtggagcgcctatattgatcgatctccagggcaggatagttactctttggaatgcttcaatgcttgtgtgtctggctgtggattcaggtttgacgtcccaacggagaaggtcgaagagatcaagcccaataggccatccaagccatcagctcctgaacctgaagtgaaacgaactaggaatgcagattgtactgaagatgtgccgtgcacgtcggcctagtttgagtgttggcgtgcctcaaattttgtaaagcaaatgtgcttctccatgttgtatccctacttgtcctattttcccgtggaaaatgcacgggaaacttatctagcttagggtgaagatttaccacactggcggtgagaggtgatggcctgggacctgggtgaagatttgccgcattggtggtgagaggtgatggcctgatgagtaatgcgacgatgtaatgtgcacaagtaacggaaactgagtttct

SEQ ID NO: 2365 - DNA, 1273 bp, Glycine max
ttacccacaccctctctctctctctctctgtcacgcacagagaaaaactcagacacccacgttcacacttcgcacacaccatctctcactgttctttcttcttcctctttttcttcttttttttcttttctcttaatggaatgatggaacacaacatcatcgtcaacaacaacgtgatcgcaccgtttgtcataaaaacctacaatatggtgaacgatcccaccaccgataaactcatcacgtggggcccagccaacaacagcttcatcatcctcgatcccctcgacttctcccactccctcctccctactttcttcaagcacaacaacttctccagcttcgttcgccaactcaacacctatggtttcagaaaggtggatccggatcggtgggagttcgcgaacgagtggttcctgcgaggacaaaagcacttattgaggaacatcgtgcggaagaagcacggtggagctgggaggaccaattccaattcgcattattcgcatcccttgaagctggaggagttggacgacgaggctatggtgatggagatagcgaggttgaaggaggagcaaaaagcgttggaggaagagcttcatgaaatgaacaagaggttagagacaacagaaaaacgaccacaacaaatgatggcttttctgtgtaaggttgtcgaggacccgcagattctttctcggattctccgagaaagagaaaagaaacacctgggagagaaaaagcgacgcctcattccgcctccgccgccgacggcagcgacgtcgtcgtcgtcgtcctccggcatcaagacagagttcgaagaagacgaaggtaattataatatcaagtcttcgtcgccggagacagggttggaaatcgacaacaatagtaacaatatttgttcgccgccgccgctggggtgttggggtgaacagggttgttatgggtacaattgcgcctccgtgccggcacctttgacggtggtagcgccggcgtttccgacgatgggaggagggtatttgaggcgtggggggttttggggggaaatggcggcggaggggaatgcggtgccgccttatccgttttcgttgttggaagggggcttttagatttagttttaggttatgaaatgaatgaattattactgccacaaaatttcatcttggattttctgtcgtattgaaagttctatccttttttgtgcgttgattctgtgtaaagaaaaaaggttgggaaaaagagtaaaaaggtagtgggaaaattgttagatatttatagttgt

SEQ ID NO: 2366 - DNA, 1226 bp, Glycine max
ctttctctttctcactcactctcactctctgtcacggacagacagagaaaaactcagacacccacgttcacacttccctcacaccatcccttactgttccttcttcttcttcttcctttttttttttttttctcttaatggaatgatggaacacaacatcatcgttaacaacaacaacgtgatcgcaccgtttgtcataaaaacctacaacatggtgaacgatcccaccaccgataaactcatcatgtggggcccagccaacaacagcttcatcgtcctcgaccccctcgacttctctcactccctcctccctgctttcttcaagcacaacaacttctccagcttcgttcgacaactcaacacttatggtttcagaaaggtggatccggatcggtgggaattcgcaaatgagtggttcctgcgaggacagaagcacttgttgagaaacatcgcgcggaggaagcacggtggagctgggaggagcaatttcaatttgcattcgcatcatcatccgttgaaggtggaggaattggacgacgaagccatggtgatggagatagcgaggttgaaggaggagcaaaaagcgttggaggaagagcttcaaggaatgaacaagaggttagagacaacagaaaaacgaccacaacaaatgatggcttttctgtccaaggttgtcgaggacccgcaggttctttctcggattctccgagaaagagaaaagaaacacctgggcgagaaaaagcgccgcctaattccgccgccaacaacgacggcagcgacgacgtcgtcgtcgtcgtcctccggcatcaagacggagttcgaagaagacgaaggtaattataatatcatgtcttcgtcgccagagacagggttggaaatcgataataataatatttgttcgcctctggcggcggggtattggggggaacagggttgtcatgggtacaatcgtggcgccgtgacggcgccgttgacggtggtggcgccggcggttccgacgatgggaggagggtatttggggcgtggggttttttttggggaaatggcggcggaggggaatgcggtgccgccttatccgttttcgttgttggaaggtggcttttagatttatttgttttaggttatgaaatgaatgaattattactgccacaagatttcatcttggattctgtctttttgtattgaaagttctttcctttttgtgcgttgattctgtggaaagaaaa

SEQ ID NO: 2367 - DNA, 988 bp, Glycine max
tttttttttctcttaatggaatgatggaacacaacatcatcgttaacaacaacaacgtgatcgcaccgtttgtcataaaaacctacaacatggtgaacgatcccaccaccgataaactcatcatgtggggcccagccaacaacagcttcatcgtcctcgaccccctcgacttctctcactccctcctccctgctttcttcaagcacaacaacttctccagcttcgttcgacaactcaacacttatggtttcagaaaggtggatccggatcggtgggaattcgcaaatgagtggttcctgcgaggacagaagcacttgttgagaaacatcgcgcggaggaagcacggtggagctgggaggagcaatttcaatttgcattcgcatcatcatccgttgaaggtggaggaattggacgacgaagccatggtgatggagatagcgaggttgaaggaggagcaaaaagcgttggaggaagagcttcaaggaatgaacaagaggttagagacaacagaaaaacgaccacaacaaatgatggcttttctgtccaaggttgtcgaggacccgcaggttctttctcggattctccgagaaagagaaaagaaacacctgggcgagaaaaagcgccgcctaattccgccgccaacaacgacggcagcgacgacgtcgtcgtcgtcgtcctccggcatcaagacggagttcgaagaagacgaaggtaattataatatcatgtcttcgtcgccagagacagggttggaaatcgataataataatatttgttcgcctctggcggcggggtattggggggaacagggttgtcatgggtacaatcgtggcgccgtgacggcgccgttgacggtggtggcgccggcggttccgacgatgggaggagggtatttggggcgtggggttttttttggggaaatggcggcggaggggaatgcggtgccgccttatccgttttcgttgttggaaggtggcttttagattta

SEQ ID NO: 2368 - DNA, 1415 bp, Zea mays
ttttatagcagcctccatgcgcctcactcccgcactcccacaccacgctcgagacgagagccagctctcccagcacacgagcacatggcgtccaccaccctcctcgctgtcttgctgctcgtggctgcgtccgcagcgccggcgcggtcttgctcacctcgcgacctgcaggcgctgttgagcgtgaagcaggcgctagggaacccgtcaacgctgtcgacgtggaccccagcgtcgcccgactgctgctcgtgggaccacctccggtgtaacgacgccggacgcgtgaacaacgtgttcatcgacggcgcggacgacgtgcgcgggcaaatcccgtcggcggtgggcgggctgacggagctcatgtcgctgaccctgttccggctggcggggctgacgggccccatcccggcctgcctggccgcgctgtccaacctgcagttcctgaccgtctcccacaccaacgtgtccggcgccatcccggagtccctggcgcggctgcgcggcctcgactcggtggacctctccagcaaccagctgacgggcggcatcccggcgtcgttcgccgacctgcccagcctccggtcgctggacctcgggcacaaccagctgacgggcagcatcccggcggggctggtgcaggggcagttccggtcgctggtcctgtcgtacaaccagctgacgggcccgatcccgcgcgacgacgcgcgcgacgagatcaacaccgtggacctctcccacaacaagctgacgggcgacccctcccacctgttcgccgccggccggcccatcggcaaggtggacctgtcgtggaactacctcgacttcgacctgagccagctggtgttcccgccggagatgacgtacctggacctgtcccacaacctcatccggggcaccgtgccgctgtcgctggagcggctgtccacgctgcagaagctggacctgagctacaaccgcctgtgcggcccgctccccaagggacacggcgtcatcaagcacgggtgcaagccgtacgcgcacaaccagtgccgcaaagggaccccgctcgcgggctgccaggacctggagtggagtgagtgagccggccggtatggttttctatactctgctctgctctccctcgccggcgtgcttcccgatcgtggtgtgtgtaaggaactaaggacgacggtgcctggtttaggcgtttagctatagacgaaagcacgtacggccgcgtgcctggtctagctacgcggccggttgatcttgagcagttaagcgtgtacgaaacgacagcgctgtgtacgtgtactgtctgctgaagtgtgagatgtactgtctgtgtgtatttggtatggatccgatcggcctgatgtatgaaaaggatgtttacgtactatataaagatggaaaatcgtatttgcctcctc

SEQ ID NO: 2369 - DNA, 1384 bp, Zea mays
gcactcccacaccacgctcgagacgagagccagctctcccagcacacgagcacatggcgtccaccaccctcctcgctgtcttgctgctcgtggctgcgtccgcagcgccggcgcggtcttgctcacctcgcgacctgcaggcgctgttgagcgtgaagcaggcgctagggaacccgtcaacgctgtcgacgtggaccccagcgtcgcccgactgctgctcgtgggaccacctccggtgtaacgacgccggacgcgtgaacaacgtgttcatcgacggcgcggacgacgtgcgcgggcaaatcccgtcggcggtgggcgggctgacggagctcatgtcgctgaccctgttccggctggcggggctgacgggccccatcccggcctgcctggccgcgctgtccaacctgcagttcctgaccgtctcccacaccaacgtgtccggcgccatcccggagtccctggcgcggctgcgcggcctcgactcggtggacctctccagcaaccagctgacgggcggcatcccggcgtcgttcgccgacctgcccagcctccggtcgctggacctcgggcacaaccagctgacgggcagcatcccggcggggctggtgcaggggcagttccggtcgctggtcctgtcgtacaaccagctgacgggcccgatcccgcgcgacgacgcgcgcgacgagatcaacaccgtggacctctcccacaacaagctgacgggcgacccctcccacctgttcgccgccggccggcccatcggcaaggtggacctgtcgtggaactacctcgacttcgacctgagccagctggtgttcccgccggagatgacgtacctggacctgtcccacaacctcatccggggcaccgtgccgctgtcgctggagcggctgtccacgctgcagaagctggacctgagctacaaccgcctgtgcggcccgctccccaagggacacggcgtcatcaagcacgggtgcaagccgtacgcgcacaaccagtgccgcaaagggaccccgctcgcgggctgccaggacctggagtggagtgagtgagccggccggtatggttttctatactctgctctgctctccctcgccggcgtgcttcccgatcgtggtgtgtgtaaggaactaaggacgacggtgcctggtttaggcgtttagctatagacgaaagcacgtacggccgcgtgcctggtctagctacgcggccggttgatcttgagcagttaagcgtgtacgaaacgacagcgctgtgtacgtgtactgtctgctgaagtgtgagatgtactgtctgtgtgtatttggtatggatccgatcggcctgatgtatgaaaaggatgtttacgtactatataaagatggaaaatcgtatttgcctcctc

SEQ ID NO: 2370 - DNA, 1348 bp, Saccharum officinarum
gagagccagctctcccagcacgcacacacgagcacgatggcgtccaccaccaccaccttcctcgctgtcttcctgctcgtggcgtcggcgtccgcggcgccggcgcggtcctgctcaccgagcgacctgcacgcgctgctgagcgtgaagcaggcgctgggcaacccggcgacgctgtcgacgtggaccgcgtcgtcgcccaactgctgcgcgtgggaccacctccggtgcaacgacgccgggcgcgtgaacaacgtcttcatcgacgccgcggacgacgtgcacggccagatcccgtccgcggtgggcgggctgacggagctcatgtcgctgaccctgttcaagctgccggggctcacgggctccatcccgacctgcctcaccgcgctgtccaagctggagttcctcaccatctcccacaccagcgtgtccggcgccatcccggagtccctggcgcggctgcgcagcctcgactccgtggacctctccagcaaccagctgacgggcggcatcccggcgtcgttcgccgacctgcccaacctccggtcgctggacctccggcacaaccagctgacgggcaccatcccggcggggctggtgcaggggcagttccggtcgctgatcctgtcctacaaccagctgacgggcccgatcccgcgcgacgacgcgcacgacgagatcaacaccgtggacctctcccacaacaagctcaccggcgacccctcccacctgttcgtcgccggccggcccatcggcaaggtggacctgtcgtggaactacctcgacttcgacctcagcaagctggtgttcccggcggagctgacgtacctggacctgtcccacaaccaaatccggggcaccgtgcccgtgtcgctggagcggctgtccacgctgcagaagctggacctcagctacaaccgcctgtgcgggccgctccccaagggccacggcgtgatcaagcacgggtgcaagccgtacgcgcacaaccagtgccgcaaggggaccccgctcgcggggtgccaggacctggagtgagctgtgagccggtcgcccgtgtgctctccctcgtcggcgtgcggcggcgcacgtgtgcttttcgcgtcccgatcgtggtgcctggtgtttagctatagacaaaagtacggtcgcgtggtggtggtaatatgctttagctacgcggccggttgatcttgagcagttgagcgtgtacgaaacgacagctgtgtacgtgtactgtctgctgaagtgtgcgatgtagtactgtgtatttggtatggatccgatcgatcggcctgatgtatgaaaaggatgtttacgtactactataaatggcaaatcatattttcct

SEQ ID NO: 2371 - DNA, 1421 bp, Sorghum bicolor
gcactcccacaccacactcgagagcccagcacgcacacgagcacgatggcgtccaccaccaccgccaccttcctcgccgtcttcctcctcgtggcggcgtcgtcctcggcgccggcgcggtcctgcgcaccgagcgacctgcacgcgctgctgagcgtgaagcaggcgctgggcaacccggcgacgctgtcgacgtggacggcgtcgtcgcccaactgctgcgcgtgggaccacctccggtgcaacgacgccgggcgcgtgaacaacgtcttcatcgacgccgcggacgacgtgcacgggcagatcccgtccgcggtgggcgggctgacggagctcatgtcgctgaccctgttcaagctgccggggctcacgggctccatcccggcgtgcctcaccgcgctgtccaagctggagttcctcaccatctcccacaccagcgtgtcgggcgccatcccggagtccctgacgcggctgcgcagcctcgactccgtggacctctccagcaaccagctgacgggcaccatcccggcgtcgttcgccgacctgcccaacctccggtcgcttgacctccggcacaaccagctgacgggcaccatcccggcggggctggtgcaggggcagttccggtcgctgatcctgtcctacaaccagctgacggggcccatcccgcgcgacgacgcccacgacgagatcaacaccgtggacctctcccacaacaagctcaccggcgacccctcccacctgttcgtcgccggccggcccatcggcaaggtggacctgtcgtggaactacctcgacttcgacctcagcaagctggtgttcccgccggagctgacgtacctggacctgtcccacaaccacatccggggcacggtgccgctgtcgctggagcgcctgtccacgctgcagaagctggacctcagctacaaccgcctgtgcgggccgctccccaagggccacggcgtcatcaagcacgggtgcaagccgtacgcgcacaaccagtgccgcaaggggaccccgctcgcgggatgccaggacctggagtgagccggccggtcgcccggaccccgccggagctgggatttctcttctctgctctccctctccctcgtcggcctctgctctctccctcgtcggcgtgcggcggcgcacgtgtgcttttcgcgtcccgatcgtggtggtgtgtgtgtaagcacgacggtgcctggtgtgtttagctatagacaaaagtacggccgcgtaagcacgcgcggttgatcttgagcagttaagcgtgtacgaaatgacagctgtgtacgtgtactgtgtctgatgaagtgtgggatgtagtactgtgtatttggtatggatctgatgtatgaaaaggatgtttacgtactataaatggcaaatcatcatatatttcctcttttttttttaag

SEQ ID NO: 2372 - DNA, 1410 bp, Setaria italica
cagcgcgagctcccagcagcgcacgagctgagcctgagagagccaccaacaggaataggagcaggatggcgtccaccgcctcatccttcctcgttgtcttcctgctcgtggcggcggccgcgacgacgccggcgcggtcctgcgcgccgagcgacctgcacgcgctgctgagcgtgaaggcggcgctgggcaacccggcgacgctgtcgtcgtggagcccgtcgtcgcccaactgctgcgcgtgggaccacctccggtgcgacgacgccgggcgcgtgaacaacgtcttcatcgacggcgccgacgatgtgcacggccagatcccgtccgcggtgggcgggctgtcggcgctcatgtcgctgtccctgttccgcctgccggggctcacgggcaccatcccgccctgcctcaccgcgctctccaacctgcagttcctcaccatctcccacaccaacgtatcgggccccatccctgaggccctggcgcggctccgcagcctcgactcggtggacctctccaacaacaagctgtgcggcggcatcccggcggcgttcgccgacctgcccaacctccggtcgctggacctccggcacaaccagctgacgggccccatcccggcggggctcgtgcaggggcagttccggtcgctgatcctgtcctacaaccagctgagcgggccgatcccgcgcgacgacgcgcaggacgagatcaacaccgtggacctctcccacaacaagctcaccggcgacccctcccacctcttcgtccccggccggcccatcggcaaggtggacctgtcgtggaactacctcgacttcgacctcagcaagctggtgttcccgccggagctcacgtacctggacctctcccacaaccgcatccggggcaccgtgccggcgtcgctggagcgcctctccacgctgcagaagctggacctcagctacaacaacctgtgcgggccgctccccaggggtcacggcgtgatcaagcacgggtgcaaaccgtacgcgcacaacgagtgccaccacgggaccccgctcgccgggtgccaggacctgtcgtgagcgcgcccgccgccgccggatcgagcggggggctccgtctccctcggcgtccgtgtgctcgctggccggtgctcttcgcgtcccgtacgtggtggtcgtggtaaagcacgacggtgcttggtgtttagctatagacaaagaggtgctgcgtggcggtaataccgatgcgcgcggctgtgaccttgagctgttaaagcgtgtacgtacgaaaacgacagctgtgtacgtgtattgtactgtactggagcgtgttatgtaccgtgtatttggtatggatccgatcggcctaatgtatcaaaggaatgttactaaatggtaattatgattgccttttttttctctaaaa

SEQ ID NO: 2373 - DNA, 1330 bp, Pennisetum glaucum
cctcgccgtcttcctgctcgtggcggcggcggcggcgacgccggcgcggtcctgcgcgccgagcgacctccacgcgctgctgagcgtgaaggcggcgctgggcaacccggcgacgctgtcgtcgtggagcccgtcatcgcccaactgctgcgcgtgggaccacctccggtgcgacgacgccgggcgcgtgaacaacgtcttcatcgacggcgccgacgacgtgcacggccagatcccgtccgccgtgggcgggctgtcggcgctcatgtcgctgtccctgttccggctgccggggctcacgggcaccatcccgccctgcctcaccgcgctctccaacctgcagttcctcaccatctcccacaccaacgtgtcgggcccgatcccgcaggccctggcgcggctccgcagcctcgactcggtggacctctccaacaacaagctgtgcggcggcatcccggcggcgttcgccgacctgcccaacctccggtcgctggacctccggcacaaccagctgacgggccccatcccggcggggctcgtgcaggggcagttccggtcgctcgtcctgtcctacaaccagctgaccggcccgatcccgcgcgacgacgcagatcaacaccgtggacctctcccacaacaagctcaccggcgacccctcccacctcttcgtccccggccggcccatcggcaaggtggacctgtcgtggaactacctcgacttcgacctcagcaagctggtgttcccgccggagctcacctacctggacctctcccacaaccgcatccggggcaccgtgccggcgtcgctggagcgcctctccacgctgcagaagctggacctcagctacaacaacctgtgcgggccgctgcccaggggccacggcgtgatcaagcacgggtgcaagccgtacgcgcacaaccagtgccgccacggaaccccgctcgccgggtgccaggacctgtcgtgagcgcgcccgccgccgccgccggatcgagcgcggggggcggctgctcctgctccgtctccctcggcgtccgtgcgctctagctgcggcgtcccgttacgcgtggccgtggggtgaaagcacggcggtgcttggtgtttagctatagacgacagagaggtgctgcgtggcggtaataccgaagcaagcgcgcggctgtgatctcgagctgttaattaaggcgtgtgtacgtacgaagaacgacagctgtgtacgtgtactgtactgtactggagcgtgttgtgtaccgtggtatttggtatggatccgatcggcctgtgatgtatctcccaaaggaatgttactaaatggtaattacgtttgcc

SEQ ID NO: 2374 - DNA, 1237 bp, Panicum virgatum
gtcgacgccggcgcggtcgtgcgcaccgagcgacctgcgcgcgctgctgagcatgaagcaggcgctgggcaacccggcgacgctgtcgtcgtggagcccgtcgtcgcccaactgctgcgcgtgggaccacctccggtgcgacgacgccgggcgcgtgaacaacgtcttcatcgacggcgccgacgacgtgcacgggcagatcccgtcggcggtggcggggctgacggcgctcatgtcgctgtccctgttccgcctgccggggctcacgggcgccatcccggcctgcctcgcggggctctccaacctgcagttcctcaccatctcccacaccaacgtctccggccccatcccggaggccctggcgcggctccgcaccctggactcggtcgacctctccagcaaccggctgagcggcctcatcccggcgtcgttcgccgacctgcccaacctccggtcgctggacctccagcacaaccagctgacgggccccatcccggcggggctcgtgcaggggcagttccgctcgctgatcctgtcctacaaccagctgaccgggccgatcccgcgcgacgacgcgcaggacgagatcaacacggtggacctctcccacaacaagctcaccggcgacccctcccacctgttcgtccccgggcggcccatcgggaaggtggacctgtcctggaactacctcgacttcgacctcagcaagctggtgttcccgccggagctgacgtacctggacctgtcccacaaccgcatccggggcaccgtgccggcgtcgctggagcgcctgtccacgctgcagaagctggacctcagctacaacaacctgtgcgggccgctccccagggggcacggcgtcatcaagcacgggtgcaagccgtacgcgcacaaccagtgccgccacgggacgccgctcgccggctgccgggacctgtcgtgagcgcgccccggtcgtggtgtgtggtgagctgatctgagcacggcgacggtgcttggtgttcttcttagctatagacaagagtgcgctgcgtggcggcaatgccgatctcgagcagttaaaagcgtgtacgtacgaaacgacagcggtggacgtgtgctgtactggagcgtgtgttatgtactgtgtatttggtatggatccgatcggccccatgtatcaaaagaatgttactaaatggtaattatgtttgtttggcttctttacaaatagaaaataaactttgctcgagaacca

SEQ ID NO: 2375 - DNA, 1987 bp, Zea mays
tcgtaccgccgccgcgcggccgtagagcccgtgcggagagccgcatggggcaaggcggcagggggcagactccaactcgaacttgcccaccaccagtccactgtccaccaccctggcggcctggcccttcaacactcgccaaggccaggccagccaactagtcaaggccgccagggggcgtctggcttctccttccttgctgcggtcctgctcctgcccagagcagccctttcgtccctccctgcgctttccctccacaccttcgcggacacacacacaaaaaattgtcagctgcccccgccccgtataaaaaacgcaccaccagtggcggccaagccatccactgccccccgcgcatcgccatggctctcgccgtccgcacgcctcggttccagcctcgaccggcctccatttctgcgcccacaacacccgcatcgacctccctcgccgccgggaacgcgaggccccgcccctgcgccggcgccgccgttcgcgcctcgcccttcaccgaggccacctcctcctcgcgctaccgccgcgacgcctggtcatacgccgccgatggctcctccaactccgcatccccgtcctccgctgccgctgctgccgcgggccgtcgggatgacgagatcgcgctgcagctgccggaactgcggaggctcctggacgtgctgagggcgtccagggggaggggcgccgaggagggcggcggacccgggagggtggcactggtgggcacagggcccggggaccccgagctgctcacgctcaaggcggtccgggccatcgaggcggcggacctggtgctctacgacaggctggtgtctaacgacgtgttggacttggtcggggagggcgccaggctgctctatgtcggcaagaccgcgggataccacagccgcacccaggaggagattcacgagctgctgctgagctttgcggaggccggtgccaatgttgtgcgcttgaaaggtggcgatcctctggtttttggaaggggtggagaagagatggatttcttacagcaacagggaattaaagttgaagttatcccaggaattacttctgcttcgggtattgcagcagagctaggcattccgttaacccatagaggtgttgctaccagtgtcagatttttaactggccactccagaaatggtgggacagatccactatatgtagctggaaatgcggctgatccagacactactttggttgtgtatatgggtttgtcaacacttccatcacttgctccaaagttaatgaagcacggcctgccaccagatacccctgctgttgcagtagagcgcgggactacaccccaacaacgaacggtgttcgcctcgttgaaggatcttgtggatgaagtcaagtcagccgatctagtttctccaactctaataattattgggaaagtggtatccttgtcacccttctgggttgagtcatctgaacatgatgcactgaaagttcagagctcgtatgcaaatgaggccagatgacaacagattttcttggtttttagtgactggacaatacttgagaaatgcaagatcccagatatgggagcacaggttcgacctggtgtacacagaaacatctcaggaagcatggatcctgaatggcggatggtagcttaagcttataacagacttggggcagaagcgcacttggactgatcatgcttgattctttggcctaatctacatgagattcacaatttttcgatttagttgagttcgacaatagttgtgtgcttctttgttactagtagccatgtacgtgcggcgcacgcgtgtttacgattctatgccctagcatagtaaggctattccaacgctgccacgttatgattttatgataatgggagtttcgtagcaccatgataatgagaaatagtgctacgaagctcttattatatgacaagtgccataaatcgtagcacttatgattttatgataatggggagcttcgtagagctctttct

SEQ ID NO: 2376 - DNA, 2088 bp, Zea mays
tgccgccgacgcgtcgccacctgtgacctgtgtccgtagagcccgtgcggacagctgggaccggaggcagactcccactcgaacttgcccacctcgacggttgttctacggtttggttcattgaacctggcctggcccttcaacactccccaaggccagccaagccaaggccgccaaggggcgtccggactccggcgtctcctccttgcttctgcccagccacagcaagccctgcctcccgtcccgccctccgctctccgcctacaccttctcccgtccaagaccacacgcgcacagaaaaaagtacagctggtcagtggtcctggtcagctgctcccgtacaaaaagcgcaccacaagcggcggccaagccgtccgctgccccccgcatcgccatggctctcgccgtgcgcacgccccgcttccagcctcgaccggcctccatttctgcgcccgcaacacccgcctcgaattccctcgccgccgccgccgccgcgaacgcgaggccccgcacctgcgccggcgccgccgtccgcgcttcgcccttcaccgaggccacctcctcctcgcgctacctccgtgacgcctggtcctacgccaccgattgctcctccaactccgcatcccgttcctccgatgccgccgctgcggcggcggcgctgggccgccgggacgacgagatcgcactgcagctgccggagctgcagaggctcctggacgcgctgagggcgtccagaaggaggggcgcagagggcggcggcggcggcggccgcggacccgggagggtggcactggtgggtacagggcccggggaccccgagctgctcacgctcaaggcggtccgggctatcgaggcggcggacctggtgctctacgacaggctggtgtctaacgacgtgttggacttggtcggggagggctccaggcttctctatgtcggcaagaccgcgggataccacagccgcacccaggaggagattcacgagctgctgctgagctttgcggaggctggtgccaatgttgtgcgcttgaaaggtggcgatcctctggtttttggaaggggtggagaagagatggatttcttacagcaacagggaatcaaagttgaaattatcccaggaattacctctgcttcaggaattgcagcagaactaggcattccgctaacccatcgaggtgttgctaccagtgtcagatttttaactggacactccagaaatggtgggacagacccactatatgtagctggaaatgcagccgatcctgacactactttggttgtgtacatgggtttgtcaacacttgcatcacttgcaccaaagttaatgaagcacggcctgccaccagatacccctgctgttgcagtagagcgcgggactacacctcaacaacgaatggtgtttgcgttgttaaaggatcttgtggatgaagtcaagtcagctgatcttgtttctccaactctaataattatcgggaaagtggtatccttgtcaccattttgggttgagtcatctgaacatgatgccctgaaaattgagagctcgtatgcaagtgaagccagatgataatacgttttcatgattttagtgattggacaatacatacttgagtaacgcaatatcccagatatgagcagttccagttgggatccatttaggacatgcgagcacaggttcgacctggtgtacacaacatttcaggaagcatggattctgaatgacggatgatagcttaagcccataacagcctttggggtttgggcagaagcgcacttgggagttgatgagggcatgtctggaggcttcagcttcagtaaatttacggctttcaattcggtgtcttcttcgtcaaagaagactcggtagatgtatggttttcaattcaatagcacctgcaaactcctttctgactggaggtccattcggagtgcagggattttacagaaattagacaaaaaaagttctgttttttggggggaattagaaaaatctctgcttcccaagcgtagataactgtaagatttttgttgtcatctttaaaataattgtattgtttttatgtgttatattcatctttaaaaactcttggt

SEQ ID NO: 2377 - DNA, 1558 bp, Brachypodium distachyon
ccccctgcccctgtgttcccatggctctcgccctccgacctccccgcttccagccgctctccgcttccatttccgtggcaaccacctcctccacctctttcgccacttccgcgaggccttcctccactcccgccgccgccatctgcgccgccgcctcctcgccgttcaccgaggccacttcatcctcgcggtaccgccgcgacgcctggtcctacaccgccgaagactcctcctccccctcctccacttcctcgtccgccgctgcagcagcggtggcggcggcggcggcttcggggcgccgggacgacgagatcgcgctgcagctaccggagctgcggaggctcctggaggtcctgagggcttccagagggaaaggactggaagaggagggcggcgccagcgggccagggagggtggcgctggtggggacggggcctggggactcggagctcctcacgctcaaggcggtgcaggccatcgaggcggcggacctggtgctgtacgatcggctcgtgtccaacgaagtgctcgatttggttggggacagcgccaggctactctacgtcggcaagacggccggataccacagccgcacccaggaagagattcatgagttgctcctcagttttgcggaggctggtgccagtgtggtgcggttgaaaggaggcgatcctctggtctttggaaggggtggagaagagatggatttcctacaacagcaaggaattagagttgaagttataccaggaatcacttctgcttcgggaattgcagctgaccttggtattccactaacccatcgaggtgttgccaccagtgtcaggtttttaactggtcactctagaaatggtgggacagatcctctatttgtggcagagaatgcagctgacccggacacaactttggttgtgtatatgggtttgtcaacactgccatctcttgctccgaagctaatgaagcatggccttccaccagatactcctgctgttgcagtagagcgtgggactacccctcaacagagaatggtattttcaatgttaaaagatcttgtggatgaagtcaaatcggcagagcttgtttctccaactctgataatcataggaaaggtggtggccttgtcacccttttgggttgaatcgtctgaacaggatgcgctgaagattgagaactcttacgcagctgagaccacaagatagcagtactcctgaaccaaatactgagtgatcccgagcaacatcatctttcggatatgaacctttccagttccctgaagacagcaggatacagggagtatgaatattacagaagacgtacataacaacctcagagaacagggttacacttgaactggtgctgagagtcgtgatttggccgaatctacagctgcgacaaatcttcattcttcaggcttcagcctagttgagtttggccaataccaatatttacagcctaactgtctgatacgctgtctgttaggctgttagccgctgtatgtcagcattttccttaaagctcatttgttcgatttgatcacaagtttttgaataagattcatgct

SEQ ID NO: 2378 - DNA, 2019 bp, Hordeum vulgare
gggactccgatcccctccgccctccgccctccaccccttcgcccatccaaaaccacaccaccacaacgaaccacccgcctccggctctccggctcctgctccggtcctcacctcacctctctcccgtataaaacaccaccccctgcctaaatccacggtccacaccccttgcgacgccatggctctcgcccttcgagcgccccgctttcagccgcttcccgcctccattcccgcgacctccaccgctttcgccagcaccgcgaggcattcctcctccgccgtcgccatctgcgccgccgcgtcgccgttcaccgaggccacgtcctcctcgagataccgccgcgacgcctggtcctacactgcccaagactcctcctctccctcgtccgccgccgccgccgctgctgctgcggcctcgggacgccgggacgacgagatcgctctgcagctcccggagctgcggaggcttctgaaggctctcagggcgtccagagggaaagggctggaggggaaggacggcggcggtgggcccgggagggtggcgctggtggggacggggcccggggacccggagctcctgacgctcaaggcggttcgggccatcgaggcagcggacctagtgctgtacgatcgcctcgtgtccaacgaggtgctcgatttggtcgcggagggcgccaggctactctacgtcggcaagacggctggataccacagtcgcactcaggaagaaattcatgagttgctcctgagctttgccgaggctggtgccaatgtggtgcggttgaaaggcggcgatcctctggtctttggaaggggtggagaagagatggattttctacagcaacaaggaattaaagttgaagttattccaggaattacctctgcttcaggaattgcagctgaacttggtattccgctaacccatcggggtgtcgctaccagtgtcagatttttaaccgggcactctagaaatggtgggacggatcctctacatgtggcagagaatgcagccgacccagacacaactttggttgtgtatatgggtttgtcaacattaccatcactagctcccaagttaatgaagcacggtcttccagcagatactcctgctgttgcagtagagcgtgggactaccccccaacagcgaatggtatttgcaatgttgaaggatcttgtgaatgaggtccactcggcagatctggtttctccaactctgataattatcggcaaggtggtggccttgtcacccctatgggttgagtcatctaaacaagatgcgcttaataatgagaactcgtcgcaactgagtccaacaatttttcctgtataaagtacaagggatgttaatgaacgtcacgcttttggaacatttccaaattgagatctaaggctatatgatctggttttaggttaggacatgcaaacacagggcatagtgaatctggacaagagagcaaacacagggagcatatattttgaataatattgcagttgcagaaggcgtacataaaaccacagagaacaagagttcagtttaaccggcggcgacagtccatgatttggcttaatctactgaactgagcatagtttagttttggtcttggaccatatgtatatctttcttgaatcaaaggtaggatctgttttgttgtctctgtcgcattactttgttttggggctactcttgaaacatgttgagcattgtatgccagtattctgtcaggctcatttgtttggtttaataacgaattttgaacaagttccacacatgatcagtcgagccgattctccctattcatggactagtctctgaaggtttcggttggaaggcaaatgcatagactagtattgcgacccttaattaatcattagttttgatatatttgaaactaacactagtatgaagtagaagatatgtgagaatgaatgcattgcaagatatgtggtccatttttttttcattgttatgtatatatcatatgtatgataaatttttccctatgttgaatgcaaaattgt

SEQ ID NO: 2379 - DNA, 515 bp, Triticum aestivum
  misc_feature (38)..(38): n is a, c, g, or t
  misc_feature (56)..(56): n is a, c, g, or t
  misc_feature (253)..(253): n is a, c, g, or t
  misc_feature (313)..(313): n is a, c, g, or t
ccacgcgtccgaaaaaggaagagcgagagcttactgtnattcgcatggcgacctcnatcatggcttctatggctctgaaatcatctccatcgccattttctgggcagtcgcagctccagcgcatccagccttcagcacgatcatcatctttcagagtaatgtccaaaaaggcaaagaaagttcagacttctcagcctttcgggcccgggggaggattggaactgaaagatggtgttgatgcatctggaaggcnagccaaggggaagggcgtctaccagtttgccagcaagtatggagcaaatgttgatgggtncagcccaatatataacccagaagaatggtctccaagtggtgactactatgcgggaggaaagacatggttgttgctctgggtggctactcttgctggaattctgctgggtggtgctctgcttgtttacaatactagtgctttggcttcttgaagcctggtatcggaaaccagattatgtaccatgcaaggatttacatcatct

SEQ ID NO: 2380 - DNA, 3700 bp, Arabidopsis lyrata
accaaatcggtttttcgtatcggcttcttccttttgctactagctctcctctcttctccgaaaatggcgtcacaaaacaaacaagaagagaaaaagaaagtgaagaagttgcaaaagagttacttcgatgttctcggaatctgttgtacatcggaagttcctatcatcgagaatattctcaaggcacttgacggcgttaaagaatattccgtcatcgttccctcgagaaccgtgatcgttgttcacgacagtctcctcatctctcccttccaaattgctaaggcattgaaccaagctaggttagaagcaaacgtgagagtaaacggagaaaccaacttcaagaacaaatggccgagccctttcgcggtggtttccggcatacttctcctactctccttcttaaagtttgtctactcgccgttacgttggctcgcagtcgcagcagttgccgccggtatttatccgatacttgccaaagcctttgcttccattagaaggcttaggatcgacatcaatatattggtcattataaccgtgatagcaacacttgcaatgcaagatttcatggaggctgcagcagttgtgttcttgttcaccatatccgactggcttgaaacaagagctagctacaaggcaacagcggtaatgcagtctttgatgagcttagctccacagaaggcaataatagcagagactggtgaagaagttgaagtagatgaggttaagattagcacagttgtagcggttaaagctggtgaaaccataccaattgatggaattgtggtggatggaaactgtgaagtagacgagaaaaccttaaccggcgaagcatttcctgtacctaaacagagagattctacggtttgggctggaactatcaatctaaatggttacataagtgtgaaaacaacttctttagcgggtgattgcgtggttgcgaagatggctaagctagtagaagaagctcagagcagtaaaaccaaatcccaaagactaatagacaaatgttctcagtactatactccagcaatcatcgtagtatcagcttgcgtcgccattgtcccggttattatgaaggtccacaaccttaaacattggttccacctggcattagttgtgttagtcagtggctgtccctgtggtcttatcctctctacaccagttgctactttctgtgcacttactaaagcagcaacttccgggcttctgatcaaaagtgctgattatctggacactctctcaaagatcaagatcgctgctttcgacaaaaccgggactattacaagaggagagttcattgtcatagatttcaagtcactctctagagatataagcctacgcagcttgctttactgggtatcaagtgttgaaagcaaatcaagtcatccaatggctgcaacaatcgtggactacgcgaaatccgtttctgttgagcctaggcctgaagaggttgaagattaccagaattttccaggtgaaggaatctatgggaagattgatgggaacgatatctacatcgggaacaaaaggattgcttctcgagctggttgttcaaccgttccagagactgaaattgataccaaaggtgggaagactgttggatacgtctatgtaggtgaaagactagcgggagttttcaatctttctgatgcttgtagatccggtgtatctcaagcaatgacggaactgaaatctctaggcatcaaaaccgcaatgctaacgggagatagtcaagccgcggcaatgcatgctcaagaacagctagggaatgttttagatgttgtacatggagaacttcttcctgaagataaatccaaaatcatacaagagtttaagaaagaaggaccaaccgcaatggtaggggacggtgtgaatgatgcaccagctttagctacagctgatattggtatctccatgggaatctctggctcggcgcttgctacgcagactggtcatattattctaatgtctaatgacataagaaggataccacaagcggtaaagctagcgagaagagctcggcgcaaagttgttgaaaacgtgtttctttcaatcgttttaaaagctggaatacttgctttggcgtttgctggtcatcctttgatttgggcagctgttcttgttgatgtagggacttgtcttcttgtgattctcaatagtatgttgctgctgcgagagaagaaaaagattgggaacaaaaagtgttacagggcttctacatctatgttgaatggtaggaaactcgaaggcgatgatgatgatgttgtggacttagaagcaggcttgttaaaaaagagcgggaatggtcaatgtaactcaagctgttgtggagataagaaaaatcaagagaaggttgtgatgatgaaaccaagtagtaaaaccagttctgatcattctcaccctggttgttatggcgataagaagcaagacaaagtgaagccgcttgtgagagatggttgttgcggtgaggaaactaggaaagcagtgggagacattatttcattgagctcatgtaagaagtctagtcatgtcaaacatgacttgaaaatgaaaggtggttcaggttgttgtgctaacaaaagtgagaaggtagaggaagtagtggcaaagagctgttgtgagaaatcaaaacagcaaatggagagtgctggagactgcaaatctagccattgcgaggagaagaagcatgctgaggaaattgttgtcccggtgcagattattggtcaggcattaactggtttggaaatagagttgcagagaaaggaaccctgcaaaacaagctgttgtgacaataaagaggagaaggttaaggaaataggtttgttgcttgctagtgaggacaaatcttacccggagaaaggagtgctgattaaagatgaaggaaactgcaagtctggctgcgagaacaaggggacagtgacacaaaggtgccatgagaaggcagctgcagtgatgaaaaacaaaccggggaaataactcttgcttctgaggaagagacagacgatcaagattgctcctcgggatgttgtgtgaatgaggggatagtgaaacaaagctcccatgagaagaagcatgctgtgttggtggagaaggaaggtttggacatggaaactggtgtatgttgtgatgatctcaagttggtttgttgtggaaacacagaaggggaagtggaggagcaatgtgatctggagataaagaatgaaggacattgcaagtctggttgctgcaacgatgaaaagcaaacagcggaaatcactctagcttcagaggaagagacagacagcacggattgttcctcgggatgttgtatggacaaagaagaagtgacaaaaatctgtggtgagaagcctgttagcttggtggtttcaggcttggaaatgaagaaggatgagcattgtgagagctcaaacagagccgtgaaggtagagacctgttgcaaagtgaagattccagaggcttgcgcatcaaaatgtagggaaagagagaagcgtcacagtggtaaaagctgttgcaggagttacgcaaaagagttttgcagccaccgccaccatcatcaccaccaccaccatcaccatcaccatgtgagtgcttgacgcatccatctattcacaaaacattccattaatggcgaaataaaaaaacatggataaatttgttccagcaaaggcagtagtatagattaagcaactgtgttattcat

SEQ ID NO: 2381 - DNA, 1109 bp, Hordeum vulgare
agctaccagtagcacatacactaacaatggcgatggcaagggtgcccatcctcgtcgccgtggccctcatggccgcgtcggcctcctgcagcgcatgggatcccaccatccggatggtcgacgacgcggtggcgccgctcatccacgcgctgcggccgctgctgggctccggcgggcagctggggagccgcggcggcgtgccgtgcgacagctggaggctgggcgtggaggcgtacaacgtgcgggactggaagacggtgccggccaactgcgagggctacgtggggcactacatgctcggcaaccacttccggcgcgactgcaaggtcgtcatcgaccaggccatcgcctacgtcgacggcctcaagctcgccggcaacggcaaggacgtgtgggtcttcgacatcgacgagaccaccctctccaacctcccttactacgccacgcacggctttggggctaggccatacaacgcgacgagcttcgacgcgtacgtgatggaggggagtgcaccggtgctgccggagacgaagcggctctactacaagctactcaaggtgggcatcaagccggtattcatcacaggccggacggaggataagagggccgtcaccgtcgggaacctccgcagccagggcttctccgggtggatgagcctgacgctcaagcaacatgggttcaagggctccgccatatcctacaagtccgccgagaggaagaagctggaggatgccgggtacgtcatcgtcggcaacatcggcgaccagtggagcgacatcctcggcgcgcccgagggcgctcgcaccttcaagctgcctgaccccatgtactacatcgcctaggtcggttgcggctatttgattgccccgtgctcgtggtccacgaataataagaatatagtagactttgttggtttctttgaaaccaagaaggagaacattaatagtaccactttgaacaatattgctggtaataagaattttggcatcaactatctgcccaaaaaacagttggtggtgtccttgtgggcattaatagtgatatctatgagattattggctttgtcaatagaaaattctgtgtgactgctacagttaaaaataatactc

SEQ ID NO: 2382 - DNA, 1207 bp, Triticum aestivum
gctagcagtaacaatggcgatggcaagggtgcccatcctcatcgcggtggctctcgtggccgcggcggcctcctgcagcgcatgggagcccaccatccgtatgccgacggcggaggctgcggccgctgccgtcgacgacgccgtggcgccgctcatccacgcactgcgtccgctgctgggctccagcggagagctcggcagccgcggcggcgtgccgtgcgacagctggaggctgggcgtggaggcgtacaacgtgcgtgactggaagactgtccccgccaactgcgagggctacgtgggccactacatgctgggcagccatttccggcgcgactccaaggtcgtcatcgaccaggccatcgcctacgtcgacagcctcaagctcgccggcaacggcaaggaggtgtgggtcttcgacattgacgagaccacgctctccaacctcccttactacgccacgcacggctttggggctaggccatacaacgcgacgagcttcgacgcgtacgttcttgagggaaccgcgccggtgctgccggagacgaagcggctctactacaagctactcaaggtgggcatcaagccggtgttcatcacaggccggacggaagacaagagggccatcaccgtcggaaacctccgcagccagggcatctccgggtggatgaacctgacgctcaagcagcccgggttccatggctccgcgatatcctacaagtccgccgagaggaagaagctgcaggacgccgggtacgtcatcgtcggcaacataggcgaccagtggagcgatctcctcggcgcgcccgagggagctcgtactttcaagctgcccgaccccctgtactacatcagctaagcttgcggccattcattggacgaatgctcgtggtccacgaataagctccatgctcttaataattatctgcatgctggatgcatcaataataagcttctgtgttgttcttgcttggttggtttacttagttcatatcaattgccactagtacattggctacagattttcttttctttgggaatccatgggctattgttgcttgatgtgttgttatccatcataatttcgttcttgtacaattgcatgacatcggtcttttgactgttatttttgccctataaacaacattactgtgatataaggacatctaaagtatcaaaaagcaagaagagagaagggtgaaaaaaaaaa

SEQ ID NO: 2383 - DNA, 1718 bp, Triticum aestivum
  misc_feature (1481)..(1481): n is a, c, g, or t
  misc_feature (1611)..(1611): n is a, c, g, or t
caagaagcagagcaccacaggcagctagcagtaacaatggcgatggcaagggtgcccatcctcatcgcggtggctctcgtggccgcggcggcctcctgcagcgcatgggagcccaccatccgtatgccgacggcggaggctgcggccgctgccgtcgacgacgccgtggcgccgctcatccacgcactgcgtccgctgctgggctccagcggagagctcggcagccgcggcggcgtgccgtgcgacagctggaggctgggcgtggaggcgtacaacgtgcgtgactggaagactgtccccgccaactgcgagggctacgtgggccactacatgctgggcagccatttccggcgcgactccaaggtcgtcatcgaccaggccatcgcctacgtcgacagcctcaagctcgccggcaacggcaaggaggtgtgggtcttcgacattgacgagaccacgctctccaacctcccttactacgccacgcacggctttggggctaggccatacaacgcgacgagcttcgacgcgtacgttcttgagggaaccgcgccggtgctgccggagacgaagcggctctactacaagctactcaaggtgggcatcaagccggtgttcatcacaggccggacggaagacaagagggccatcaccgtcggaaacctccgcagccagggcatctccgggtggatgaacctgacgctcaagcagcccgggttccatggctccgcgatatcctacaagtccgccgagaggaagaagctgcaggacgccgggtacgtcatcgtcggcaacataggcgaccagtggagcgatctcctcggcgcgcccgagggagctcgtactttcaagctgcccgaccccctgtactacatcagctaagcttgcggccattcattggacgaatgctcgtggtccacgaataagctccatgctcttaataattatctgcatgctggatgcatcaataataagcttctgtgttgttcttgcttggttggtttacttagttcatatcaattgccactagtacattggctacagattttcttttctttgggaatccatgggctattgttgcttgatgtgttgttatccatcataatttcgttcttgtacaattgcatgacatcggtcttttgactgttatttttgccctataaacaacattactgtgatataaggacatctaaagtatcaaaaagcaagaagagagaagggtgaataggagatttccaaagaaaagaaaatctgtagccaatgtactagtggtaattgatatgaactaagtaaaccaaccaagcaagaacaacacagaagcttattattgatgcatccagcatgcagataattattaagagcatggagcttattcgtggaccacgagcattcgtccaatgaatggccgcaagcttagctgatgtagtacagggggtcgggcagcttgaaagtacgacctgcccgggcggcgctcaaatcccggncatggcggcgggagcatgcagtcggcccatcgcctatatgatctatacattcatggcgtcgttacacgtctgactggaaacctgcgtacccactatcgctgcacacatcccttcgcactgcgtatacganagccgcacgatgctcactgcactagcatgcccttcgctaccggttggtaccatgctatcagcagcgctgttctcttcctgcgtccgatacgtctagcttgtcgcaca

SEQ ID NO: 2384 - DNA, 1208 bp, Triticum aestivum
  misc_feature (4)..(4): n is a, c, g, or t
  misc_feature (8)..(8): n is a, c, g, or t
  misc_feature (14)..(33): n is a, c, g, or t
  misc_feature (35)..(35): n is a, c, g, or t
  misc_feature (37)..(39): n is a, c, g, or t
  misc_feature (41)..(42): n is a, c, g, or t
  misc_feature (45)..(45): n is a, c, g, or t
  misc_feature (48)..(48): n is a, c, g, or t
  misc_feature (50)..(51): n is a, c, g, or t
  misc_feature (59)..(59): n is a, c, g, or t
  misc_feature (61)..(61): n is a, c, g, or t
  misc_feature (63)..(63): n is a, c, g, or t
  misc_feature (67)..(67): n is a, c, g, or t
  misc_feature (69)..(69): n is a, c, g, or t
  misc_feature (72)..(72): n is a, c, g, or t
tttncggnattttnnnnnnnnnnnnnnnnnnnngngnnncnnggnccntnncttggttnangnggtnanaancccctcaagaagcagagcaccacagggtagctaggctagcagtaacaatggcgatggcaagggtgcccatcctcatcgcggtggctctcgtggccgcagcggcctcgtgcagcgcctgggagcccaccatccgtatgccgacggcggaggctgcggctgctgcggtcgacgatgccgtggcgccgctcatccacgcgctgcgcccgctgctgggctccagcggagagctcggcagccgcggcggcgtgccgtgcgacagctggaggctaggcgtggaggcgtacaacgtgcgtgactggaagactgtccctgccaactgcgagggctacgtggggcactacatgctcggcagccacttccggcgcgactccaaggtcgtcatcgaccaggccattgcctacgtcgacagcctcaagctcgctggcaacggcaaggaggtgtgggtcttcgacatcgacgagaccacgctctccaacctcccttactacgccacgcacggctttggggctaggccatacaacgcgacgagcttcgacgcgtacgtgctggaggggaccgcgccggcgctgccggagagtaagcggctgtactacaagctgctcaaggtcggcatcaagccggtgttcatcacaggccggacggaagacaagagggcgatcaccgtggccaacctccgcagccagggcatctccgggtggatgaacctgacgctcaagcagcccgggttccatggctccgcgatatcctacaagtccgccgagaggaagaagctgcaggacgccgggtacgtcatcgttggcaacatcggcgaccagtggagcgacctccttggcgcgccagagggagctcgtaccttcaagctgcctgaccccctgtactacatcggctaagcctgcggccattgattgctcgaatgctcgtggtccacgaataagctccatgctcttaataattatctgcatgctggatgcatcaataataagcctctgtgttgttcttgcttggttggtttacttagttcatatcaattgccactactacattggctacagcttttcttttctttggcaatccacgggatattgttgcttgatgtgttgttatccatcataatttcgttcttgtacaattgcatg

SEQ ID NO: 2385 - DNA, 1270 bp, Leymus cinereus x Leymus triticoides
  misc_feature (5)..(8): n is a, c, g, or t
  misc_feature (1010)..(1010): n is a, c, g, or t
  misc_feature (1239)..(1239): n is a, c, g, or t
ggagnnnncaccacagggtagctagcagtagcacagacactaacaatggcgatggcaagaatgccaatcctcgtcgccgtggctctcgtggccgcagcggcctcctgcagcgcatgggagcccaccatccggatgccgacggcggaggctgcggctgctgccgtagatgatgccgtggcgccgctcatccatgcgctgaggccgctgctgggctccggcgggcagctcgggagccgcggcggcgtgccgtgcgacagctggcggctgggcgtggaggcgtacaacgtgagggactggaagacggtcccggccaactgcgagggctacgtgggccactacatgctcggcggccacttccggcgcgactccaaggtcgtcattaacgaggccatcgcctacgtcgagagcctcaagctcgccggcaacggcaaggaggtgtgggtcttcgacatcgacgagaccacgctctccaacctcccttattacgccacgcacggctttggggctaggccatacaacgcgacgagcttcgatgcgtacgtgctggaggggaccgcgccggcgctgccggagacgaagcggctgtactacaagctactcaaggtgggcatcaagccggtgttcatcacaggccggacagaagacaagagggccatcaccgtctccaacctccgcagccagggcatctccgggtggatgaacctgaggctcaagcagcccgggttcaagggctccgcgatatcctacaagtccgccgagaggcagaagctgcaggacgccgggtatgtcatcgtcggcaacatcggcgaccagtggagcgacatcctcggcgcacctgagggcgctcgcaccttcaagctgcccgaccccatgtactacatcggctaggtcagctggggccattgattctcgaatgctcgtggtccacgaataagctccatgctcttaataattatctgcatgctcgatgcatgaataataatccactgttgttgttgtttggttggttnacttagttcatatcagttgctactactctatgggctactgcttttcttttctttgtgaatccacgggctattattgttgcttgatgtgttgttcaacgccataatttcgatcttgtacaattgcatgacatatcggtctttcgactgtacatgtctgtctagctgcaaatgttgagccgggccacatctgggtagcacatgtactacagggccccggcgtacgtcaagntttaaactggaaaagtttttttaaaaaaaaa

SEQ ID NO: 2386 - DNA, 1095 bp, Triticum aestivum
ggtagctaggctagcagtaacaatggcgatggcaagggtgcccatcctcatcgcggtggctctcgtggccgcagcggcctcgtgcagcgcctgggagcccaccatccgtatgccgacggcggaggctgcggctgctgcggtcgacgatgccgtggcgccgctcatccacgcgctgcgcccgctgctgggctccagcggagagctcggcagccgcggcggcgtgccgtgcgacagctggaggctaggcgtggaggcgtacaacgtgcgtgactggaagactgtccctgccaactgcgagggctacgtggggcactacatgctcggcagccacttccggcgcgactccaaggtcgtcatcgaccaggccattgcctacgtcgacagcctcaagctcgctggcaacggcaaggaggtgtgggtcttcgacatcgacgagaccacgctctccaacctcccttactacgccacgcacggctttggggctaggccatacaacgcgacgagcttcgacgcgtacgtgctggaggggaccgcgccggcgctgccggagagtaagcggctgtactacaagctgctcaaggtcggcatcaagccggtgttcatcacaggccggacggaagacaagagggcgatcaccgtggccaacctccgcagccagggcatctccgggtggatgaacctgacgctcaagcagcccgggttccatggctccgcgatatcctacaagtccgccgagaggaagaagctgcaggacgccgggtatgtcatcgttggcaacatcggcgaccagtggagcgacctcctcggcgcgcccgagggagctcgtactttcaagctgcccgacccactctactacatcggctagggctgccgccattgattgctcgaatgctcatggtccacgaataagcctatgctcttaataattatctgcatgctggatgcatcaataataagcctctgtgttgttcttgcttggttggtttacttagttcatatcaattgccactactacattggctacagcttttcttttctttggcaatccacgggatattgttgcttgatgtgttgttatccatcataatttcgttc

SEQ ID NO: 2387 - DNA, 1130 bp, Triticum aestivum
gcacctcaagaagtagagcaccacagggtagctagcagtaacaatggcgatggcaagggtgcccatcctcatcgcggtagctctcgtggctgcagcggcctcctgcagcgcatgggagcccaccatccgtatgccaacggccgaggctgcagctgctgcggtcgacgacgcggtggcgccgctcatccacgcactgcgcccgctgctgggctccagcggagagctcggcagccgcggcggcgtgccgtgcgacagctggaggctgggcgtggaggcgtacaacgtgcgtgactggaagactgtccccgccaactgcgagggctacgtggggcactacatgctcggcagccacttccggcgcgactccaaggtcgtcatcgaccaggccattgcctacgtcgacagcctcaagctcgccagcaacggcaaggagggtgtgggtcttcgacatcgacgagaccacgctctccaacctcccttactacgccacgcacggcttcggggctaggccatacaacgcgacgagcttcgacgcgtacgtgctggaggggaccgcgccggcgctgccggagagtaagcggctgtactacaagctgctcaaggtgggcatcaagccggtgttcatcacaggccggacggaagacaagagggccatcaccgtcgccaacctccgcagccagggcatctccgggtggatgaacctgacgctcaagcagcccgggttccatggctccgcgatatcctacaagtccgcccagaggaagaagctgcaggacgccgggtatgtcatcgttggcaacatcggcgaccagtggagcgacctcctcggcgcgcccgagggagctcgtactttcaagctgcccgacccactctactacatcggctagggctgccgccattgattgctcgaatgctcatggtccacgaataagcctatgctcttaataattatctgcacgctcgatgcatctctcaataataataatccactctgcccttgttgcttactagttgatatgaattgctactgctccatgggctactgtttttttttcttttctttaggaggccacgggttattgttgcttgatgtgttgttatctgtcataatttctttcttgacaattgca

SEQ ID NO: 2388 - DNA, 1036 bp, Triticum aestivum
taagcagagcaccacagagctagcagtagcacacactaacaatggcgatggcaaaggtgcccatcctcgttgccgtggctctcatggccgcggtggcctcctgcagtgcaagggagcccaacatctgtatgccgctggcggaggttgcggcgactgctgctgatgacgccgtggcgccactcatccacgcgttgcggccgcttctgggctccggcgggcagctcgggagccacggcggcgtgccgtgcgacagctggcggctgggcgtggaggcgtacaacgtgcgggactggaagatggtccccgccaactgcgagggatacgtgggccactacatgctcggcagccactaccgccgcgactccaaggtcgtcatcgaccaggccatcgcctaccttgacagcctcaggctcgccggcaatggcaaggaggtgtgggtcttcgacatcgacgaaaccatgctctccaatctaccttactacgccacgcacggcttcggggctaggccgtacaatgcgacgagctacaacgcgtacgtgctggaggggagcgcgcctgcgctaccagagacaaagcggctgtacaacaagctgctcacagtgggcatcaagccggtgttcctaacgggccggaccgaggaccagagggccatcacagttgccaacctccgccgccaaggcatctccggatggatgtacctgctgctcaagcaaccagggttcaagggctccgcagtgatctacaaatccggcgagaggcaaaagctgcaggacgctgggtatgtcatcgtgggaaacatcggcgaccagtggagcgacatcctcggcgcacccgagggtgctcgcactttcaagctgcccgaccccatgtactacatcggctaggcccgcagccatcgatttcttgtggtcgatgaataagctccttctgaataattatatacatgatcccgtctgttgttgttgcttggttagtttcctcagttgggatcaattggtattatcaataagacgtacgggagtaaaatggatgttgc

SEQ ID NO: 2389 - DNA, 1043 bp, Triticum aestivum
taagcagagcaccacagagctagcagtagcacacactaacaatggcgatggcaaaggtgcccatcctcgttgccgtggctctcatggccgcggtggcctcctgcagtgcaagggagcccaacatctgtatgccgctggcggaggttgcggcgactgctgctgatgacgccgtggcgccactcatccacgcgttgcggccgcttctgggctccggcgggcagctcgggagccacggcggcgtgccgtgcgacagctggcggctgggcgtggaggcgtacaacgtgcgggactggaagatggtccccgccaactgcgagggatacgtgggccactacatgctcggcagccactaccgccgcgactccaaggtcgtcatcgaccaggccatcgcctaccttgacagcctcaggctcgccggcaatggcaaggaggtgtgggtcttcgacatcgacgaaaccatgctctccaatctaccttactacgccacgcacggcttcggggctaggccgtacaatgcgacgagctacaacgggaacgtgctgaaggggagcgcgcctgcgctaccagagacaaagcggctgtacaacaagctgctcacagtgggcatcaagccggtgttcctaacgggccggaccgaggaccagagggccatcacagttgccaacctccgccgccaaggcatctccggatggatgtacctgctgctcaagcaaccagggttcaagggctccgcagtgatctacaaatccggcgagaggcaaaagctgcaggacgctgggtatgtcatcgtgggaaacatcggcgaccagtggagcgacatcctcggcgcacccgagggtgctcgcactttcaagctgcccgaccccatgtactacatcggctaggcccgcagccatcgatttcttgtggtcgatgaataagctccttctgaataattatatacatgatcccgtctgttgttgttgcttggttagtttcctcagttgggatcaattggtattatcaataagacgtacgggagtaaaatggatgttgcctggtgc

SEQ ID NO: 2390 - DNA, 1169 bp, Triticum aestivum
cacagagctagcagtagcacacactaacaatggcgatggtaaggatgcccatcctcgttgccgtggctctcgtggccgcagtggcctcctgcagcgcaagggagcctaacatctgtacgccgatggcggaggttgcagcaactgctgtagatgacgccgtggcgccgctcatccacgcgttgcggccactactgggctccggcgggcagctcgggagccacggcggggtgccgtgcgacagctggcggctgggcgtggaggcgtacaacgtgcgggactggacgacggtccccgccaactgcgagggatacgtgggccactacatgctcggcagccactaccgccgcgactccaaggtcgtcatcgaccaggccatcgcctaccttgacagcctcaagctcgccggcaacggcaaggaggtgtgggtcttcgacatcgacgagaccatgctctccaacctaccttactacgccactcacggcttcggggccaggccgtacaacgcgacgagctacaacgcttatgtgttggaggggagcgcgcctgcgctaccggagacaaaacggctgtactacaagctgctcgcggtgggcatcaagccagtgttcctaacaggacggaccgagcaccggagggccatcacagttgccaacctctgccgccagggcatctccggatggatgaacctgctcctcaagcaaccatggttcaagggttccacggtgacctacaagtctggcgagaggcagaagctgcaggacgctgggtacgtcgtcgtgggaaacatcggcgaccagtggagcgacatcctcggcgctcccgagggcgctcgcaccttcaagttgcccgaccccatgtactacatcggctaggcccgcagccatccattgcttgtggtcgatgaataagctccatcttctgaataattagatgcatgatcccgtctgttgttgttgcttggttagtttcctcagttgggatcaattgctactatcaataagacgtatgggagtcaaatggatcttgctcaatcaatggatccatgggctgctgctttttcttcttcttttttttcatgaaattcatggggtattgttgtttgatgtgtggttcgtctgtcataattgatcatgttcaattgggtgaaaaaaaaaaaaaaaactcgtgcc

SEQ ID NO: 2391 - DNA, 1172 bp, Triticum aestivum
gcacgaggctgcaataagcagagcaccacagagctagcagtagcacacactaacaatggcgatggtaaggatgcccatcctcgttgccgtggctctcgtggccgcagtggcctcctgcagcgcaagggagcctaacatctgtacgccgatggcggaggttgcagcaactgctgtagatgacgccgtggcgccgctcatccacgcgttgcggccactactgggctccggcgggcagctcgggagccacggcggggtgccgtgcgacagctggcggctgggcgtggaggcgtacaacgtgcgggactggacgacggtccccgccaactgcgagggatacgtgggccactacatgctcggcagccactaccgccgcgactccaaggtcgtcatcgaccaggccatcgcctaccttgacagcctcaagctcgccggcaacggcaaggaggtgtgggtcttcgacatcgacgagaccatgctctccaacctaccttactacgccactcacggcttcggggccaggccgtacaacgcgacgagctacaacgcttatgtgttggaggggagcgcgcctgcgctaccggagacaaaacggctgtactacaagctgctcgcggtgggcatcaagccagtgttcctaacaggacggaccgagcaccggagggccatcacagttgccaacctctgccgccagggcatctccggatggatgaacctgctcctcaagcaaccatggttcaagggttccacggtgacctacaagtctggcgagaggcagaagctgcaggacgctgggtacgtcgtcgtgggaaacatcggcgaccagtggagcgacatcctcggcgctcccgagggcgctcgcaccttcaagttgcccgaccccatgtactacatcggctaggcccgcagccatccattgcttgtggtcgatgaataagctccatcttctgaataattagatgcatgatcccgtctgttgttgttgcttggttagtttcctcagttgggatcaattgctactatcaataagacgtatgggagtcaaatggatcttgctcaatcaatggatccatgggctgctgctttttcttcttcttttttttcatgaaattcatggggtattgttgtttgatgtgtggttcgtctgtcataattgatcatgttcaattgggtga

SEQ ID NO: 2392 - DNA, 1431 bp, Glycine max
attgtttgtcattgcaaagcgcaaattaaagcgcaaaaaccattctccttcggtgctcttgaaaacatgggaaaacagagcacagaattctctgccctcaactgcatcgacctctccaaccctgacatcaaccaatccgtcaatttactcaaacaggcatgtttggattccggttttttctacgttgtcaatcatggaataagccaggaattcatggaagaggtttttgcacagagcaagaaattcttctctcttcctcacaaggagaagatgaagattctcaggaatgaaaaacacaggggatacacccctgttcttgatgagttgcttgatcctgaaaaccaagtgcatggagactacaaagaggggtattatattggagttgaaaaaggtgaagatgacccagaatcgaataaacctttttatggaccgaataactggcccgcaccaggtgttcttccagggtggagggagaccatggaaaagttccatagagagacattagaagtagggaaagcagttgcaaagataatagcccttgcacttgatttggatgctaatttttttgatcagccagaaatgcttggagagcccattgcaactctgcgtttgctgcactatgaaggtcaagtttcggatcccttgaaaggattatatggagctggagctcatactgactatggtttaattacactgttagcaacagatgatgtctcgggtcttcaaatatgcaaagatagggatgctaaacctcagaaatgggaggatgtagcaccattgaagggagcattcatagtgaatcttggtgacatgctggagcgctggagcaactgcgtttttaagtccacactgcacagagttctaggaaacggtcaaggaagatattctattgcatacttcttggagcccagtcatgattgtctagtggagtgcttgcctacctgcaaatcagacagtaatccgcccaaatttcctcccatcttatgccatgactacctaactcagcgctacaacgacactcatgctgacttgaatgtttataagaaacaacaagcttgagtagtcaacctttggaactgaacagcctggagatttctcacaaggacactcacctaagctgatttggatgtttacaataaacaacatgcttaagaagttagtcttttggagctgagcagctggggaattttggactgcattatgtgttagagttaacagcatcatattgcattggcgatgttatgtagaatttgtttgaatggcaaattagttttgttttgtggaaggggggattcagctgtatggtttggtacttaatgttaaacctaaaagaaaaacatgtatgaaattagcagatgtattttttttattcagcactaaagttgggaaatgggaatgataggaagatgaaaaatgaaaattagtattttg

SEQ ID NO: 2393 - DNA, 1504 bp, Glycine max
tcattgcaaagcgcaaattaaagcgcaaaaaccattctccttctttgctcttcaaacatgggaaaacagagcacagaattctctgccctcaactgcatcgacctctccaaccctgacatcaaccaatccgtcaatttactcaaacaggcatgtttggattccggttttttctacgttgtcaatcatggaataagccaggaattcatggaagaggtttttgcacagagcaagaaattcttctctcttcctcacaaggagaagatgaagattctcaggaatgaaaaacacaggggatacacccctgttcttgatgagttgcttgatcctgaaaaccaagtgcatggagactacaaagaggggtattatattggagttgaaaaaggtgaagatgacccagaatcgaataaacctttttatggaccgaataactggcccgcaccaggtgttcttccagggtggagggagaccatggaaaagttccatagagagacattagaagtagggaaagcagttgcaaagataatagcccttgcacttgatttggatgctaatttttttgatcagccagaaatgcttggagagcccattgcaactctgcgtttgctgcactatgaaggtcaagtttcggatcccttgaaaggattatatggagctggagctcatactgactatggtttaattacactgttagcaacagatgatgtctcgggtcttcaaatatgcaaagatagggatgctaaacctcagaaatgggaggatgtagcaccattgaagggagcattcatagtgaatcttggtgacatgctggagcgctggagcaactgcgtttttaagtccacactgcacagagttctaggaaacggtcaaggaagatattctattgcatacttcttggagcccagtcatgattgtctagtggagtgcttgcctacctgcaaatcagacagtaatccgcccaaatttcctcccatcttatgccatgactacctaactcagcgctacaacgacactcatgctgacttgaatgtttataagaaacaacaagcttgagtagtcaacctttggaactgaacagcctggagatttctcacaaggacactcacctaagctgatttggatgtttacaataaacaacatgcttaagaagttagtcttttggagctgagcagctggggaattttggactgcattatgtgttagagttaacagcatcatattgcattggcgatgttatgtagaatttgtttgaatggcaaattagttttgttttgtggaaggggggattcagctgtatggtttggtacttaatgttaaacctaaaagaaaaacatgtatgaaattagcagatgtattttttttattcagcactaaagttgggaaatgggaatgataggaagatgaaaaatgaaaattagtattttgctttcatcccttgcttctagtctctttactttggcgtctttatctgaattgatttgaaaatatacattacaaattgcattcc

SEQ ID NO: 2394 - DNA, 1591 bp, Sorghum bicolor
ccggccagcaccagcaagtgagagtcctcacctcacctcaccccaccccaccccaccccaccgaacaatggcggcggcggcggcggcgacttccacagcctccgcgccctcctcctccttcccctccacctgcagggctagggccagggtcggggcccggccatccctcgtctctctccgcgtcagagcagcgaatcccgccacggtcaacgttaccaccgcctccgatcccgccccggtcttccagtccgtcacggccttcgcgccagccaccgtcgccaacctcggcccgggcttcgacttcctcggatgcgccgtcgctgacgcctccctctccctgggcgacaccgtcaccgcaaccctcgaccccacactcccgcccgccaccgtctccatcgcctccgtcacatccccgtcccgcccccacctcgccgaccgcctctccaaggacccgctccgcaactgcgcgggcgtcgccgccatcgccgcgctccgcgccctcggcgtccgctcccacgccgtctccatccaccttaccaagggcctgccgctcggctcggggctcggctcttccgcggcctccgccgccgccgccgccaaggccgtcgacgccctcttcggctcgcgcctcgcccgcgacgacctcgtcctcgcggggctcgagtccgagaaggccgtcagcggcttccacgccgacaacatcgcccccgccatcctcggcggcttcgtcctcgtccgcagctacgaccccttccacctcgtcccgctctgctccccgcccgcgctccgcctccacttcgtcctcgtcacccccgacttcgaggctcccacgagcaagatgcgcgccgcgctgcccaaacaggtcgacgtccaccagcacgtgcgcaactccagccaggcagcggcgctcgtggcggcggtgctgcaaggggatgcgggcctcatcggctccgcgatgtcgtccgacagcatcgtcgagcccaccagggcacccctcatacctggcatggcggccgtcaaggcggcggccctgcaagctggagcgctgggctgcacaattagcggcgcgggccccacagcggtggccgtcatcgaaggggaggaaaagggggaggaggttgcccgcaggatggtggacgccttctggagcgcaggcaaactcaaggcgactgcaaccgtcgctcagctcgatacccttggtgccagggtcatcgccacatcatccttggactagccaaagattacggaggcctccacttgggaactggtgctgtaattctatctaggaatacctgttagcccaaggaagagtatgctgggtgggaagggaacccatggattgtatgtctttcgcgcatcttcttgtatcactaagtactttaggtggtcggtttatgtgggttctgaggtagcaaaaatgaaaccattaattgattgtcttggctttgcaataagttagtgatagggacatggcctccatcggcaggagatgtcgaaacgctcattttggcagaataatccgtgggctgtaatttcaatttgggctggtttccgcatcacgccatgatcatgaataaggaaattattaatc

SEQ ID NO: 2395 - DNA, 1500 bp, Oryza sativa
gactcccactcgtcaaccacccaaaccccccaccactaccgagtaccaaatggcggcggcggcggcggcggcggcggcgccctctccggctccctgcttcccttccacccgccacacgctgcctgggctcgtatctgtccgcgtctctcggagagtcaaagtcgccgtcgccatcgccgaccccgctccggccttcaactccgtcacggccttcgcgcccgccaccgtcgccaacctcggcccgggattcgacttcctcggctgcgccgtcgccgacgcctccctctccctcggcgacaccgtcaccgctaccctcgacccctccctgccccccggcaccgtcgccatcgcatccgtcacctccccctcccgccccaccctcgccgaccgcctctcccgcgaccccctccgcaactgcgccggagtcgccgccatcgctgcccttcgcgccctcgatgtcaagtcccacgccgtctccatccacctcaccaagggcctccccctcggctccggcctcggctcctccgccgcctccgccgccgccgctgccaaggccgttgacgccctcttcggctccctcctacaccaagatgacctcgtcctcgcgggcctcgagtccgagaaagccgtcagtggcttccacgccgacaacatcgccccggccatcctcggcggcttcgtcctcgtccgcagctacgaccccttccacctcatcccgctctcctccccacctgccctccgcctccacttcgtcctcgtcacgcccgacttcgaggcgcccaccagcaagatgcgtgccgcgctgcccaaacaggtggccgtccaccagcacgtccgcaactccagccaagcggccgcgcttgtcgccgctgtgctgcaaggggacgccaccctcatcggctccgcaatgtcctccgacggcatcgtggagccaaccagggcgccgctgattcctggcatggctgcggtcaaggccgcggcgttggaagctggggcattgggctgcaccatcagtggagcagggccaactgctgtggctgtcattgacggggaggagaagggcgaggaggttggccggaggatggtggaggcattcgccaatgccggcaatctcaaagcaacagctactgttgctcagctcgatagagttggtgccagggttatctctacctccactttggagtaggaagatctgggaggactgctccggtaggtcaaatttggaatggctcacatggacactagtgggaggagaagaaggggggattggtgtgttttgtaattcctgggctgaccagaacgattgtcagtcagttgggttgtgaattgtgtgatgtagtagcaaactgattcgtgccggcaattgaattgcaataagctagtggttgcagcatcacctggcgaggcgtagctaggagatgcagaaacagcattttgacatgtgtgggtgttgacatgcaacgaataaaatgaatgaagctgaattgaggtttgtattgt

SEQ ID NO: 2396 - DNA, 1279 bp, Panicum virgatum
  misc_feature (557)..(557): n is a, c, g, or t
  misc_feature (563)..(563): n is a, c, g, or t
  misc_feature (572)..(572): n is a, c, g, or t
  misc_feature (584)..(584): n is a, c, g, or t
  misc_feature (595)..(595): n is a, c, g, or t
  misc_feature (728)..(728): n is a, c, g, or t
cgctcgtctccctccgctccggagccctgctcagggtccgcgccgccgccgaacccgccccggccttccagtccgtgacggccttcgcgcccgccaccgtggccaacctcggcccgggcttcgacttcctcggttgcgccgtcgccgacgcctccctctccctcggcgacacggtgacggtcaccctggacccaaccctgccccccggcaccgtctccatcgcctccgtcacctccccgtcccgcccccacctcgccgcccgcctctccaaagacccgctccgtaactgcgcgggcgtggccgccatcgcggcgctccgcgccctcggcgtccggtcacacgccgtgtccatccagctgaccaagggcctgccgctgggctcgggcctgggctcctccgcggcttccgccgccgccgccgccaaggccgtggacgccctcttcgggtcgcgcctcgggcgcgacgacctcgtcctggcgggcctcgagtccgagaaggccgtcagcggcttccacgccgacaacatcgcgcccgccatcctgggcggcttcgtcctngtgcgnagctacganccctttcacctngtcccgctggnctccccgccgggcctccgcctccacctggtcctggtgacccccgacttcgaggcgcccacgagcaagatgcgcgcggcgctgcccaaggaggtgggcgtgcagcagcacgtgcgcaactcgagccaggcggcngcgctggtggcgggcgtgctgcagggggacgcggggctgatcggctccgccatgtcgtcggacggcatcgtggagccgagcagggcgcccctgatacctggcatggtggccgtgaaggcggcggcgctgcaggccggggcgctggggtgcaccataagcggggcggggcccacggcggtggcggtgatcgacggcgaggagaagggggaggaggttggcggcaggatggtggacgccttctggagcgcaggcaagctcaaggcaacagcaaccgtggctcagctcgataggcatggtgccagggtcatcgccacaactgctctcggctagctaccttgttgtgcggcaggcaggcaggcagcggcttagaagccattttttcttgttttgttttgcttggcttgattgcaataagaggagagttagtgctgctattaggaacactactcatattggcggtttgtgttttgactactaataaggccctgtttgtttccagaggactaaactttagacttatcacatcaaagataatcttgctatttagcagt

SEQ ID NO: 2397 - DNA, 1523 bp, Brachypodium distachyon
atggcggcggcggcggcgactgtaccatctccggccacctccttcccctccaccacccgcaaggcaacggtgctgtctctccgcgtctctaggagattcaaagtcgccgcttccgcagccgcctcgccgggcccggacccatccccggccttcaagtccgtgacggccttcgcgccggccacggtggccaacctgggcccgggcttcgacttcctcggctgcgctgtcgccgacgcctccctctccctcggcgacaccgtcaccgccaccctcgacccgtccctgccccccggcaccgtcgccatcgccggcatcacctccccgtcccggccccacctcgcagaccgcctctcccgcgacccgctccgcaactgcgccggcatcgccgccgccgccgcgctccaggccctcggcgtccgctcccacgccgtctccctccgcctcgccaagggcctccccctcggctccggcctcggctcctccgccgcatccgccgccgcagccgccaaggccgtcgacgcgctcttcggctcccttctctaccgcgacgacctcgtcctcgccgggctcgagtccgagaaggccgtcagcggcttccacgccgacaacatcgcccccgccatcctcggcggcttcgtcctcgtccgcagctacgagcccttccacctcatgcccctcccgtgcccgccggccctccgcctgcacttcgtcctcgtcacgccagacttcgaggcgcccaccagcaagatgcgcgccgcgctgcccaagcacgtcgcaatcaagcaccacgtgcgcaactccagccaggccgccgccctcgtggccgccgtgctgcaaggcgacgccggggtcatcggctccgccatgtcctccgacggcatcgtggagccgaccagggcgccgctgatacctggcatggtggcggtgaaggctgctgctctggaagctggcgcactgggatgcaccatcagtggagcagggccgaccgccgtggctgtcattgagggggcagagaagggggaggagattgctcggaggatggtggacgcattcttgtcggtagggaagctgaaagcaacggcaacaatcgcgcagctcgacagagccggtgccagggttatctccacctctagtttggagtagaaagattttagtgctcttgtatccattcgtgtattttccgggcctgatgctgatggtgtatggtaggcccttcctgggttgagcaaactgctgggcttgtgccccgcattgatagcaataagttggtgtgatgcagttgaagagagggcgccgattggcatgacctgtcgtcagaataatgtgtgcccaatctcgtcttgttgtaatttggtgttaattcttcacacttgatgaataatatgcggtcgatttgagatacattctgattgggaactggattttagtgggtgaagaagctcaagagttctggcagctcagttgatcaatactactagtgtattatattaatagcaaatctatacatacatgccacttgttcc

SEQ ID NO: 2398 - protein, 471 aa, Leymus cinereus x Leymus triticoides
MKKTVVLYPGLGVGHLVPMVELAKLFLKHGLAVTVALVDPQAESTDFSAAVARARASNPSVAFHVLPPPASADSNSDSAPTHFVVQIFRFLKAMNAPLLDFLRSLPSVQALVLDMFCVDAQDVAAELKLPVYYFYASAAADLALFLHLPSKLAGSEAEIKELGDSIITFPGVPPFKASDLPEVTHNGEALTAILGMFDRMPDADGILINSFESLETRAVRALKDGLCVPGRATPPVYCIGPLVSGGGDKEHDCLRWLDAQPDQSVVFLSFGSLGTFSGKQLQEIAIGLEKSGERFMWVVRSPRSPDYKYGDSLTEPDLDALMPEGFLERTKDRGLVVKSWAPQVEVLRHRATGAFMTHCGWNSTLEGITAGLPLLCWPLYAEQKVNKVHIVEGMKLGVEMRGYNEEVVKAEEVEEKVRWVMVSEGGRALRERVAAAKDAAAEALKEGGSSHLAFVQFLNDLGTSIAATVQN

SEQ ID NO: 2399 - protein, 472 aa, Triticum aestivum
MKKTVVLYPGLGVGHLVPMVEVAKLFLKHGLAVTMALVEPQVKSTDFSAAVARARASNPSVAFRVLPSPPADSNPDGAPRHHVVKVIQSLAAMNALLRDFLRSLPSVHALVLDMFCVDAQDVAAELKLPVFYSFASAASDLAIFLNLPSKFASNTAKIKELGDSIITFPGVPPFKASELPSEVIGDDEALVYVLRMFERMAEAKGILINSFDSLEKPALSALSEGLCVPGRATPPVYCIGPLVSGGGDKEHECLRWLDAQPDQSVVFLSFGSLGTFTSKQLEEIAVGLEKSGERFLWVVRSPRSPDEKHGDPLPEPDLDALMPEGFLERTKDRGLVVKSWAPQVEVLRHRATGAFMTHCGWNSTLEGITAGLPLLCWPLYAEQKVNKVHIVEGMKLGVEMRGYNEKVVKAEEVEEKVRWVMASEGGGRALRVRVAAAKDAAAEALQEGGSSNLAFAQFLKDMDISKVATMHD

SEQ ID NO: 2400 - protein, 475 aa, Hordeum vulgare
MKKTVVLYPGLGVGHLVPMVEVAKLFLKHGLAVTMALVEPQVKSTDFSAAVARARASNPSVAFHVLPTPTPPPPADANTDGAPRHHVVKVIQSLAAMNAPLRDFLRSLPSVHALVLDMFCVDALDVAAELKLPVYYSFASGAGDLAIFLNLPSKFASNTAKVKELGDSIVTFPGVPPFKASELPSEVIGDGEAFMYLLRMFERMTEANGILINSLESLEKPAVTALNDGLCVTGRATPPVYCIGPLVSGGGDKEHDCLRWLDAQPDQSVVFLSFGSLGTFSSKQLEEIALGLDKSGERFLWVVRSPRSPDQKHGDPLPEPDLDALMPEGFLERTKDRGLVVKSWAPQVDVLRHRATGAFMTHCGWNSTLEGITAGLPLLCWPLYAEQRVNKVHIVDGMKLGVEMRGYNEEVVKAEEVEEKVRWVMASEGGKALRERVTAAKDAAADALKEGGSSYLAFDQFLNDMGTSMVATVQN

SEQ ID NO: 2401 - protein, 476 aa, Avena sativa
MKKTVVLYPGLGVGHLVPMVELAKVFLKHGVAVIVALIDPGAKSTDFSAAVARAKTSNPSVDFHVLPPPPPAPVDSNSQQVAASTHHVTKIFKLLTAMNAPLRDFLRSLPSVDALILDMFCADAQDVAAELELPVYYFYASGAADLAIFLNLPSRVAGNTSKMKELGDSVITFPGVPPFKASDLPNEVIGDGEALPAIVGMFDRMSRADGILVNSFDSLETRAVQALRDDGLCVPGRATPPVYCVGPLVSGGGGGEKEHECLRWLDAQPDRSVVFLSFGSMGTFSGKQLLEIAVGLEKSGERFLWVVRTPRSPDFSYGDPLPEPDLDALMPEGFLERTKDRGLVVKSWAPQVEVLRHRATGAFVTHCGWNSTLEGITAGLPLLCWPLYAEQRVNKVHIVEEMKLGVEMRGYNQEVVKAEEVEEKVRWVMASEGGEALRERVAAAKEGAAEALKEGGSSHLAFVQFLKDLDTATVQD

SEQ ID NO: 2402 - protein, 201 aa, Zea mays
MSRYRGPRLKKIRRLGALPGLTIKTPKYGSNQKKKFHSGKKEQYRIRLQEKQKLRVHYGLTERQLLRYVHIAGKAKRSTGQVLLQLLEMRLDNILFRLGMASTIPGARQLVNHRHILVNGRIVDIPSFRCKPRDIITTKDNQRSKRLVQNYIASSDPGKLPKHLTVDTLQYKGLVKKILDRKWVGLKINELLVVEYYSRQT

SEQ ID NO: 2403 - protein, 201 aa, Zea mays
MSRYRGPRLKKIRRLGALPGLTRKTPKSGSNQKKKFHSGKKEQYRIRLQEKQKLRFHYGLTERQLLRYVHITGKAKRSTCQVLLQLLEMCLDNILFRLGMASTIPGARQLVNHRHILVNGRIVDIPSFRCKPRDIITTKDNQRSKRLVQNYIASSDPGKLPKHLTVDTLQYKGLVKQILDRKWVGLKINELLVVEYYSRQT

SEQ ID NO: 2404 - protein, 750 aa, Oryza sativa
MMIRSPEPEVKIVVDRDPVKTSFEEWARPGHFSRTIAKGPDTTTWIWNLHADAHDFDSHTGDLEEISRKVFSAHFGQLSIIFLWLSGMYFHGARFSNYEAWLSDPTHIGPSAQVVLPIVGQEILNGDVGGGFRGIQITSGFFQIWRASGITSELQLYCTAIGALIFASLMLFAGWFHYHKAAPKLAWFQDVESMLNHHLAGLLGLGSLSWAGHQIHVSLPINQFLDAGVDPKEIPLPHEFILNRDLLAQLYPSFAEGATPFFTLNWSKYAEFLSFRGGLDPITGGLWLSDIAHHHLAIAILFLIAGHMYRTNWGIGHGLKDILEAHKGPFTGQGHKGLYEILTTSWHAQLSLNLAMLGSTTIVVAHHMYSMPPYPYLATDYGTQLSLFTHHMWIGGFLIVGAAAHAAIFMVRDYDPTTRYNDLLDRVLRHRDAIISHLNWVCIFLGFHSFGLYIHNDTMSALGRPQDMFSDTAIQLQPIFAQWVQNLHAGAPSVTAPGATTSTSLTWGGGELVAVGGKVALLPIPLGTADFLVHHIHAFTIHVTVLILLKGVLFARSSRLIPDKANLGFRFPCDGPGRGGTCQVSAWDHVFLGLFWMYNSISVVIFHFSWKMQSDVWGTISDQGVVTHITGGNFAQSSITINGWLRDFLWAQASQVIQSYGSSLSAYGLFFLGAHFVWAFSLMFLFSGRGYWQELIESIVWAHNKLKVAPATQPRALSIIQGRAVGVTHYLLGGIATTWAFFLARIIAVG

SEQ ID NO: 2405 - protein, 201 aa, Oryza sativa
MSRYRGPRFKKIRRLGALPGLTRKTPKSGSNLKKKFHSGKKEQYRIRLQEKQKLRFHYGLTERQLLRYVHIAGKAKSSTGQVLLQLLEMRLDNILFRLGMASTIPEARQLVNHRHILVNGRIVDIPSFRCKPRDIITTKDNQRSKRLVQNSIASSDPGKLPKHLTIDTLQYKGLVKKILDRKWVGLKINELLVVEYYSRQT

SEQ ID NO: 2406 - protein, 166 aa, Hordeum vulgare
MSRYRGPRLKKIRRLGALPGLTRKTPKSGSNLKKKFNSGKKEQYRIRLQEKQKLRFHYGLTERQLLRYVHIAGKAKRSTGQVLLQLLEMRLDNILFRLGMASTIPGARQLVNHRHILVNGRIVNIPSFRCKPRDIITTKDNQRSKGPGSKFYCFIGPGEIAKPFDD

SEQ ID NO: 2407 - protein, 201 aa, Hordeum vulgare
MSRYRGPRLKKIRRLGALPGLTRKTPKSGSNLKKKFNSGKKEQYRIRLQEKQKLRFHYGLTERQLLRYVHIAGKAKRSTGQVLLQLLEMRLDNILFRLGMASTIPGARQLVNHRHILVNGRIVNIPSFRCKPRDIITTKDNQRSKGLVQNFIASSDPGKLPSHLTIDTLEYKGLVNKILDRKWVGLKINELLVVEYYSRQT

SEQ ID NO: 2408 - protein, 201 aa, Brachypodium distachyon
MSRYRGPRLKKIRRLGALPGLTRKTPKSGSNLKKKFHSGKKEQYRIRLQEKQKLRFHYGLTERQLLRYVHIAGKAKRSTGQVLLQLLEMRLDNILFRLGMAATIPGARQLVNHRHILVNGRIVNIPSFRCKPRDIITTKDNQRSQSLVQNSIASSDPGKLPKHLTIDTLEYKGLVNKILDRKWVGLKINELLVVEYYSRQT

SEQ ID NO: 2409 - protein, 86 aa, Brachypodium distachyon
MSRYRGPRLKKIRRLGALPGLTRKTPKSGSNLKKKFHSGKKEQYRIRLQEKQKLRFHYGLTERQLLDMYISLESKKVHRSGFTTIT

SEQ ID NO: 2410 - protein, 57 aa, Lolium multiflorum
MSRYRGPRLKKIRRLGALPGLTRKTPKSGSNLNSILGKRSNIVFVFKKNRNYVFIMV

SEQ ID NO: 2411 - protein, 181 aa, Zea mays
LTRKTPKSGSNQKKKFHSGKKEQYRIRLQEKQKLRFHYGLTERQLLRYVHIAGKAKRSTGQVLLQLLEMRLDNILFRLGMASTIPGARQLVNHRHILVNGRIVDIPSFRCKPRDIITTKDNQRSKRLVQNYIASSDPGKLPKHLTVDTLQYKGLVKKILDRKWVGLKINELLVVEYYSRQT

SEQ ID NO: 2412 - protein, 178 aa, Zea mays
MSCYRGPRLKKIRRLGALPGLTRKTPKSRSNQKKKFHSWKKEQYRIRLQEKQKLCFHYGLTERQLLRYVHIAGKAKRSTGQVLLQLLEMRLDNILFRLGMASTIPGARQLVNHRHILVNGRIVDMPSFRCKPRDIITTKDKQRSKRLVQNYIASSDPGKLPKHLTVDTLQYKGLVKKF

SEQ ID NO: 2413 - protein, 201 aa, Musa acuminata
MSRYRGPRFKKIRRLGALPGLTSKRPRSGSDLKNQLRSGKRSQYRIRLEEKQKLRFHYGLTERQLLRYVHIAGKAKGSTGQVLLQLLEMRLDNILFRLGMASTIPGARQLVNHRHILVNGRIVDIPSYRCKPRDIITTKDKQRSKALIQNYIALSPPEELPKHLTFDSFQYKGVVNQIIDSKWIDLKINELLVVEYYSRQT

SEQ ID NO: 2414 - protein, 604 aa, Papaver somniferum
MIIRSPEPEVKILVDRDPVKTSFEEWARPGHFSRTIAKGPDTTTWIWNLHADAHDFDSHTSDLEEISRKVFSAHFGQLSIIFLWLSGMYFHGARFSNYEAWLSDPTHIRPSAQVVWPIVGQEILNGDVGGGFRGIQITSGFFQIWRASGITSELQLYCTAIGALVFAALMLFAGWFHYHKAAPKLAWFQDVESMLNHHLAGLLGLGSLSWAGHQIHVSLPINQFLDAGVDPKEIPLPHEFILNRDLLAQLYPSFAEGATPFFTLNWSKYAEFLTFRGGLDPVTGGLWLTDIAHHHLAIAILFLIAGHMYRTNWGIGHGLKDILEAHKGPFTGQGHKGLYEILTTSWHAQLSLNLAMLGSLTIVVAHHMYAMPPYPYLATDYGTVLSLFTHHMWIGGFLIVGAAAHAAIFMVRDYDPTTRYNDLLDRVLRHRDAIISHLNWACIFLGFHSFGLYIHNDTMSALGRPQDMFSDTAIQLQPVFAQWVQNTHALAPGATAPGATTSTSLTWGGSGLVAVGGKVALLPIPLGTADFLVHHIHAFTIHVTVLILLKGVLFARSSRLIPDKANLGFRFPRDGVEGQPAVDVSCKKKFKERRRNPSVLTGRL

SEQ ID NO: 2415 - protein, 201 aa, Arabidopsis lyrata
MSRYRGPRLKKIRRLGALPGLTSKRPKAGSDLRNQSRSVKKSQYRIRLEEKQKLRFHYGLTERQLLKYVRIAGKAKGSTGQVLLQLLEMRLDNILFRLGMALTIPQARQLVNHGHILVNGRIVDIPSYRCKPRDIITVKDEQNSRTLVQNLLDSSAPEELPNHLTLHTFQYEGLVNQIIDRKCVGLKINELLVVEYYSRQT

SEQ ID NO: 2416 - protein, 291 aa, Zea mays
MEATPISMKPPSPAPAAPPPATLEPGDLPTHAFGGTELEPSSMNQLAIAPDPKRPRVEEAADGNGCKHCACKKSRCLKLYCPCFSGGGYCSDKCGCQPCFNKEAFAETVHTTRKVLLSRQKRMSMKINRRPEANTEPMEDAHHSSSSTPPKRGCNCKKSSCLKKYCDCYQDGTGCSLFCRCDDCQNPFGKNEGIMADDSKRYLYTGADLDHSEGEHDFVVERSPRLQSPISKESSFPPNPTSSQGVKQRRARFPTRDIPVAGAAPLVALFQQEEQQRPSHGRLRELQELEP

SEQ ID NO: 2417 - protein, 359 aa, Zea mays
MEATPISMKPPSPAPAAPPPATLEPGDLPTHAFGGTELEPSSMNQLAIAPDPKRPRVEEAADGNGCKHCACKKSRCLKLYCPCFSGGGYCSDKCGCQPCFNKEAFAETVHTTRKVLLSRQKRMSMKINRRPEANTEPMEDAHHSSSSTPPKRGCNCKKSSCLKKYCDCYQDGTGCSLFCRCDDCQNPFGKNEGIMADDSKRYLYTGADLDHSEGEHDFVVERSPRLQSPISKESSFHQTPPHLRASSRDAHVFPHAISQWQALPRSWHCSNKRNSSDRAMDDSANYKNSNHDYWQVPKHEDSYSISKCVQILNGMAELSQVEKSVAPDVFLQPGNREIFVSLSGDVRAMWLKRKIQHLA

SEQ ID NO: 2418 - protein, 356 aa, Zea mays
MEATPISMKPPAPPPVTLEPIELSTHAVGLTELERSSMNQLAIAPDPKRQRVEEAADGNGCKHCACKKSRCLKLYCPCFAGGGYCSDKCGCQPCFNKEAFSETVQTTRKVLLSRQKRMSMKINRRPEANAEPMEDAHHSSSSTPPRRGCNCKKSSCLKKYCDCYQDGTGCSLFCRCDDCQNPFGKNDGIIADDSKRYLYTGADLDHSEGEHDFVVERSPRLQSPMSKESSFHQTPPHLRASSRDAHVFPQAVSQWQALPRSWHCSNKRNGNDRAMDDSSANGNYKSSSHDWQMSKLEDGYSISRCVQILNGMVELSQVEKSVAPDVFLLPGNREIFVSLGGDVRAMWLKRKIQHLA

SEQ ID NO: 2419 - protein, 356 aa, Pennisetum glaucum
SVKPPSPSPSPAPPPQAALETRDLPTHAVVATEVEPSSMNQLAVAVTPDPKRQKVEDTADGKGCKHCACKKSRCLKLYCPCFAGGGYCSEKCGCQPCFNKDAYAETVQNTRKVLLSRQKRMSLKINRRSEANAEAMEDAHHSSSSTPPRRGCNCKKSSCLKKYCDCYQDGTGCSLFCRCGDCQNPFGKNEGIMTEDSKRYLYTGADLDHSEGEHEFVVERSPHLQSPMSKESSFLQTPPHLRASSRDTHVFPQAVLQWQAPPRSWHCSNKRNNNDRAMDDSANYKNSHNDWQLPKPEDSYSISKCVKILNGMVELSQVEKSVAPDVFLLPGNREIFISLGGDVRALWLKRKIQHLT

SEQ ID NO: 2420 - protein, 221 aa, Solanum phureja
MAGVLSVLRRIYLTLYNWIVFFGWFQVFYLAVKTLKESGHEHVYDAVEKPLLLAQTAAILEIFHGLVGLVRSPVSATLPQISSRLYVTWGILWSFPELRSHILVSSLVISWSITEIIRYSFFGTKEAFASAPSWLLWLRYSTFLLLYPSGITSEVGLIYSALPYIKGSDMYSLRMPNKWNFSFDYYYAGLVALGIYFPGSPHMYGYMLGQRKKALSKSKKE

SEQ ID NO: 2421 - protein, 221 aa, Solanum melongena
MDGVLSVLRRIYLTLYNWVVFFGWFQVFYLAVKTLKESGHEHVYDAVEKPLLLAQTAAILEILHGLVGLVRSPISATLPQISSRLYVTWGILWSFPELRSHILVSSLVISWSITEIIRYSFFGTKEAFGSAPSWLLWLRYSTFLLLYPSGITSEVGLIYSALPYMKASKKYCLRMPNKWNFSFDYYYAGLVTLAIYVPGSPHMYGYMLGQRKKALFKSKKE

SEQ ID NO: 2422 - protein, 221 aa, Petunia hybrida
MAGFLSALRRIYLTLYNWTVFFGWFQVFYLAVKTLKESGHQHVYDAVEKPLLLAQTAAILEILHGLVGLVRSPVSATLPQISSRLYVTWGILWSFPELRSHVLVSSLVISWSITEIIRYSFFGTKEAFGSAPSWLLWLRYSTFMLLYPTGITSEVGLIYSALPYIKESEKYSIRMPNKWNFSFDYYYAGLVALGIYVPGSPHMYGYMLGQRKKALSKSKKE

SEQ ID NO: 2423 - protein, 221 aa, Nicotiana benthamiana
MAGVLSALRRVYLTLYNWTVFFGWFQVLYLAVKTLKESGHEHVYDAVEKPLLLAQTAAILEILHGLVGLVRSPVSATLPQISSRLYVTWGILWSFPELRSHILVSSLVISWSITEIIRYSFFGTKEAFGSAPSWLLWLRYSTFMLLYPTGITSEVGLIYSALPYIKGSEKYSIRMPNKWNFSFDCYYAGLVVLGFYVPGSPHMYGYMLGQRKKALSKSKKE

SEQ ID NO: 2424 - protein, 221 aa, Capsicum annuum
MAGILSLVRRIYLSFYNWIVFFGWFQVFYLAVKTLKESGHEHVYDAVEKPLLLAQTAAILEILHGLVGLVRSPVSATLPQISSRLYVMWGILWSFPELRSHILVSSLVISWSVTEIIRYSFFGTKEAFGSAPSWLLWLRYSTFLLLYPSGITSEVGLIYSALPYITESGKYSLRMPNKWNFSFDYYYAGLVALGIYVPGSPHMYGYMLGQRKKALSKSKKE

SEQ ID NO: 2425 - protein, 221 aa, Aquilegia formosa
MAGFLSVLKRIYLTLYNWTVFTGWAQVLYFAVKTLKESGHEHVYSAVERPLQLAQTAAVMEILHGLIGLVRSPVSATLPQIGSRLYVTWGILWSFPETQTHVLVSSLVISWSITEIIRYSFFGLKEAFGSAPSWLLWLRYSTFLLLYPSGITSEVGLIYTALPFIKNSEKYCIRMPNKWNFSFDYFYAAIIALGIYVPGSPHMYQYMLGQRKKALSKSKKE

SEQ ID NO: 2426 - protein, 221 aa, Coffea canephora
MAGVLSGLKRLYLTIYNWTVFVGWLQVFFLAVKTLKESGHQHVYDAVEKPLLLAQSAAILEIIHGLVGLVRSPVSATLPQIGSRLYVAWGILWSFPEVRTHVLVSSLVISWSITEIIRYSFFGTKEAFGSAPSWLLWLRYSTFLLLYPTGITSEVGLIYNALPLIKESAKYSVVIPNKWNFSFDYYYAAFVVLGVYVPGSPHIYTYMLGQRKKALSKSKKE

SEQ ID NO: 2427 - protein, 219 aa, Allium cepa
GFFSVLRRIYLTIYNWTVFFGWAQVLYFAVKTLRESSHQEVYDAVEKPLQLAQTAAVLEILHGLIGLVRSPVSATLPQISSRLYVTWGILWSFPEVRSHFLVSSLVISWSITEIIRYSFFGMKEALGFAPSWLLWLRYSTFLLLYPCGITSEVGLIYLALPYIKASEKYCIRMPNKWNFSFDYYYAAILALGIYVPGSPHMYTYMLGQRKEALSQSKKA

SEQ ID NO: 2428 - protein, 221 aa, Actinidia deliciosa
  misc_feature (98)..(98): Xaa can be any naturally occurring amino acid
  misc_feature (102)..(102): Xaa can be any naturally occurring amino acid
  misc_feature (116)..(116): Xaa can be any naturally occurring amino acid
  misc_feature (149)..(149): Xaa can be any naturally occurring amino acid
MAGSLSVLRRVYLTLYNWTVFVGWFQVLYLALKTLKESGHEHVYDAVEKPLLLAQSAAVLEILHGLVGLVRSPIIATLPQIGSRLYVAWGILWSFPEXRSHXLVSSLVISWSITEXIRYSFFGTKEALGSAPSFLMWLRYSTFLLLYPXGISSEVGLIYVGLPYIKESEKYCIRMPNKWNFSFDYFYFAILVLGFYVPGSPHMYTYMLGQRKKALAKSKEE

SEQ ID NO: 2429 - protein, 221 aa, Carica papaya
MAGFLSVIRRLYLTIYNWTVFVGWAQVLFLALKTLKESGYEHVYDAVEKPLQFAQTAAVLEILHGLVGLVRSPVMATLPQISSRLYLTWGILWSFPEVRSHMIVSSLVISWSVTEIIRYSFFGMKEGLGSAPSWLLWLRYSTFLLLYPTGISSEVGLIYLALPYIKRSDKYCIRMPNKWNFSFDYFYAAILALGIYVPGSPHMYTYMLGQRKRALSKSKRE

SEQ ID NO: 2430 - protein, 221 aa, Citrus sinensis
MAGCLSLLRRLYLTAYNWTVFAGWAQVLYLALKTLNESGHENVYKAVERPLQLAQTAAVLEILHGLLGLVRSPITATLPQISSRLYVTWGILWSFPQTQNHILVSSLVISWSLTEIIRYSFFGMKEALGFAPSWLLWLRYSTFLLLYPSGITSEVGLIYTALPYIKESEKYCLRMPNKWNFSFDYFYAAILVLGFYVPGSPHMYTYMLGQRKKALSKSKKE

SEQ ID NO: 2431 - protein, 221 aa, Malus domestica
MAVPLSALRRLYLSLYNWTVFLGWFQVLYLALKTLKESGHQHVYSAVERPLLLAQSAAFLEILHGLVGLVRSPITATLPQIGSRLYLTWGILWSFPETRSHMLVSSLVISWSITEIIRYSFFGMKEALGFAPTWLLWLRYSTFILLYPTGITSEVGLIYIALPHIKNSEKYCIRMPNKWNFSFDYLYAAIVALGIYVPGSPHMYGYMLGQRKKALAKAKGE

SEQ ID NO: 2432 - protein, 221 aa, Quercus alba
MAGFLSLLRRIYLSVYNWTVFVGWFQVLYLAVKTVRESGHQHVYSAVERPLQLAQTAAILEIFHSLVGLVRSPVSATLPQIASRLYLTWFILWSFPQTQTHILVTSLVISWSITEIIRYSFFGLKEALGFAPSWLLWLRYSTFLLLYPTGITSEVGLIYVALPFIKESEKYCIRMPNKWNFSFDFFYAAILVLGIYVPGSPHLYGYMLGQRKKALSKSKKE

SEQ ID NO: 2433 - protein, 221 aa, Cleome spinosa
MAGFFSLLRRVYLTLYNWTVFFGWAQVLYLSLKTLNESGHEHVYDAVEKPLQLAQTAAVLEILHGLVGLVRSPVSATLPQIGSRLYVTWGILYSFPEVRSHFLVSSLVISWSVTETIRYSFFGLKEGLGSAPSWLLWLRYSSFLVLYPTGITSEVGLIYLALPHNKKTEKYSVRMPNKWNFSFDNFYAAILVLGIYVPGSPHMYRYMLGQRKRALSKSKRE

SEQ ID NO: 2434 - protein, 222 aa, Ipomoea nil
MAGGVFSGLRRFYLALYNWVVFVGWVQVFYLAVKTLMESGHENVYQAVEKPLLLAQSAAVLEILHGLVGLVRSPISATLPQIGSRLYVTWGILYSFPEIRTHVFVSSLVISWSITEIIRYSFFGTKEAFGRGPSGLLWLRYSSFILLYPTGITSEVGLIYKALPYLMESGKYSFWMPNKWNFSFDYYYMAFVVLAIYVPGSPHMYGYMLGQRKKALRKAKQA

SEQ ID NO: 2435 - protein, 221 aa, Arachis hypogaea
MAGFFSLLRRLYLSIYNWTVFFGWSQVLYHVLITLKESGHENVYNAAEKPLLFAQTAAVLEILHGLVGLVRSPVSATLPQIGSRLYLTWGILWSFPETRNHVLVTSLLISWSITEIIRYSFFGFKEAFGFAPSWLLWLRYSTFLLLYPTGISSEVGLIYIALPFIKASEKYCIRMPNKWNFSFDYFYAAIVVLGIYVPGSPHMYTYMLAQRKKALSKSKRE

SEQ ID NO: 2436 - protein, 221 aa, Persea americana
MAGFFSTVKRIYLSIYNWAVFCGWIQVLYLALKTLNESGHEKVYDAVERPLQLAQTAAVMEILHGLVGLVRSPVSATLPQIGSRIYVTWGILWSFPETRTHWLVSSLVISWSITETVRYSFFGMKEALGFAPSWLLWLRYSTFLILYPTGITSEVGLIYIALPYIKRSDKYCLRMPNTWNFSFDYFYASILALGIYVPGSPHMYQYMIGQRKKALSKSKRE

SEQ ID NO: 2437 - protein, 221 aa, Tropaeolum majus
MAGALSLLRRIYLTLYNWVVFFGWAQVLYLALKTLNESGHENIYTAVEKPLLLAQSAAVLEILHGLVGLVRSPISSTVPQISSRLYLTWGILYSFPEVRSHILVTSLVISWSLAEIIRYSFFGVKEGLGFAPSWLLWLRYSSFILLYPTGISSEVGLIYVALPYIKGSEKYCIRMPNKWNFSFDNFYAAIVVLGIYVPGTPHLYGYMLGQRKRALSKSKRE

SEQ ID NO: 2438 - protein, 221 aa, Prunus persica
MAGALSALRRLYLSLYNWTVFLGWLQVLYLALKTLNELGHQHVYKAVERPLLLAQSAAVLEILHGLVGLVRSPISATLPQIGSRLYLTWGVLWSFPETQSHILVSSLVISWSITEIIRYSFFGMKEALGFAPSWLLWLRYSTFILLYPTGITSEVGLIYIALQYIQKSEKYSVRMPNKWNFSFDYFYAAIIALGIYVPGSPHMYRYMLSQRKKALSKTKAA

SEQ ID NO: 2439 - protein, 221 aa, Brassica rapa
MAGSFSFVRRVYLTLYNWIVFAGWAQVLYFAVKTLKETGHEHVYDAVEKPLQLAQTAAVLEILHGLVGLVRSPVSATLPQIGSRLFLTWGILYSFPEVQSHFLVASLVISWSITEIIRYSFFGLKEALGFAPSWHLWLRYSSFLVLYPTGITSEVGLIYLALPHIKTSEMYSVRMPNTLNFSFDFFYATILVLAIYVPGSPHMYRYMLGQRKRALSKSKRE

SEQ ID NO: 2440 - protein, 221 aa, Gossypium hirsutum
MASALTVLRRLYLSIYNWLVFIGWFQVLFLALKALKESGHEHVYNAVEKPLLLAQSAAVMEILHGLIGLVRSPVSSTLPQIGSRLYLTWGILWSFPEIRTHILVTSLVISWAITEIIRYSFFGMKEAFGFAPSWHLWLRYSTFLVLYPTGISSEVGLIYFALPYIKASEKYCFRMPNKWNFSFDYFYAAILALGIYVPGSPHLYHYMLGQRKRALSKSKKE

SEQ ID NO: 2441 - protein, 221 aa, Gossypium hirsutum
MASALTVLRRLYLSIYNWLVFIGWFQVLFLALKALKESGHEHVYNAVEKPLLLAQSAAVMEILHGLIGLVRSPVSSTLPQIGSRLYLTWGILWSFPEIRTHILVTSLVISWAITEIIRYSFFGMKEAFGFAPSWHLWLRYSTFLVLYPTGISSEVGLIYFALPYIKASEKYCFRMPNKWNFSFDYFYAAILALGIYVPGSPHLYRYMLGQRKRALSKSKKE

SEQ ID NO: 2442 - protein, 221 aa, Thellungiella halophila
MAGFLSFVRRVYLTLYNWIVFAGWAQVLYFAIRTLKETGHENVYDAIEKPLQLAQTAAVLEILHGLVGLVRSPVSATLPQIGSRLFLTWGILYSFPEVRSHFLVTSLVISWSITEIIRYSFFGLKEALGFAPSWHLWLRYSSFLLLYPTGITSEVGLIYLALPHIKSSEMYSVRMPNILNFSFDYFYATIIVLAIYVPGSPHMYRYMLGQRKSALSKSKRE

SEQ ID NO: 2443 - protein, 221 aa, Vitis vinifera
PMAFFSLLRRLYLTIYNWVVFFGWAQVLFFALSTLKESGHQHVYRAVERPLQLAQTAAVLEIFHGLVGLVRSPITATLPQIGSRLYVTWGILWSFPEVQTHVLVSSLVISWSITEIIRYSFFGVKELLGFAPAWLLWLRYSTFLLLYPTGITSEVGLIYIALPYIKESAKYCLRMPNKWNFSFDYFYAALLVIAFYVPGSPHMYQYMLGQRKRALSKSKRE

SEQ ID NO: 2444 - protein, 305 aa, Triticum aestivum
MEPDQSGTGQTSPRGNDWEVVQLTASNYASAPGPARTEPSDEEAEGQVYDAEGGDSAAASLLMSGHFSVPQSEAEKLLMEADTSIYQQEARGSQYAVSDKGGDGMYEDQQEKLKDDGLDRIPSFDKGKSLSPVDMEPDDGNALHSVSQAGEDPVTFSSSGYSATEAEKEVTESAKEKTEENITLQNVDPVTDSSNVVASGEESKPDGSGAPRNVWWQKQLISLYRSAKESNKLWPIVVAAAALMGMAYFRRRWQKGKLQLQQVKLQPASSKERINQATVPLNRIKDILVAGNHPSPATHGNARLG

SEQ ID NO: 2445 - protein, 306 aa, Triticum aestivum
MEPDQSGTGQTSPRGNDWEVVQLTASNYASAPGPARTEPSDEESEGQVYGAEGGDSAAAALLMSGHFSVPQNEAENLLMGADTSIEQQEARGSQYAVSDKGDDGDREEDPQEKLKDDVLDRIPSFDKGKSLSSVDMEPDDGSELHRGSLVGKDPVTFSSSVYNATDAEKEATESAKEKTEESPTLQNIDPVTDSSNIVASGDESKPDGSGAPRNAWWQKQLISLYRSAKESNKLWPIVVAAAALMGMAYFRRRWQKGKLQLQQVKLQPASSKERINQATVPLNRIKDILVAGNHPSPAPHGNARLG

SEQ ID NO: 2446 - protein, 306 aa, Hordeum vulgare
MEPHQSGTGQTSPRGNDWEVVQLTASNYASAPGPARTEPSDEESEGQVYGAEGGDSAASALLMSGHFSVPQNEPGGLLVEANASIERQEAHGSQYAVSDKGDDDDTEDDRQEKLKDDDLDRTPSFDKGKSLSSVDMEPDDGSELHRGSPVGKDLVTFKSSGYSATDAEKEAIDSANEKAEENTMLQNVDPVTDSSNVVASGEESKPDGSGAPRNVWWQKQLISLYRSAKESNKLWPIVVAAAALMGMAYFRRRWQKGKLQLQQVKVQPASSKERINQAAVPLNRIKDILVAGNHPSPAAHGNARLG

SEQ ID NO: 2447 - protein, 221 aa, Sorghum bicolor
MAGVGSALRRLYLSVYNWVVFFGWAQVLYYAVLTLRESGHKAVYAAVEKPLQFAQTAAIMEILHGLVGLVRSPVSATLPQIGSRLFLTWGVLWSFPETQSHLLVTTLVISWSITEIIRYSFFGMKEAFGFAPSWLLWLRYSTFMLLYPTGISSEVGLIYIALPYMKASEKYCLRMPNKWNFSYDYFYSSILALLIYVPGSPHMYRYMLSQRKKALSKAKAA

SEQ ID NO: 2448 - protein, 221 aa, Saccharum officinarum
MAGIGSALRRLYLSVYNWVVFFGWAQVLYYAVLTLRESGHKAVYAAVEKPLQFAQTAAVMEILHGLVGLVRSPVSATLPQIGSRLFLTWGVLWSFPETQSHLLVTTLVISWSITEIIRYSFFGMKEAFGFAPSWLLWLRYSTFMLLYPTGISSEVGLIYIALPYMKASEKYCLRMPNKWNFSYDYFYTSILALLIYVPGSPHMYRYMLSQRKKALSKAKAA

SEQ ID NO: 2449 - protein, 221 aa, Setaria italica
MAGVGSALRRLYLSVYNWVVFFGWAQVLYYAVLALRESGHEAVYAAVERPLQFAQTAAIMEILHGLVGLVRSPVSATLPQIGSRLFLTWGVLWSFPETQSHILVSTLVISWSITEIIRYSFFGMKEAFGSAPSWLLWLRYSTFMLLYPTGISSEVGLIYTALPYMQATEKYSFRMPNKWNFSYDYLYTSILALVIYIPGSPHMFGYMLSQRKKALSKAKTA

SEQ ID NO: 2450 - protein, 221 aa, Oryza sativa
MAGVGSAVRRLYLSVYNWAVFFGWAQVLYYAVTTLLESGHEAVYAAVERPLQFAQTAAFLEILHGLVGLVRSPVSATLPQIGSRLFLTWGILWSFPETHSHILVTSLVISWSITEIIRYSFFGMKEAFGFAPSWLLWLRYSTFMVLYPTGISSEVGLIYIALPYMKASEKYCLRMPNKWNFSFDFFYASILSLAIYVPGSPHMFTYMLAQRKKALAKAKAA

SEQ ID NO: 2451 - protein, 222 aa, Cenchrus ciliaris
MAAGVGSALRRLYLAVYNWVVFFGWAQVLYYAVLALRENGHQAVYAAVERPLQFAQTAAILEILHGLVGLVRSPVTATLPQIGSRLFLTWGVLWSFPETQSHILVSSLVISWSITEIIRYSFFGMKEAFGSAPSWLLWLRYSTFMLLYPTGIASEVGLIYTALPYMQATEKYCLRMPNKWNFSYDYLYTSILALVIYIPGSPHMFTYMLSQRKKALSKAKTA

SEQ ID NO: 2452 - protein, 221 aa, Cynodon dactylon
MAGVGSAVRRLYLSVYNWVVFYGWAQVLYYAVTTLRQSGHEAVYAAVERPLQFAQTAAIMEILHGLVGLVRSPVSATLPQIGSRLFLTWGILYSFPETQSHILVTSLVISWSITEVIRYSFFGMKEALGFAPSWLLWLRYSTFLILYPTGITSEVGLIYIALPFMMASEKYCLRMPNKWNFSFDYFYMSILVMGIYIPGSPHMYNYMRAQRKKALSKAKSA

SEQ ID NO: 2453 - protein, 221 aa, Oryza sativa
MTGVGSAVRRLYLSVYNWAVFFGWAQVLYYAVTTLLESGHEAVYAAVERPLQFAQTAAFLEILHGLVGLVRSPVSATLPQIGSRLFLTWGILWSFPETHSHILVTSLVISWSITEIIRYSFFGMKETFGFAPSWLLWLRYSTFMVLYPTGISSEVGLIYIALPYMKATEKYCLRMPNKWNFSFDFSYASILSLAVYVPGSPHMFTYMLAQRKKALAKAKAA

SEQ ID NO: 2454 - protein, 222 aa, Pennisetum glaucum
MAAGVGSALRRLYLSVYNWVVFVGWAQVLYYAVLTLLESGHEAVYGAVERPLQFAQTAAIMEILHGLVGLVRSPISATLPQIGSRLFLTWGILWSFPETRSNILVTSLVISWSITEIIRYSFFGMKETFGSAPYWLLWLRYTTFMVLYPTGISSEVGLIYAALPYMQATEKYCLRMPNKWNFSYDYMYTSILALAVYIPGSPHMFRYMLSQRKKALSKSKTA

SEQ ID NO: 2455 - protein, 222 aa, Brachypodium distachyon
MAAAAGSVLRRLYLSAYNWVVFFGWAQVLYYAVTALLESGHGAVYAAVEKPLQFAQTAAFMEILHGLVGLVRSPVSATLPQIGSRLFLTWGILWSFPETRSHILVTSLVISWSITEIIRYSFFGMKEALGFAPSWLLWLRYSTFMILYPTGIFSEVGLIYIALPYMKASEKYYIKMPNKWNFSFDYFYASAIAIGVYVPGGPHMFTYMLAQRKKALSKAKTA

SEQ ID NO: 2456 - protein, 66 aa, Panicum virgatum
  misc_feature (27)..(27): Xaa can be any naturally occurring amino acid
MAGVGSAVRRIYLAVYNWIVFAGWAQXLYYAIWRCGRAAMRLSTTLSSGRCSSRKQPPSWRFCMDL

SEQ ID NO: 2457 - protein, 221 aa, Panicum virgatum
MAGVGSAVRRLYLAVYNWIVFAGWAQVLYYAILALLESGHEAVYGAVERPLQFAQTAAIMEILHGLVGLVRSPISATLPQIGSRLFLTWGILWSFPETRSNILVTSLVISWSITEIIRYSFFGTKETFGFAPSWLLWLRYSTFMVLYPTGISSEVGLIFAALPHMMASQKYCLRLPNKWNFSYDYLYTSILALAVYIPGSPHMFKYMLSQRKKALSKSKTV

SEQ ID NO: 2458 - protein, 221 aa, Triticum aestivum
MAGVGSAVRRLYLSVYNWVVFVGWAQVLYYAVTALLAGGHEGVYAAVERPLQLAQTAAVMEILHGLVGLVRSPVTATLPQIGSRLFLTWGILWSFPETQSHILVTSLVISWSITEIIRYSFFGLKEMLGFAPSWLLWLRYSTFLILYPIGILSEVGLIYIALPYMKVSEKYFVKMPNKWNFSFDYFYTCVIAIGVYVPGGPHMFTYMLAQRKKALSKAKTA

SEQ ID NO: 2459 - protein, 221 aa, Triticum aestivum
MAGVGSAVRRLYLSVYNWVVFVGWAQVLYYAVTALLDGGHEGVYAAVERPLQLAQTAAVMEILHGLVGLVRSPVTATLPQIGSRLFLTWGILWSFPETQSHILVTSLVISWSITEIIRYSFFGLKETLGFAPSWLLWLRYSTFMILYPTGILSEVGLIYIALPYIKVSEKYFVKMPNKWNFSFDYFYTCAIAIGVYVPGGPHMFTYMLAQRKKALSKAKTA

SEQ ID NO: 2460 - protein, 221 aa, Pseudoroegneria spicata
  misc_feature (10)..(10): Xaa can be any naturally occurring amino acid
MAGVGSAVRXLYLSVYNWVVFYGWAQVLYYAVTALLGGGHEGVYAAVERPLQLAQTAAVMEILHGLVGLVRSPVSATLPQIGSRLFLTWGILWSFPETQTHILVTSLVISWSITEIIRYSFFGLKETLGFAPSWLLWLRYSTFLILYPTGILSEVGLIYIALPYIKVSEKYFVKMPNKWNFSFDYFYTCVIAIGVYVPGGPHMFTYMLAQRKKALSKAKTA

SEQ ID NO: 2461 - protein, 221 aa, Triticum aestivum
MAGVGSAVRRLYLAVYNWVVFVGWAQVLYYAVTALLGGGHEGVYAAVERPLQLAQTAAVMEILHGLVGLVRSPVAATLPQIGSRLFLTWGILWSFPETQSHILVTSLVISWSITEIIRYSFFGLKETLGFAPSWLLWLRYSTFLILYPTGILSEVGLIYIALPYIKVSEKYLVKMPNKWNFSFDYFYTCAIAIGVYVPGGPHMFTYMLAQRKKALSKAKTT

SEQ ID NO: 2462 - protein, 221 aa, Hordeum vulgare
MAGVGSAVRRLYLSAYNWVVFYGWAQVLYYAITALLGDGHEGVYAAVERPLQLAQTAAVMEILHGLVGLVRSPVTATLPQIGSRLFLTWGILWSFPETQSHILVSSLVISWSITEIIRYSFFGLKETLGFAPSWLLWLRYSTFMILYPTGIFSEVSLIYIALPYMKVSERYFLKMPNKWNFSFDYFYTCVIAIGVYIPGGPHMFTYMLAQRKKALSKAKTA

SEQ ID NO: 2463 - protein, 205 aa, Eragrostis curvula
  misc_feature (205)..(205): Xaa can be any naturally occurring amino acid
MAGFGSAVRRLYLSVYNWVVFYGWAQVLYYAVMALQESGHEAVYAAVERPLQFAQTAAIMEILHGIVGLVRSPISATLPQIGSRLFLTWGVLWSFPETQSHILVTSLVISWSITEIIRYSFFGMKEALGFAPSWLLWLRYSTFLLLYPTGITSEVGLIYIALPFMKASERYCLRMPNKWNFSFDYMYGSILALAIYVPGRPHMYX

SEQ ID NO: 2464 - protein, 528 aa, Zea mays
MSLRPSEREQMRKGNYKQTVDAEESRRRREGQMVDIRKAKREESLQKKRRDGFPAAGAVPPMGHSTALQQKLDGLPAMVQAVHSNDPTVQLEATTQFRKLLSIERSPPIEEVISTGVVPRFIEFLTREDHPQLQFEAAWALTNIASGTSENTKVVVESGAVPIFVKLLNSNSEDVREQAVWALGNVAGDSPKCRDLVLGHGGLFPLLQQLNEHAKLSMLRNATWTLSNFCRGKPQPNFDQVKPALPALQQLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNREQIQAVINANIIAPLVQLLQTAEFDIKKEAAWAISNATSGGTHDQIKYLVAQGCIKPLCDLLVCPDPRIVTVCLEGLENILKVGEAEKNLGAGDVNVYAQMIDDAEGLDKIENLQSHDNTEIYEKAVKMLESYWLEEEDDAMPSGDNPQNGFNFGNQPSVPSGGFNFG

SEQ ID NO: 2465 - protein, 530 aa, Sorghum bicolor
MSLRPSEREQMRKGNYKQTVDAEESRRRREGQMVDIRKAKREESLQKKRRDGFPASAAGAVPPMGHSTALQQKLDGLPAMVQAVLSNDPTVQLDATTQFRKLLSIERSPPIEEVISTGVVPRFIEFLTREDHPQLQFEAAWALTNIASGTSENTKVVVESGAVPIFVKLLNSHSEDVREQAVWALGNVAGDSPKCRDLVLGHGGLFPLLQQLNEHAKLSMLRNATWTLSNFCRGKPQPNFDQVKPALPALQRLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNREQIQAVINANIIAPLVQLLQTAEFDIKKEAAWAISNATSGGTHDQIKYLVAQGCIKPLCDLLVCPDPRIVTVCLEGLENILKVGEAEKNLGGGDVNVYAQMIDDAEGLDKIENLQSHDNTEIYEKAVKMLESYWLEEEDDAMPSGDNPQNGFNFGNQPSVPSGGFNFG

SEQ ID NO: 2466 - protein, 530 aa, Saccharum officinarum
MSLRPSEREQMRKGNYKQTVDAEESRRRREGQMVDIRKAKREESLQKKRRDGFPASAAGAAPPMGHSTALQQKLDGLPAMVQAVLSNDPAVQLEATTQFRKLLSIERSPPIEEVISTGVVPRFIEFLTREDHPQLQFEAAWALTNIASGTSENTKVVVESGAVPIFVKLLNSHSEDVREQAVWALGNVAGDSPKCRDLVLGHGGLFPLLQQLNEHAKLSMLRNATWTLSNFCRGKPQPNFDQVKPALPALQRLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNREQIQAVINANIIAPLVQLLQTAEFDIKKEAAWAISNATSGGTHDQIKYLVAQGCIKPLCDLLVCPDPRIVTVCLEGLENILKVGEAEKNLGGGDVNVYAQMIDDAEGLDKIENLQSHDNTEIYEKAVKMLESYWLEEEDDAMPSGDNPQNGFNFGNQPSVPSGGFNFG

SEQ ID NO: 2467 - protein, 527 aa, Setaria italica
RPSEREQMRKGNYKQSVDAEESRRRREGQMVDIRKAKREESLQKRRHVGFAASATGAVPPMGHSSALQQKLDGLPALVQAVLSNEPNVQLEATTQFRKLLSIERSPPIEEVISTGVVPRFIEFLTREDHPQLQFEAAWALTNIASGTSENTKVVVESGAVPIFVKLLNSHSEDVREQAVWALGNVAGDSPKCRDLVLGHGGLFPLLQQLNEHAKLSMLRNATWTLSNFCRGKPQPNFDQVKPALSALQRLIHSQDEEVLTDACWALSYLSDGTNDKIQAVIESGVFPRLVELLMHPSASVLIPALRTVGNIVTGDDLQTQCVIDHQALPCLLNLLTTNHKKSIKKEACWTISNITAGNREQIQAVINANIIAPLVHLLQTAEFDIKKEAAWAISNATSGGTNDQIKYLVGQGCIKPLCDLLVCPDPRIVTVCLEGLENILKVGEAEKNLGAGDVNVYAQLIDDAEGLDKIENLQSHDNTEIYEKAVKMLESYWLEEEDDAMPSGDNPQNGFNFGNQPSVPSGGFNFG

SEQ ID NO: 2468 - protein, 526 aa, Pennisetum glaucum
MSLRPSEREQMRKGNYKQSVDAEESRRRREGQMVDIRKAKREESLQKRRHVGFAGAVPPTSHSSALQQKLDGLPALVQAVLSNEPNVQLEATTQFRKLLSIERSPPIEEVISTGVVPRFIEFLTREDHPQLQFEAAWALTNIASGTSENTKVVVESGAVPIFVQLLNSHSEDVREQAVWALGNVAGDSPKCRDLVLSHGGLFPLLQQLNEHAKLSMLRNATWTLSNFCRGKPQPNFDQVKPALSALQRLIHSQDEEVLTDACWALSYLSDGTNDKIQAVIESGVFPRLVELLMHPSASVLIPALRTVGNIVTGDDLQTQCVIDHQALPCLLNLLTTNHKKSIKKEACWTISNITAGNREQIQAVIDANIIAPLVHLLQTAEFDIKKEAAWAISNATSGGTNDQIKYLVAQGCIKPLCDLLVCPDPRIVTVCLEGLENILKVGEAEKNLGGGDVNVYAQLVDDAEGLDKIENLQSHDNSEIYEKAVKMLETYWLEEEDDAMPSGDNPQNGFNFGNQPSVPSGGFNFG

SEQ ID NO: 2469 - protein, 498 aa, Panicum virgatum
QMVGIRKAKREESLQKRRHVGFPASAAGAVPAGHSSALQQKLDGLPALVQAVLSNDPNVQLEATTQFRKLLSIERSPPIEEVISTGVVPRFIEFLTREDHPQLQFEAAWALTNIASGTSENTKVVVESGAVPIFVKLLNSHSEDVREQAVWALGNVAGDSPKCRDLVLGHGGLFPLLQQLNEHAKLSMLRNATWTLSNFCRGKPQPNFDQVKPALSALQRLIHSQDEEVLTDACWALSYLSDGTNDKIQAVIESGVFPRLVELLMHPSASVLIPALRTVGNIVTGDDLQTQCVIDHQALPCLLNLLTTNHKKSIKKEACWTISNITAGNKEQIQAVINANIIAPLVHLLQTAEFDIKKEAAWAISNATSGGTHDQIKYLVGQGCIKPLCDLLVCPDPRIVTVCLEGLENILKVGEAEKNLGAGDVNVYAQMIDDAEGLDKIENLQSHDNTEIYEKAVKMLESYWLEEEDDAMPSGENPQNGFNFGNQPSVPSGGFNFG

SEQ ID NO: 2470 - protein, 534 aa, Oryza sativa
MSLRPSERAEVRRSRYKVAVDADEGRRRREDNMVEIRKSRREESLLKKRRDGLPAAAAAAAAASPLLAHSSALQQKLEGLPAMVQAVQSDDSAVQLEATTQFRKLLSIERSPPIEEVINTGVVPRFIAFLQREDYPQLQFEAAWALTNIASGTSDNTKVVVESGAVPIFVKLLSSPSEDVREQAVWALGNVAGDSPKCRDLVLASGGLYPLLQQLNEHAKLSMLRNATWTLSNFCRGKPQPNFEQVKPALSALQRLIHSQDEEVLTDACWALSYLSDGTNDKIQAVIESGVFPRLVELLMHPSASVLIPALRTVGNIVTGDDMQTQCVIDHQALPCLLNLLTNNHKKSIKKEACWTISNITAGNREQIQAVINANIIAPLVHLLQTAEFDIKKEAAWAISNATSGGTHDQIKYLVAQGCIKPLCDLLVCPDPRIVTVCLEGLENILKVGEAEKNLGAGDVNSYAQMIDDAEGLEKIENLQSHDNTEIYEKAVKMLESYWLEEEDDAMPSGDNAQNGFNFGNQQPNVPSGGFNFG

SEQ ID NO: 2471 - protein, 532 aa, Brachypodium distachyon
MSLRPSERAEVRRGRYKASVDAEEGRRRREDQMVEIRKNRREDFLLKKRREGLPSSAAPGGASQMGHSSALQQKLEGLPAMVQAVLSDDSAVQLEATTQFRKLLSIERSPPIEEVINTGVVPRFIEFLKREDYPQLQFEAAWALTNIASGTSENTKVVVEYGAVPIFVTLLSSPSEDVREQAVWALGNVAGDSPKCRDLVLGSGGLFPLLQQLNEHAKLSMLRNATWTLSNFCRGKPQPNFEQVKPALSALQRLIHSQDEEVLTDACWALSYLSDGTNDKIQSVIESGVFPRLVELLMHPSASVLIPALRTVGNIVTGDDLQTQCVIDHQALPCLLNLLTTNHKKSIKKEACWTISNITAGNRDQIQAVINANIIGPLVHLLQGAEFDIKKEAAWAISNATSGGTHDQIKYLVAQGCIKPLCDLLICPDPRIVTVCLEGLENILKVGEAEKNLGAGDVNTYAQMIDDAEGLEKIENLQSHDNTEIYEKAVKMLESYWLEEDDEAMPTGENPQNGFNFGNQQNSVPSGGFNFG

SEQ ID NO: 2472 - protein, 534 aa, Hordeum vulgare
MSLRPNERAEVRRSRYKASVDAEDGRRRREDQMVEIRKNQRDANLQKKRRDGFPAGAASAAGGAPQMGHSSALQQKLEGLPAMVQAVLSDDNTVQLEATTQFRKLLSIERSPPIEEVINTGVVPRFIEFLTREDYPQLQFEAAWALTNIASGTSDNTKVVVEFGAVPIFVKLLSSPSEDVREQAVWALGNVAGDSPKCRDLVLGSGGLYPLLQQLNEHAKLSMLRNATWTLSNFCRGKPQPNFEQVKPALSALQRLIHSQDEEVLTDACWALSYLSDGTNDKIQSVIESGVFPRLVELLLHPSASVLIPALRTVGNIVTGDDLQTQCVIDNQALPCLLNLLTTNHKKSIKKEACWTISNITAGNRDQIQAVIQANIIGPLVHLLQGAEFDIKKEAAWAISNATSGGTHDQIKYLVGQGCIKPLCDLLICPDPRIVTVCLEGLENILKVGEAEKNLGAGDVNNYAQMIDDAEGLEKIENLQSHDNTEIYEKAVKMLESYWLEEEDEVMPSGDNAQNGFNFGSQQNSVPSGGFNFG

SEQ ID NO: 2473 - protein, 534 aa, Triticum aestivum
MSLRPNERAEVRRSRYKASVDAEDGRRRREDQMVEIRKNQRDANLQKKRRDGFPAGAASAAGGAPQMGHSSALQQKLEGLPAMVQAVLSDDNAVQLEATTQFRKLLSIERSPPIEEVINTGVVPRFIEFLTREDYPQLQFEAAWALTNIASGTSDNTKVVVEYGAVPIFVKLLSSPSEDVREQAVWALGNVAGDSPKCRDLVLGSGGLFPLLQQLNEHAKLSMLRNATWTLSNFCRGKPQPNFEQVKPALSALQRLIHSQDEEVLTDACWALSYLSDGTNDKIQSVIESGVFPRLVELLLHPSASVLIPALRTVGNIVTGDDLQTQCVIDHQALPCLLNLLTTNHKKSIKKEACWTISNITAGNRDQIQAVIQANIIGPLVHLLQGAEFDIKKEAAWAISNATSGGTHDQIKYLVAQGCIKPLCDLLICPDPRIVTVCLEGLENILKVGEAEKNLGAGDVNNYAQMIDDAEGLEKIENLQSHDNTEIYEKAVKMLESYWLEEEDEVMPSGDNAQNGFNFGSQQNSVPSGGFNFG

SEQ ID NO: 2474 - protein, 534 aa, Avena sativa
MSLKPSDRLEARRSRYKASVDAEDGRRRREDNLVEIRKANRDANLQKKRRDGFPASAASAAGGAPQMGHSSALQQKLEGLPAMVQAVLSEDGAVQLEATTQFRKLLSIERSPPIEEVIATGVVPRFIVFLTREDYPQLQFEAAWALTNIASGTSDNTRVVVESGAVPIFVKLLSSPSEDVREQAVWALGNVAGDSPKCRDLVLGSGGLFPLLQQLNEHAKLSMLRNATWTLSNFCRGKPQPNFEQVKPALSALQRLIHSQDEEVLTDACWALSYLSDGTNDKIQSVIESGVFPRLVELLTHPSASVLIPALRTVGNIVTGDDLQTQCVIDHQALPCLLNLLTTNHKKSIKKEACWTISNITAGNRDQIQAVINANIIGPLVHLLQGAEFDIKKEAAWAISNATSGGTHDQIKFLVNQGCIKPLCDLLICPDPRIVTVCLEGLENILKVGEAEKNLGAGDVNNYAQMIDDAEGLEKIENLQSHDNTEIYEKAVKMLESYWLEEEDEAMPSGENPQNGFNFGDQQNSAPSGGFNFG

SEQ ID NO: 2475 - protein, 530 aa, Manihot esculenta
MSLRPSARTEVRRNRYKVAVDAEEGRRRREDNMVEIRKNRREESLQKKRREGLQAQPVPAAIHSSAVEKKLEHLPSMVAGVWSEDSNLQLEATTQFRKLLSIERSPPIEEVIQAGVVPRFVEFLMREDFPQLQFEAAWALTNIASGTSENTRVVIDHGAVPIFVKLLGSPSDDVREQAVWALGNVAGDSPKCRDLVLGHGALIPLLAQLNEHAKLSMLRNATWTLSNFCRGKPQPPFDQVKPALPALAHLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQAVIEANIIGPLVHLLQNAEFDIKKEAAWAISNATSGGTHDQIKYLVSQGCIKPLCDLLICPDPRIVTVCLEGLENILKVGEADKNLGNTGDVNQYAQMIDDAEGLEKIENLQSHDNTEIYEKAVKILETYWLEEEDETMPPGDASQSGFQFGGSEMPAVPSGGFNFS

SEQ ID NO: 2476 - protein, 530 aa, Manihot esculenta
MSLRPSARTEVRRNRYKVAVDAEEGRRRREDNMVEIRKNRREESLQKKRREGLQAQPMPASIHSSAVEKKLEHLPSMVAGVWSDDSNLQLEATTQFRKLLSIERSPPIEEVIQAGVVPRFVEFLMREDFPQLQFEAAWALTNIASGTSENTRVVIDHGAVPIFVKLLGSPSDDVREQAVWALGNVAGDSPKCRDLVLGHGALIPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQAVIEANIIGPLVHLLQNAEFDIKKEAAWAISNATSGGSHEQIKYLVSQGCIKPLCDLLICPDPRIVTVCLEGLENILKVGEADKNLGNTGGVNQYAQMIDDAEGLEKIENLQSHDNTEIYEKAVKMLETYWLEEEDETMPPGDASQSGFQFGGGEMPAVPSGGFNFS

SEQ ID NO: 2477 - protein, 529 aa, Theobroma cacao
MSLRPNARTEVRRNRYKVAVDAEEGRRRREDNMVEIRKNRREESLQKKRREGLQAQPMPASLHSSAVEKKLENLPAMVAGVWSEDSNLQLESTTQFRKLLSIERSPPIEEVIQAGVVPRFVEFLMREDFPQLQFEAAWALTNIASGTSENTKVVIDHGAVPIFVKLLGSPSDDVREQAVWALGNVAGDSPRCRDLVLGHGALLPLLAQLNEHAKLSMLRNATWTLSNFCRGKPQPPFDQVKPALPALARLIHSNDEEVLTDACWALSYLSDGTNDKIQAVIEAGVCARLVELLLHPSPSVLIPALRTVGNIVTGDDLQTQCIINHQALPCLLNLLTNNFKKSIKKEACWTISNITAGNKEQIQAVIEANIIAPLVHLLQNAEFDIKKEAAWAISNATSGGTHDQIKFLVSQGCIKPLCDLLNCPDPRIVTVCLEGLENILKVGEADKNQGNTGGVNLYAQMIDDAEGLEKIENLQSHDNTEIYEKAVKVLETYWLEEEDETMPPGDASQTGFQFGPGEVHVPSGGFNFS

SEQ ID NO: 2478 - protein, 530 aa, Centaurea maculosa
MSVRPNARTEVRRNRYKVAVDAEEGRRRREDNMVEIRKNKREESLQKKRREVLTGSQFSVPVQSASAAEKKLENLPAMVAGVWSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLGQGALIPLLAQLNEHAKLSMLRNATWTLSNFCRGKPQPSFDQTRPALPALQQLIHSNDEEVLTDACWALSYLSDGTNDKIQAVIEANVCPRLVELLNHPSPSVLIPALRTVGNIVTGDDMQTQYIINHQALPCLLNLLSNNHKKSIKKEACWTISNITAGNKEQIQTVIEANIIGPLVHLLQNAEFDIKKEAAWAISNATSGGSHDQIKYLVSQGCIKPLCDLLVCPDPRIVTVCLEGLENILKVGEAEKNLGRSGDVNLYAQMIDDAEGLEKIENLQSHDNNEIYEKAVKLLETYWLEEEDDAMPPGETTQPGFHFEGGDVSIPSGGFNFN

SEQ ID NO: 2479 - protein, 531 aa, Ricinus communis
MSLRPSARTEVRRNRYKVAVDAEEGRRRREDNMVEIRKNRREESLQKKRREGLQAQPMPASLHSSAVEKKLEHLPSMVAGVWSDDSNLQLEATTQFRKLLSIERSPPIEEVIQAGVVPRFVEFLMREDFPQLQFEAAWALTNIASGTSENTRVVIDHGAVPIFVKLLASPSDDVREQAVWALGNVAGDSPKCRDLVLGNGALLPLLAQLNEHAKLSMLRNATWTLSNFCRGKPQPFFEQVKPALPALARLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQAVIEANIIGPLVHLLENAEFDIKKEAAWAISNATSGGTHDQIKYLVSQGCIKPLCDLLICPDPRIVTVCLEGLENILKVGEADKNLGNNDGGVNLYAQMIDDAEGLEKIENLQSHDNIEIYEKAVKILETYWLEEEDETMPPGDASQSGFQFGGSDMPTIPSGGFNFS

SEQ ID NO: 2480 - protein, 532 aa, Sequoia sempervirens
MSLRPVSRTEVRRKNYKVAVDADEARRKREDNMVEIRKNKREESLLKKRREGMQAQQFAPAVQSSAVEKKLESLPAMVAGVWSDDPSLQLEATTQFRKLLSIERSPPIEEVIEAGVVPRFVEFLTRQDFPQLQFEAAWALTNIASGTSDHTRVVIDHGAVPIFVQLLSSPSDDVREQAVWALGNVAGDSPKCRDLVLSHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDMQTQYIINNQALPCLLALLTHNHKKSIKKEACWTISNITAGNKEQIQAVIDANIIPPLVQLLQTAEFDIKKEAAWAISNATSGGTHEQIKYLVNQGCIKPLCDLLVCPDPRIITVCLEGLENILKVGEAEKDLGNTGGVNLYAQYIDDAEGLEKIENLQSHDNNEIYEKAVKILETYWLEDEEDDQALPAGSDAAQPTFNFGANQPTVPSGGFNFG

SEQ ID NO: 2481 - protein, 531 aa, Eucalyptus grandis
MSLRPNARTEVRRNRYKVAVDAEEGRRRREDNMVEIRKNRREESLQKKRREGLQAQQQTAPSLHSSAVEKKLEHLPSMIGGVYSDDNNLQLEATTQFRKLLSIERSPPIEEVIQSGVVPRFVEFLMREDFPQLQFEAAWALTNIASGTSENTKVVVDHGAVPIFVKLLASPSDDVREQAVWALGNVAGDSPKCRDLVLANGALLPLLAQLNEHAKLSMLRNATWTLSNFCRGKPQPPFDQVRPALPALERLIHSNDEEVLTDACWALSYLSDGTNDKIQAVIEAGVCPRLVELLLHPSPSVLIPALRTVGNIVTGDDLQTQCIINHQALPCLLNLLTGNYKKSIKKEACWTISNITAGNKEQIQAVIEANIIAPLVHLLQNAEFDIKKEAAWAISNATSGGSHEQIKFLVCQGCIKPLCDLLICPDPRIVTVCLEGLENILKVGEAEKNLGGTGDVNLYAQMIDDAEGLEKIENLQSHDNNEIYEKAVKLLETYWLEEEDEAMPPEDSAHPGVPFGGNELPPVPSGGFKFG

SEQ ID NO: 2482 - protein, 532 aa, Podocarpus macrophillus
MSLRPISRTEVRKKSYKVAVDADEARRKREDNMVEIRKNKREESLLKKRREGMQAQQFTPQVQSSAVEKKLESLPAMVGGVWSDDPSLQLEATTQFRKLLSIERSPPIEEVIEAGVVPRFVEFLTRQDFPQLQFEAAWALTNIASGTSDHTRVVIDHGAVPIFVQLLSSPSDDVREQAVWALGNVAGDSPKCRDLVLSHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHEQIKYLVNQGCIKPLCDLLVCPDPRIITVCLEGLENILKVGEAEKDLGNSGGVNLYAQYIDDAEGLEKIENLQSHDNNEIYEKAVKILETYWLEDEEDDQALPAGGDVAQPAFNFGSNQPSVPSGGFNFG

SEQ ID NO: 2483 - protein, 531 aa, Aristolochia fimbriata
MSLRPNARTEVRRNRYKVAVDAEEGRRRREDNMVEIRKNRREESLQKKRREGMQAQQFPTSIHASAVEKKLESLPAMVNGVWSDDSNLQLEATTQFRKLLSIERSPPIEEVIQAGVVPRFVDFLLREDFPQLQFEAAWALTNIASGTSENTKVVIDHGAVPIFVKLLGSPSDDVREQAVWALGNVAGDSPRCRDLVLGHGALIPLLAQLNEHAKLSMLRNATWTLSNFCRGKPQPPFEQTKPALPALERLIHSNDEEVLTDACWALSYLSDGTNDKIQAVIEAGVCPRLVELLMHPSPSVLIPALRTVGNIVTGDDMQTQCIINHQALPCLLNLLTHNHKKSIKKEACWTISNITAGNKEQIQAVINADIIGPLVNLLHTAEFDIKKEAAWAISNATSGGTHDQIKYLVSQGCIKPLCDLLVCPDPRIVTVCLEGLENILKVGEAEKNVGNTGGVNLYAQLIDEAEGLEKIENLQSHDNTEIYEKAVKILETYWLEEEDELPPGDAAAAAQAGGFRFGGELPVPSGGFNFS

SEQ ID NO: 2484 - protein, 529 aa, Gossypium hirsutum
MSLRPNSRTEVRRNRYKVAVDAEEGRRRREDNMVEIRKNRREESLQKKRREGLQAQPMPASLHSSAVEKKLENLPAMVAGVWADDSNMQLEATTQFRKLLSIERSPPIDQVIQAGVVPRFIEFLARDDFPQLQFEAAWALTNIASGTSENTKVVIDHGAVPIFVKLLASPSDDVREQAVWALGNVAGDSPRCRDLVLSHGALLPLLAQLNEHVKLSMLRNATWTLSNFCRGKPQPPFDLVKPALPALTHLIHSNDEEVLTDACWALSYLSDGTNDKIQAVIEAGVCGRLVELLMHPSPSVLIPALRTVGNIVTGDDGQTQCIINHQVLPCLLNLLTNNFKKSIKKEACWTISNITAGNKEQIQAVIEANIISPLVHLLQNAEFDIKKEAAWAISNATSGGTHDQIKFLVSQGCIKPLCDLLNCPDPRIVTVCLEGLENILKVGEADKNLGTTGGVNLYAQMIDDAEGLEKIENLQSHDNTEIYEKAVKVLETYWLEEEDETMPPGDASQTGFHFGGGELPVPSGGFNFS

SEQ ID NO: 2485 - protein, 529 aa, Cucumis melo
MSLRPNERAEVRRNRYKVAVDADEGRRRREDNMVEIRKNRREESLQKKRREGLQAQQLQTSTHSSAVEKKLEHLPSMVAGVWSDDGSLQLESTTQFRKLLSIERSPPIEEVIQAGVVPRFVEFLMREDFPQLQFEAAWALTNIASGTSENTKVVIDHGAVPIFVKLLGSPSDDVREQAVWALGNVAGDSSRCRDLVLGHGALLPLLAQLNEQAKLSMLRNATWTLSNFCRGKPQPAFDLVKPALPALARLIHSNDEEVLTDACWALSYLSDGTNDKIQAVIEAGVCPRLVELLMHPAPSVLIPALRTVGNIVTGDDLQTQVIIQHNALPCLLNLLTNNHKKSIKKEACWTISNITAGNKAQIQAVIDANIVAPLVHLLQNAEFDIKKEAAWAISNATSGGSHDQIKYLVNQGCIKPLCDLLICPDPRIVTVCLEGLENILKVGEAEKNTTDTGGVNLYAQLIDDAEGLEKIENLQSHDNTEIYEKAVKILETYWLEEEDETMPPGTAPQGGFNFGGDRPVVPSGGFNFG

SEQ ID NO: 2486 - protein, 529 aa, Populus trichocarpa
MSLRPSARTEVRRNRYKVAVDAEEGRRRREDNMVEIRKNRREESLQKKRREGLQAQAMPASLHSSAAEKKLEHLPSMVAGVWTEDGNLQLEATTQFRKLLSIERSPPIEEVIQAGVVPRFVQFLMREDFPQLQFEAAWALTNIASGTSENTKVVIDHGAVPIFVQLLASPSDDVREQAVWALGNVAGDSPRCRDLVLGNGALLPLLAQLNENAKLSMLRNATWTLSNFCRGKPQPPFDQVKPALPALARLIHSDDEEVLTDACWALSYLSDGTNDKIQAVIEAGVCPRLVELLLHPSPSVLIPALRTVGNIVTGDDMQTQCIINHQALPCLLNLLANNYKKSIKKEACWTISNITAGNKEQIQAVIEANIIGPLVNLLQNAEFDIKKEAAWAISNATSGGAHEQIKYLVSQGCIKPLCDLLICPDPRIVTVCLEGLENILKVGEADKNVSETGGVNLYAQMIDDAEGLEKIENLQSHDNTEIYEKAVKILETYWLEEEDETMPPGDASQSGFQFGGEAPAVPSGGFNFS

SEQ ID NO: 2487 - protein, 532 aa, Abies balsamea
MSLRPMSRTEVRKKTYKVAVDADEARRKREDNMVEIRKNKREESLQKKRREGMQAQQFPPTVQSTAVEKKLESLPAMVAGVWSDEPTLQLEATTQFRKLLSIERSPPIEEVIDAGVVPRFVDFLTRHDFPQLQFEAAWALTNIASGTSEHTRVVIERGAVPIFVQLLSSPSDDVREQAVWALGNVAGDSPKCRDLVLSHGALPPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHEQIKYLVNQGCIKPLCDLLVCPDPRIVTVCLEGLENILKVGEAEKDLGNTGGVNLYAQFIDDAEGLEKIENLQSHDNNEIYEKAVKILETYWLEDDEDDQALPATGEAAQPAFNFGSNQPTVPSGGFTFG

SEQ ID NO: 2488 - protein, 532 aa, Pinus taeda
MSLRPMSRTEVRKKTYKVAVDADEARRKREDNMVEIRKSKREESLQKKRREGMQAQQFAPTVQSSAVEKKLESLPAMVAGVWSDEPNLQLEATTQFRKLLSIERSPPIEEVIDAGVVPRFVEFLTRHDFPQLQFEAAWALTNIASGTSEHTRVVIDRGAVPIFVQLLSSPSDDVREQAVWALGNVAGDSPKCRDLVLSHGALMPLLAQLNEHAKLSMLRNATWTLSNFCRGKPQPAFDQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHDQIKYLVNQGCIKPLCDLLVCPDPRIVTVCLEGLENILKVGEAEKDLGNTGGVNLYAQYIDDAEGLEKIENLQSHDNNEIYEKAVKILETYWLEDDEDDQTLPATGDAAQPTFNFGANQPTVPSGGFTFG

SEQ ID NO: 2489 - protein, 509 aa, Taxus baccata
MVAGVWSDDPALQLEATTQFRKLLSIERSPPIEEVIEAGVVPRFVEFLTRQDFPQLQFEAAWALTNIASGTSEHTRVVIDHGAVPIFVQLLSSPSDDVREQAVWALGNVAGDSPKCRDLVLTHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKEQIQAVIDANIIPPLVQLLQTAEFDIKKEAAWAISNATSGGTHEQIKYLVNQGCIKPLCDLLVCPDPRIITVCLEGLENILKVGEAEKDLGNTSGVNLYAQYIDDAEGLEKIENLQSHDNNEIYEKAVKILETYWLEDEEDDQALPASGDARPPSIQFRYKSTISAIWWIPVWLRRYLSCCKLGGYVMSVLNDFPRLCICAVVRHCKDNAWFLDGAGDRPIVGMSV

SEQ ID NO: 2490 - protein, 527 aa, Aquilegia formosa
MSLRPNARTEVRRNRYKVAVDAEEGRRRREDNMVEIRKNKREESLQKKRREGMQPQQFPAALHASNIEKKLESLPVMVQGVFADDNQLQLEATTQFRKLLSIERSPPIEEVIQSGVVPRFVEFLMREDFPQLQFEAAWALTNIASGTSDNTKVVIDHGAVPIFVKLLGSPSDDVREQAVWALGNVAGDSPRCRDLVLSHGALIPLLAQLNEHAKLSMLRNATWTLSNFCRGKPQPPFDQTKPALPALERLIHSNDEEVLTDACWALSYLSDGTNDKIQAVIEAGVCPRLVELLLHPSPSVLIPALRTVGNIVTGDDVQTQCIINHQALPCLLNLLTHNHKKSIKKEACWTISNITAGNKDQIQSVIAADIIGPLVHLLQTAEFDIKKEAAWAISNATSGGTHEQIKYLVVQGCIKPLCDLLVCPDPRIVTVCLEGLENILKVGETEKSLGNTGGVNVYAQYIDEAEGLEKIENLQSHDNTEIYEKAVKILETYWLEEEDEPLPPGDAAQTGFRFGGSEIPSGGFNFG

SEQ ID NO: 2491 - protein, 529 aa, Cucumis sativus
MSLRPNERAEVRRNRYKVAVDADEGRRRREDNMVEIRKNRREESLQKKRREGLQAQQLQTSTHSSVVEKKLEYLPSMVAGIWSDDGSLQLESTTQFRKLLSIERSPPIEEVIQAGVVPRFVEFLMREDFPQLQFEAAWALTNIASGTSENTKVVIDHGAVPIFVKLLGSPSDDVREQAVWALGNVAGDSSRCRDLVLGHGALVPLLAQLNEQAKLSMLRNATWTLSNFCRGKPQPAFDLVKPALPALARLIHSNDEEVLTDACWALSYLSDGTNDKIQAVIEAGVCPRLVELLMHPAPSVLIPALRTVGNIVTGDDLQTQVIIQHNALPCLLNLLTNNHKKSIKKEACWTISNITAGNKAQIQAVIDANIVAPLVHLLQNAEFDIKKEAAWAISNATSGGSHDQIKYLVNQGCIKPLCDLLICPDPRIVTVCLEGLENILKVGEAEKNTTNTGGVNLYAQLIDDAEGLEKIENLQSHDNTEIYEKAVKILETYWLEEEDETMPPGTDPQAGFNFGGDRPVVPSGGFNFG

SEQ ID NO: 2492 - protein, 529 aa, Populus trichocarpa
MSLRPSARTEVRRNRYKVAVDADEGRRRREDNMVEIRKNRREESLQKKRREGLQAQAIPAALHSSAAEKKLEHLPSMVAGVWSEDGNLQLEATTQFRKLLSIERSPPIEEVIQAGVVPRFVQFLMREDFPQLQFEAAWALTNIASGTSENTKVVIDHGAVPIFVQLLGSPSDDVREQAVWALGNVAGDSPRCRDLVLGHGALLPLLAQLNENAKLSMLRNATWTLSNFCRGKPQPPFDQVKPALPALARLIHSNDEEVLTDACWALSYLSDGTNDKIQAVIEAGVCPRLIELLLHPSPSVLIPALRTVGNIVTGDDMQTQCIINHQSLPCLLNLLTNNYKKSIKKEACWTISNITAGNKEQIQAVIEANLIGPLVHLLQNAEFDIKKESAWAISNATSGGTHEQIKYLVSQGCIKPLCDLLICPDPRIVTVCLEGLENILKVGEADKNVSDTGGVNLYAQMIDDAEGLEKIENLQSHDNSEIYEKAVKILETYWLEEDDETMPPGDASQSGFQFGGDAPAVPSGGFNFG

SEQ ID NO: 2493 - protein, 526 aa, Lactuca sativa
MSLRPSARTEVRRNRYKVAVDAEEGRRRREDNMVEIRKNRREESLQKKRREALTGSQFAVPVQSASAAEKKLENLPAMVAGVFSDDNNMQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPKCRDLVLAQGALIPLLSQLNEHAKLSMLRNATWTLSNFCRGKPQPSFSQTKPALPALQQLIHSNDEEVLTDACWALSYLSDGTNDKIQAVIEANVCPRLVELLNHPSPSVLIPALRTVGNIVTGDDMQTQYIINHQALPCLLNLLTNNHKKSIKKEACWTISNITAGNKEQIQTVIEANIIGPLIHLLQNAEFDIKKEAAWAISNATSGGSHDQIKYLVAQGCIKPLCDLLICPDPRIVTVCLEGLENILKVGEAEKNLGRSGDVNLYAQMIDDAEGLEKIENLQSHDNNEIYEKAVKLLETYWLEEEDDAMPPGDAARTQPAGRFHFGGGDVSV

SEQ ID NO: 2494 - protein, 530 aa, Eucalyptus grandis
MSLRPNARTEVRRNRYKVAVDADEGRRRREDNMVEIRKSRREESLLKKRREGLQAPQASPSLHSSAVEKKLENLPSMVAAVLSNDKSLQVDATTQFRKLLSIERSPPIEEVIQSGVVPRFVEFLMKEDFPQLQFEAAWALTNIASGTSENTKVVIDHGAVPIFVKLLRSPSDDVREQAVWALGNVAGDSPKCRDLVLLNGALLPLLAQLNEHAKLSMLRNATWTLSNFCRGKPQPLFEQVKPALPALAHLIHSTDEEVLTDACWALSYLSDGTNDKIQAVIEAGVCPRLVELLLHPSPSVLIPALRTVGNIVTGDDLQTQCVIEHQALPCLLNLLTGNYKKSIKKEACWTISNITAGNKEQIQAVVEADIIGPMVQLLQNAEFDIKKEAAWAISNATSGGSHEQIKFLVNQGCVKPLCDLLICPDPRIVTVCLEGLENILKVGEAEKNLGNTGDVNVYAQMVEDVEGLEKIESLQSHDNNEIYEKAVKILEAYWLEEDDDAMPPGDAPQPDMQFGGNNLPPMPSGGFKFG

SEQ ID NO: 2495 - protein, 530 aa, Cucumis melo
MSLRPTARTEVRRNRYKVSVDAEEGRRRREDNMVEIRKSKREESLQKKRREGLQAQQFPSAVHTSTVEKKLESLPSMVAGVWSDNSSLQLEATTQFRKLLSIERSPPIEEVIQSGVVPRFVEFLVREDFPQLQFEAAWALTNIASGTSEHTKVVIDHGAVPIFVKLLASPSDDVREQAVWALGNVAGDSPTCRDLVLRHGALIPLLSQLNEHAKLSMLRNATWTLSNFCRGKPQPPFDQVKPALPALERLVHSNDEEVLTDACWALSYLSDGTNDKIQAVIEAGVCGRLVQLLLHPSPSVLIPALRTVGNIVTGDDIQTQCIINDGALPCLLSLLTHNHKKSIKKEACWTISNITAGNKEQIQAVIEAGLIPPLVNLLQNAEFDIKKEAAWAISNATSGGTHEQIKYLVSQGCIKPLCDLLVCPDPRIVTVCLEGLENILKVGEAEKNLGTNGDVNLYAQMIDDAEGLEKIENLQSHDNHEIYEKAVKILETYWLEEEDEALPTTDGGAQPGFRFGGNELPVPSGGFNFS

SEQ ID NO: 2496 - protein, 529 aa, Euphorbia esula
  misc_feature (28)..(28): Xaa can be any naturally occurring amino acid
  misc_feature (131)..(131): Xaa can be any naturally occurring amino acid
  misc_feature (145)..(145): Xaa can be any naturally occurring amino acid
  misc_feature (204)..(204): Xaa can be any naturally occurring amino acid
  misc_feature (445)..(445): Xaa can be any naturally occurring amino acid
MSLRPSARTEVRRNRYKVAVDAEEGRRXREDNMVEIRKNRREESLQKKRREGLQSQPMPASLHSSAVEKRLEHLPSMVAGVWSDDSNLQLEATTQFRKLLSIERSPPIEEVIQAGVVPRFVEFLMREDFPXLQFEAAWALTNIAXGTSENTRVVIDHGAVPIFVKLLASPSDDVREQAVWALGNVAGDSPKCRDLVLGNGALLXLLSQLNEHAKLSMLRNATWTLSNFCRGKPQPSFDQVKPALPALARLIHSNDEEVLTDACWALSYLSDGTNDKIQAVIEAGVCPRLVELLLHPSPSVLIPALRTVGNIVTGDDMQTQCIINHQALPCLLNLLTNNYKKSIKKEACWTISNITAGNKEQIQCVIEANIIGPLVHLLQNAEFDIKKEAAWAISNATSGGAHEQIKYLVSQGCIKPLCDLLICPDPRIVTVCLEGLENILKVGEXDKNLGENGGVNIYAQMIDDAEGLEKIENLQSHDNTEIYEKAVKILEAYWLEEDETMPPGDASQSGFQFGGNEMPAVPSGGFNFS

SEQ ID NO: 2497 - protein, 532 aa, Pseudotsuga menziesii
MSLRPMSRTEVRKKTYKVAVDADEARRKREDNMVEIRKSKREESLQKKRREGMQAQQFAPAVQSSAVEKKLESLPAMVAGVWSDEPNLQLEATTQFRKLLSIERSPPIEEVIDAGVVPRFVEFLTRHDFPQLQFEAAWALTNIASGTSEHTRVVIDRGAVPIFVQLLSSPSDDVREQAVWALGNVAGDSPKCRDLVLSHGALMPLLAQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQSAEFDIKKEAAWAISNATSGGTHEQIKYLVNQGCIKPLCDLLVCPDPRIVTVCLEGLENILKVGEAEKDLGNTGGVNLYAQFIDDAEGLEKIENLQSHDNNEIYEKAVKILETYWLEDDEDDQTLPATGDAAQQTFNFGTNQPTVPSGGFTFG

SEQ ID NO: 2498 - protein, 532 aa, Glycine max
MSYRPSGNSRTEVRRNRYKVAVDAEEGRRRREDTMVEIRKNRREESLQKKRREGLQPQQMPASVHSSLVEKKLEHLPSMVTGVWTDDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQVIINHQALPCLLNLLTNNYKKSIKKEACWTISNITAGNKQQIQAVIEANLIAPLVNLLQNAEFDIKKEAAWAISNATSGGSHEQIKFLVSQGCIKPLCDLLICPDPRIVTVCLEGLENILKVGEADKNIGNTGDVNLYAQMIDEAEGLEKIENLQSHDNTEIYEKAVKILETYWLEEEDETMPPGDASQSGFNFGSSDAPTVPSGGFNFN

SEQ ID NO: 2499 - protein, 530 aa, Glycine max
MSLRPNARTEIRRNRYKVAVDADEGRRRREDNMVEIRKSKREESLLKKRREGLQAQQQFPAPLQNSTVDKKLESLPAMVAGVWSDDNSIQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSQGALVPLLAQLNEHAKLSMLRNATWTLSNFCRGKPQPPFEQVRPALPALERLVFSNDEEVLTDACWALSYLSDGTNDKIQAVIEAGVCARLVQLLIHPSPSVLIPALRTVGNIVTGDDMQTQCIINHGALPCLLNLLTNNHKKSIKKEACWTISNITAGNKEQIQTVIEAGLVAPLVNLLQNAEFDIKKEAAWAISNATSGGIHEQIKYLVSQGCIKPLCDLLVCPDPRIVTVCLEGLENILKVGEAEKSLGNTGDVNEYAQMIDDAEGLEKIENLQSHDNNEIYEKAVKILETYWLEEEDETLPSGDGAQPGFNFGNNELPVPSGGFNFS

SEQ ID NO: 2500 - protein, 532 aa, Glycine max
MSYRPSGNSRTEVRRNRYKVAVDADEGRRRREDTMVEIRKNRREESLQKKRREGFQPQQIPASVHSSLVEKKLEHLPSMVTGVWTDDNNLQLEATTQFRKLLSIERSPPIEEVIQTGVVSRFVEFLMREDFPQLQFEAAWALTNIASGTSENTKVVIDHGAVPIFVKLLASPSDDVREQAVWALGNVAGDSPRCRDLVLSHGALLPLLAQLNEHAKLSMLRNATWTLSNFCRGKPQPPFDQVKPALPALARLIHSNDEEVLTDACWALSYLSDGTNDKIQAVIEAGVCPRLVELLLHPSPSVLIPALRTVGNIVTGDDMQTQVIINHQALPCLLNLLTNNYKKSIKKEACWTISNITAGNKQQIQAVIEANLIAPLVNLLQNAEFDIKKEAAWAISNATSGGSHEQIKFLVSQGCIKPLCDLLICPDPRIVTVCLEGLENILKVGEADKNIGNTGDVNLYAQMIDEAEGLEKIENLQSHDNTEIYEKAVKILETYWLEEEDETMPPGDASQSGFNFGSSDAPAVPSGGFNFN

SEQ ID NO: 2501 - protein, 533 aa, Picea glauca
  misc_feature (207)..(207): Xaa can be any naturally occurring amino acid
MSLRPMSRTEVRKKTYKVAVDADEARRKREDNMVEIRKSKREESLQKKRREGMQAQQFAPTVQSSAVEKKLESLPAMVAGVWSDEPNLQLEATTQFRKLLSIERSPPIEEVIDAGVVPRFVEFLTRHDFPQLQFEAAWALTNIASGTSEHTRVVIDRGAVPIFVQLLSSPSDDVREQAVWALGNVAGDSPKCRDLVLSHGALMPLLXQLNEHAKLSMLRNATWTLSNFCRGKPQPAFEQTKPALPALERLIHSNDEEVLTDACWALSYLSDGTNDKIQAVIEAGVCRRLVELLLHPSPSVLIPALRTVGNIVTGDDVQTQYIINNQALPCLLALLTHNHKKSIKKEACWTISNITAGNKDQIQAVIDANIIPPLVQLLQTAEFDIKKEAAWAISNATSGGTHEQIKYLVNQGCIKPLCDLLVCPDPRIVTVCLEGLENILKVGEAEKDLGNTGGVNLYAQFIDDAEGLEKIENLQSHDNNEIYEKAVKILETYWLEDDEDDQTLPATGDAAAQPTFNFGTNQPTVPSGGFTFG

SEQ ID NO: 2502 - protein, 54 aa, Zea mays
MYRGDLPFCSEECRQEQIEIDEAREQRLKQTGRAEQQRQRQQKQSPQRIPIWAW

SEQ ID NO: 2503 - protein, 130 aa, Saccharum officinarum
MAHYHHPVSTEAYGDLEAGFSGHSSSSPLKPAASPRRPGRMFCDPCDDADELHGHHHFLDICFRCRKLLSGNRDIFMYRGDMPFCSEECRQEQIEIDEAREQRLKQTGRAEQQRQRQQKQSPQRIPIWAW

SEQ ID NO: 2504 - protein, 128 aa, Panicum virgatum
MAHYNPVSVDAYGDLEAGFSGHSATPLKPAASPRRPGRMFCDPCDDADELHGHHHFLDICFRCRKLLSGNRDIFMYRGDMPFCSEECRQEQIEIDEAREQRLKQTGRAEQQRQRQQKQSPQRIPIWAW

SEQ ID NO: 2505 - protein, 129 aa, Sorghum bicolor
MAHYHPKEAYGDLEAGFSGHSSSSSSPLKPAASPRRPGRMFCDPCDDADELHGHHHYLDICFRCRKLLSGNRDIFMYRGDMPFCSEECRQEQIEIDEAREQRLKQTGRAEQQRQRQQKQNPQRIPIWAW

SEQ ID NO: 2506 - protein, 128 aa, Panicum virgatum
MAHYNPVSVDAYGDLEAGFSGHSATPLKPAASPRRPGRMFCDPCDDADELHGHHHYLDICFRCRRLLSGNRDIFMYRGDMPFCSEECRQEQIEIEEAREQRLKHTGRAEQQRQRQQKQSPQRIPIWAW

SEQ ID NO: 2507 - protein, 129 aa, Setaria italica
MAHYNPVSVDAHGDLEAGFSGHPGTPLKPAASPRRPGRMFCDPCDDADELHGHHHYLDICFRCRKLLSGNRDIFMYRGDMPFCSEECRQEQIDIDEAREQRSKQTGRAEQQLQRQQQKQSPQRIPIWAW

SEQ ID NO: 2508 - protein, 127 aa, Pennisetum glaucum
MARYNPVSVDAYGDLEAGYSGHPGTPLKPAASPRRPGRMFCDPCDDADELHGHHHYLDICFRCRKLLSGNRDIFMYRGDMPFCSEECRQEQIEIDEAREHRSKQTGRAEQQRQQQKQNPQRIPIWAW

SEQ ID NO: 2509 - protein, 129 aa, Cenchrus ciliaris
  misc_feature (101)..(101): Xaa can be any naturally occurring amino acid
MARYNPVSVDAYGDLEAGYSGHRGTPLKPAASPRRPGRMFCDPCDDADELHGHHHYLDICFRCRKLLSGNRDIFMYRGDMPFCSEECRQEQIEIDEAREHXSKQTGRAEQQRQQQKQKQSPQRIPIWAW

SEQ ID NO: 2510 - protein, 201 aa, Solanum phureja
MSRYRGPRFKKIRRLGALPGLTNKKPRTGSDLRNQSRSVKKSQYRIRLEEKQKLRFHYGLTERQLLKYVRIARKAKGSTGQVLLQLLEMRLDNILFRLGMASTIPAARQLVNHRHILVNGHIVDIPSYRCKPRDIITAKDEQKSRALIQISLDSSPHEELPNHLTLQPFQYKGLVNQIIDSKWVGLKINELLVVEYYSRQT

SEQ ID NO: 2511 - protein, 201 aa, Solanum phureja
MSRYRGPRFKKIRRLGALPGLTNKKPRTGSDLRNQSRSVKKSQYRIRLEEKQKLRFHYGLTERQLLKYVRIARKAKGSIGQVLLQLLEMRLDNILFRLGMASTIPAARQLVNHRHILVNGHIVDIPSYRCKPRDIITAKDEQKSRALIQISLDSSPHEELPNHLTLQPFQYKILVNQIIDSKWVGLKINELLVVEYYSRQT

SEQ ID NO: 2512 - protein, 113 aa, Guizotia abyssinica
MRLDNILFRLGMAPTIPGARQLVNHRHILVNGRIVDIPSYRCKPRDTIAARDEQKSRALIQNSLDSSPHEELPNHLTLQPFQYKGLVNQIIDSKWVGLKINELLVVEYYSRQT

SEQ ID NO: 2513 - protein, 201 aa, Coffea canephora
MSRYRGPRFKKIRRLGALPGLTNKKPRAGNDLRNQLRSGKKSQYRIRLEEKQKLRFHYGLTERQLLKYVRIAGKAKGSTGQVLLQLLEMRLDNILFRLGMASTIPAARQLVNHRHILVNGRIVDIPSYRCKPRDIITGKDEQKSRALIQKSLDSSPQEELPSHLTLHPFQYKGLVNQIIDSKWVGLKINELLVVEYYSRQT

SEQ ID NO: 2514 - protein, 201 aa, Tragopogon dubius
MSRYRGPRFKKIRRLGALPGLTNKRPRAGSDLRNQSRSGKKSQYRIRLEEKQKLRFHYGLTERQLLKYVRIAGKAKGSTGQVLLQLLEMRLDNILFRLGMAPTIPGARQLVNHRHILVNGRIVDIPSYRCKPRDTIAARDEQKSKALIQNSLDSSPHEELPNHLTLQPFQYKGLVNQIIDSKWVGLKINELLVVEYYSRQT

SEQ ID NO: 2515 - protein, 201 aa, Parthenium argentatum
MSRYRGPRFKKIRRLGALPGLTNKRPRAGSDLRNQSRSGKKSQYRIRLEEKQKLRFHYGLTERQLLKYVRIAGKAKGSTGQVLLQLLEMRLDNILFRLGMAPTIPGARQLVNHRHILVNGRIVDIPSYRCKPRDTIAARDEQKSRALIQNYLDSSPPEELPNHLTLQPFQYKGLVNQIIDSKWVGLKINELLVVEYYSRQT

SEQ ID NO: 2516 - protein, 201 aa, Lactuca sativa
MSRYRGPRFKKIRRLGALPGLTNKRPRAGSDLRNQSRSGKKSQYRIRLEEKQKLRFHYGLTERQLLKYVRIAGKAKGSTGQVLLQLLEMRLDNILFRLGMAPTIPGARQLVNHRHILVNGRIVDIPSYRCKPRDTIAARDEQKSKVLIQNSLDSSPHEELPNHLTLQPFQYKGLVNQIIDSKWVGLKINELLVVEYYSRQT

SEQ ID NO: 2517 - protein, 748 aa, Artemisia annua
MIIRSPEPEVKILVDRDHIKTSFEEWARPGHFSRTIAKGPETTTWIWNLHADAHDFDSHTSDLEEISRKVFSAHFGQLSIIFLWLSGMYFHGARFSNYEAWLSDPTHIRPSAQVVWPIVGQEILNGDVGGGFRGIQITSGFFQIWRASGITSELQLYCTAIGGLVFAALMLFAGWFHYHKAAPKLAWFQDVESMLNHHLAGLLGLGSLSWAGHQVHVSLPINQFLNAGVDPKEIPLPHEFILNRDLLAQLYPSFAEGATPFFTLNWSKYSDFLTFRGGLDPVTGGLWLTDTAHHHLAIAILFLIAGHMYRTNWGIGHGLKDILEAHKGPFTGQGHKGLYEILTTSWHAQLSLNLAMLGSLTIIVAHHMYAMPPYPYLATDYGTQLSLFTHHMWIGGFLIVGAAAHAAIFMVRDYDPTTRYNDLLDRVLRHRDAIISHLNWACIFLGFHSFGLYIHNMSALGRPQDMFSDTAIQLQPVFAQWIQNTHALAPSATAPGATASTSLTWGGGDLVAVGGKVALLPIPLGTADFLVHHIHAFTIHVTVLILLKGVLFARSSRLIPDKANLGFRFPCDGPGRGGTCQVSAWDHVFLGLFWMYNAISVVIFHFSWKMQSDVWGSISDQGVVTHITGGNFAQSSITINGWLRDFLWAQASQVIQSYGSSLSAYGLFFLGAHFVWAFSLMFLFSGRGYWQELIESIVWAHNKLKVAPATQPRALSIVQGRAVGVTHYLLGGIATTWAFFLARIIAVG

SEQ ID NO: 2518 - protein, 201 aa, Helianthus annuus
MPRYRGPRFKKIRRLGALPGLTNKRPRAGSDLRNQSRSGKKSQYRIRLEEKQKLRFHYGLTERQLLKYVRIAGKAKGSTGQVLLQLLEMRLDNILFRLGMAPTIPGARQLVNHRHVLVNGRIVDIPSYRCKPRDTIAARDEQKSRALIQNSLDSSPPEELPNHLTLQPFQYKGLVNQIIDSKWVGLKINELLVVEYYSRQT

SEQ ID NO: 2519 - protein, 201 aa, Manihot esculenta
MSRYRGPRFKKIRRLGALPGLTSKRPRVGSDLRNQSRSGKKSQYRIRLEEKQKLRFHYGVTERQLLKYVRIAAKAKGSTGQVLLQLLEMRLDNILFRLGMASTIPRARQLVNHRHILVNGRIVDIPSYRCKPRDIITARDEQKSRAMIQNDLDSSPQEELPKHLTLHPFQYKGLVNQIIDSKWVGLKINELLVVEYYSRQT

SEQ ID NO: 2520 - protein, 113 aa, Taraxacum officinale
MRLDNILFRLGMAPTIPGARQLVNHRHILVNGRIVDIPSYRCKPRDTIAARDEQKSKALIQNSLDSSPQEELPNHLTLQPFQYKGLVNQIIDSKWVGLKINELLVVEYYSRQT

SEQ ID NO: 2521 - protein, 201 aa, Ricinus communis
MSRYRGPRFKKIRRLGALPGLTSKRPRAGSDLRNQSRSGKKSQYRIRLEEKQKLRFHYGLTERQLLKYVRIAAKAKGSTGQVLLQLLEMRLDNILFRLGMASTIPRARQLVNHRHILVNGRIVDIPSYRCKPRDIITARDEQKSRAMIQNYLESSPQEELPKHLTLDPFQYKGLVNQIIDNKWIGLKINELLVVEYYSRQT

SEQ ID NO: 2522 - protein, 201 aa, Panax ginseng
MSRYRGPRFKKIRRLGALPGLTNKRPRAGSDLRNQSRSGKKSQYRIRLEEKQKLRFHYGLTERQLLKYVRIAGKAKGSTGQVLLQLLEMRLDNILFRLGMAPTIPGARQLVNHRHILVNGRIVDIASYRCKPRDIITARDEENSRTLIQNSLDSSSHDELPKHLTLHPFQYKGLVNQIIDSKWVGLKINELLVVEYYSRQT

SEQ ID NO: 2523 - protein, 201 aa, Prunus persica
MSRYRGPRFKKIRRLGALPGLTSKKPRAGSDLRNQSRPGKKSQYRIRLEEKQKLRFHYGLTEQQLLKYVRIAGKAKGSTGQVLLQLLEMRLDNILFRLGMASTIPQARQLVNHRHILVNGRIVDIPSYRCKTRDIITVRDEQKSRALIQNYLDSPPREELPKHLTLHPFQYEGLVNQIIDSKWVGLKINELLVVEYYSRQT

SEQ ID NO: 2524 - protein, 186 aa, Solanum tuberosum
MSRYRGPRFKKIRRLGALPGLTNKKPRTGSDLRNQSRSGKKSQYRIRLEEKQKLRFHYGLTERQLLKYVRIARKAKGSTGQVLLQLLEMRLDNILFRLGMASTIPAARQLVNHRHILVNGHIVDIPSYRCKPRDIITAKDEQKSRALIQISLDSSPHEELPNHLTLQPFQYKGLVNQIIDSKWGSV

SEQ ID NO: 2525 - protein, 554 aa, Arachis hypogaea
MALRFPRFSQGLAQDPTTRRIWFGIATAHDFESHDDITEERLYQNIFASHFGQLAIIFLWTSGNLFHVAWQGNFETWVQDPLHVRPIAHAIWDPHFGQPAVEAFTRGGALGPVNIAYSGVYQWWYTIGLRTNGDLYTGALFLLFLSAISLIAGWLHLQPKWKPSVSWFKNAESRLNHHLSGLFGVSSLAWTGHLVHVAIPGARGEYVRWNNFLGVLPHPQGLGPLFTGQWNLYAQNPDSSSHLFGTPQGAGTAILTLLGGFHPQTQSLWLTDIAHHHLAIAILFLIAGHMYRTNFGIGHSIKEILEAHIPPGGRLGRGHKGLYDTINNSLHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPIFAQWIQSAHGKTSYGFDVLLSSTNSPAFNAGRSIWLPGWLNAINESSNSLFLTIGPGDFLVHHAIALGLHTTTLILVKGALDARGSKLMQIKRFWL

SEQ ID NO: 2526 - protein, 202 aa, Quercus alba
MSRYRGPRFKKIRRLGALPGLTSKRPKAGSDLRNQSRSSKKSQYRIRLEEKQKLRFHYGLTERQLLKYVRIAGKAKGSTGRVLLQLLEMRLDNILFRLGMASTIPQARQLVNHRHILVNGRIVDIPSYRCKPQDIITARDEQKYRALIKNCLDSSPRDEELPKHLTFHPFQYKGLVNQIIDSKWVGLKINELLVVEYYSRQT

SEQ ID NO: 2527 - protein, 498 aa, Vitis vinifera
MRINPTTSGPGVSTLEKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNISESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESKLKK

SEQ ID NO: 2528 - protein, 157 aa, Lotus japonicus
MSRYRGPRIKKIRRLGALPGLTSKRPTVGSELRNQSRSTKKSQYRIRLEEKQKLRFHYGLTERQLLKYVRIAGKAKGSTGQVLLQLLEMRLDNILFRLGMASTIPQARQLVNHRHVFVNGHIVDIPSYRCKPQDIITAKDNKKSKALIQNSLESAPP

SEQ ID NO: 2529 - protein, 99 aa, Juglans hindsii x Juglans regia
MSRYRGPRFKKVRRLGALPGLTSKRLKAGSDVRNQSRSSKKSQYRIRLEEKQKLRFHYGLTERQLLKYVRIAGKAKGSTGQVLLQLLEMRLDNILFDWV

SEQ ID NO: 2530 - protein, 201 aa, Gossypium hirsutum
MSRYRGPRFKKIRRLGALPGLTSKRPRAGSDLRNQSRPGKKSQYRIRLEEKQKLRFHYGLTERQLLKYVRIARKAKGSTGQVLLQLLEMRLDNILFRLGMASTIPQARQLVNHRHILVNGRTVDIPSYRCKPRDIISARDEQKSRTLIQNYLDSSTNEELPKHLTFHTLQYKGLVNQIIDRKWVGLKINELLVVEYYSRQT

SEQ ID NO: 2531 - protein, 201 aa, Vitis vinifera
MSRYRGPRFKKIRRLGALPGLTSKRPRAGSDLRNQSRSGKRSQYRIRLEEKQKLRFHYGLTERQLLNYVRIAGKAKGATGRVLLQLLEMRLDNILFRLGMASTIPGARQLVNHRHILVNGRIVDIPSYRCKPRDIITAGNEQKSRALIQNVFDSSSHEELPKHLTLHPFQFKGLVNQIIDSNWVGLKINELLVVEYYSRQT

SEQ ID NO: 2532 - protein, 201 aa, Lotus japonicus
MSRYRGPRFKKIRRLGALPGLTSKRPTVGSELRNQSRSTKKSQYRIRLEEKQKLRFHYGLTERQLLKYVRIAGKAKGSTGQVLLQLLEMRLDNILFRLGMASTIPQARQLVNHRHVFVNGHIVDIPSYRCKPQDIITAKDNKKSKTLIQNSLESAPREELPTHLTLQPFQYKGLVNQIIDSKWVGLKINELLVVEYYSRQT

SEQ ID NO: 2533 - protein, 201 aa, Medicago truncatula
MSRYRGPRFKKIRRLGALPGLTSKGPTVGSELKNQSRSSKKSQYRIRLEEKQKLRFHYGLTERQLLKYVRIAGKAKGSTGQVLLQLLEMRLDNILFRLGMASTIPQARQLVNHRHVLVNGRIVDIPSYRCKPEDIITAKDEQKSRTLIQNSLESAPREKLPIHLTLDPFQYKGLVNQIIDSKWVGLKINELLVVEYYSRQT

SEQ ID NO: 2534 - protein, 201 aa, Lotus japonicus
MSRYRGPRFKKIRRLGALPGLPSKRPTVGSELRNQSRSTKKSQYRIRLEEKQKLRFHYGLTERQLLKYVRIAGKAKGSTGQVLLQLLEMRLDNILFRLGMASTIPQARQLVNHRHVFVNGHIVDIPSYRCKPQDIITAKDNKKSKTLIQNSLESAPREELPTHLTLQPFQYKGLVNQIIDSKWVGLKINELLVVEYYSRQT

SEQ ID NO: 2535 - protein, 109 aa, Medicago truncatula
MSRYRGPRFKKIRRLGALPGLTSKGPTVGSELKNQSRSSKKSQYRIRLEENKNCVFIMVLQNDNCLNTFVSLEKRKVQPVKFYYNYLKCVWITYFFDWVWLRLFLKPVN

SEQ ID NO: 2536 - protein, 225 aa, Brassica napus
MNSIKFPVLDRTTKNSVISTTLNDLSNWSRLSSLWPLLYGTSCCFIEFASLIGSRFDFDRYGLVPRSSPRQADLILTAGTVTMKMAPSLVRLYEQMPEPKYVIAMGACTITGGMFSTDSYSTVRGVDKLIPVDVYLPGCPPKPEAVIDAITKLRKKIAREIYKDRIRPQRGNRCFTTNHKFFVVRSTQTGNYDQELLYPPSSTSEISTETFFKYKSPVSSHELVN

SEQ ID NO: 2537 - protein, 227 aa, Citrus sinensis
MNSIEFSLLDRTTPNSFISTTSNDLSNWSRLSSLWPLLYGTSCCFIEFASLIGSRFDFDRYGLVPRSSPRQADLILTAGTVTMKMAPSLVRLYEQMPEPKYVIAMGACTITGGMFSTDSYSTVRGVDKLIPVDVYLPGCPPKPEAVIDAITKLRKKISREIYEDRIRLQRENRSFTFTTNHKFRVVCSTNTGNYDQGLLYQPPSTSEIPPETFFKYKSSVSSPEFIN

SEQ ID NO: 2538 - protein, 460 aa, Raphanus sativus
MIIRSPEPEVKILVDRDPIKTSFEEWAKPGHFSRTIAKGPDTTTWIWNLHADAHDFDSHTSDLEEISRKVFSAHFGQLSIIFLWLSGMYFHGARFSNYEAWLSDPTHIGPSAQVVWPIVGQEILNGDVGGGFRGIQITSGFFQLWRASGITSELQLYCTAIGALVFAALMLFAGWFHYHKAAPKLAWFQDVESMLNHHLAGLLGLGSLSWAGHQVHVSLPINQFLNAGVDPKEIPLPHEFILNRDLLAQLYPSFAEGATPFFTLNWSKYSDFLTFRGGLDPVTGGLWLTDTAHHHLAIAILFLIAGHMYRTNWGIGHGLKDILEAHKGPFTGQGHKGLYEILTTSWHAQLSLNLAMLGSLTIVVAHHMYSMPPYPYLATDYATQLSLFTHHMWIGGFLIVGAAAHAAIFMVRDYDPTNRYNDLLDRVLRHRDAIISHLNWVCIFLGFHSFGLYIHNDTMS

SEQ ID NO: 2539 - protein, 734 aa, Arabidopsis lyrata
MALRFPRFSQGLAQDPTTRRIWFGIATAHDFESHDDITEERLYQNIFASHFGQLAIIFLWTSGNLFHVAWQGNFETWVQDPLHVRPIAHAIWDPHFGQPAVEAFTRGGALGPVNIAYSGVYQWWYTIGLRTNEDLYTGALFLLFLSALSLIGGWLHLQPKWKPRVSWFKNAESRLNHHLSGLFGVSSLAWTGHLVHVAIPASRGEYVRWNNFLNVLPHPQGLGPLFTGQWNLYAQNPDSSSHLFGTSQGSGTAILTLLGGFHPQTQSLWLTDMAHHHLAIAILFLIAGHMYRTNFGIGHSIKDLLEAHIPPGGRLGRGHKGLYDTINNSIHFQLGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPIFAQWIQSAHGKTSYGFDVLLSSTSGPAFNAGRSIWLPGWLNAINENSNSLFLTIGPGDFLVHHAIALGLHTTTLILVKGALDARGSKLMPDKKDFGYSFPCDGPGRGGTCDISAWDAFYLAVFWMLNTIGWVTFYWHWKHITLWQGNVSQFNESSTYLMGWLRDYLWLNSSQLINGYNPFGMNSLSVWAWMFLFGHLVWATGFMFLISWRGYWQELIETLAWAHERTPLANLIRWKDKPVALSIVQARLVGLAHFSVGYIFTYAAFLIASTSGKFG

SEQ ID NO: 2540 - protein, 201 aa, Arabidopsis thaliana
MSRYRGPRFKKIRRLGALPGLTSKRPKAGSDLRNQSRSVKKSQYRIRLEEKQKLRFHYGLTEHQLLKYVRIAGKAKGSTGQVLLQLLEMRLDNILFRLGMALTIPQARQLVNHGHILVNGRIVDIPSYRCKPRDIITVKDEQNSRTLVQNLLDSSAPEELPNHLTLHTFQYEGLVNQIIDRKCVGLKINELLVVEYYSRQT

SEQ ID NO: 2541 - protein, 63 aa, Fragaria vesca
MSRYRGPRFKKIRCLGALPGLTSKKPRAGSDLRTQSRPGKKSQYRIRLEEKQKFHFHYGLTEQ

SEQ ID NO: 2542 - protein, 201 aa, Cajanus cajan
MSRYRGPRFKKIRRLGSLPGLTRKKLTVKSELRNQSRSSKKSQYRIRLEEKQKLRFHYGLTERQLLKYVRIAGKAKGSTGQVLLQLLEMRLDNILFRLGMAATIPQARQLINHRHVLVNGRIVDIPSYRCKPQDIITAKDEQKSKTLIQNYLDSAPRDKLPNHLTLHPFQYKGLINQIIDNKWVGLKINELLVVEYYSRQT

SEQ ID NO: 2543 - protein, 201 aa, Persea americana
MSRYRGPRFKKIRCLGALPGLTSKRPRSGSDLRNQSRFGKRSQYRIRLEEKQKLRFHYGLTERQLLRYVRIAGKAKGSTGQVLLQLLEMRLDNILFRLGMASTIPGARQLVNHRHILVNGRVVDIPSYRCKPRDIITARDEQRSRALIQNYLDSSPREDLAKHLTFDSSQYKGLVNQIIDIKWIGLKINEFLVVEYYSRQT

SEQ ID NO: 2544 - protein, 99 aa, Ricinus communis
PRFKKIRRLGTLPGLTSKRPRAGSDLRNQSRSGKKSQYRIRLEEKQKLRFHYGLTERQLLKYVRIAAKAKGSTGQVLLQLLEMRLDNILFRLGMASTIP

SEQ ID NO: 2545 - protein, 58 aa, Glycine max
MRLDNILFRLGMAATIPQARQLINHRHVLVNGHIVDIPSYRCKPQDIITAKDEQNRKL

SEQ ID NO: 2546 - protein, 201 aa, Amborella trichopoda
MSRYRGPRFKKIRRLGALPGLTSKRPRSGSDLRNQSRSGKRSQYRIRLEEKQKLRFHYGLTERQLLRYVRIAGKAKGSTGQVLLQLLEMRLDNILFRLGMASTIPGARQLVNHRHILVNGRLVDIPSYRCKPGDFVTTREKERSRALIQNHMNSSPNEELPKHLTLYSLQYKGLVNQIIDSKWIGLKINELLVVEYYSRQT

SEQ ID NO: 2547 - protein, 203 aa, Lotus japonicus
LYVTLSRASFSKKIRRLGALPGLTSKRPTVGSELRNQSRSTKKSQYRIRLEEKQKLRFHYGLTERQLLKYVRIAGKAKGSTGQVLLQLLEMRLDNILFRLGMASTIPQARQLVNHRHVFVNGHIVDIPSYRCKPQDIITAKDNKKSKTLIQNSLESAPREELPTHLTLQPFQYKGLVNQIIDSKWVGLKINELLVVEYYSRQT

SEQ ID NO: 2548 - protein, 203 aa, Orobanche aegyptiaca
MSRYRGPRFKKIRRLGALPGLTNKRPKAEKDLINQSRFVKKSQYRIRLEEKQKLRFHYGLTERQLLKYIRIAGKAKGSTGQVLLQLLEMRLDNILFRLGMALTIPAARQLVNHRHVLVNGRIVDIPSYRCKPLDIITAKDKQQSRTLIQNSLNSSPHAKIPNHLTLDLFQYKGIVNQIINSKWVGLKINEFLIVEYYSRQIKT

SEQ ID NO: 2549 - protein, 201 aa, Phaseolus coccineus
MSRYRGPCFKKIRRLGYLPGLTSKKPKVKNELRNQLRFSKKSQYRIRLEEKQKLRFHYGLTERQLLKYVRISGKAKGSTGQVLLQLLEMRLDNILFRLGMAATIPQARQFINHRHVLVNGCIVDIPSYRCKPQDIITAKDEQKSKTLIQNYLDSAPRDKLPNHLTVHPFQYKGLINQIIDNKWVGLKINELLVVEYYSRQT

SEQ ID NO: 2550 - protein, 62 aa, Cajanus cajan
MNKKSKTLIQNYLDSAPRDKLPNHLTLHPFQYKGLINQIIDNKWVGLKINELLVVEYYSRQT

SEQ ID NO: 2551 - protein, 185 aa, Glycine max
MSRYRGPRFKKIRRLGSLPGLTSKRPTVKSELRNQSHSSKKSQYHIRLEEKQKLHFHYGLIERQLLKYVCIVGKAKGSIGQVLLQLLEMRLDNILFRLGMAATIPQARQLVNHKHVLVNGHIVDIPSYRCKPQDIIIAKDEQKSKTLIQNYLDSAPREKLPNHLTLHPFQYKGLINQIIDNKWVG

SEQ ID NO: 2552 - protein, 149 aa, Helianthus annuus
MPRYREIPRFKKIRRLGALPGLTNKRPRAGSDLRNQSRSGKKSQYRIRLEEKQKLRFHYGLTERQLLKYVRIAGKAKGSTGQVLLQLLEMRLDNILFRLGMAPTIPGARQLVNHKHVLVNGRILYIPSYGCKPRDTIAARDEQKPKALT

SEQ ID NO: 2553 - protein, 204 aa, Mesembryanthemum crystallinum
RSLYVALPGASFQKNTSSRSLPGLTNKRPRAGSDLRNQSRSGKRSQYRIRLEEKQKLRFHYGITERQLLKYVRIARKAKGSTGQVLLQLLEMRLDNILFRLGMAPTIPGARQLVNHRHILVNGRIVDIPSYRCKPQDTVMARDEQKSRALIQNYLDSSPREELPKHLILHPFPYKGLVNQIIDSKWIGLKINELLVVEYYSRQT

SEQ ID NO: 2554 - protein, 201 aa, Zostera marina
MSRYRGPRFKKIRRLGTLPGLTSKRPRSGSDLKNQSRSGKRSQYRIRLEEKQKLRFHYGLTERQLLRYVHIARKAKGSTGQVLLQLLEMRLDNIIFRLGMASTVPGARQLVNHRHILVNGHIVDIPSYRCKPQDIITTKDKQRSKALVQNYIDSFSRQELPQHLTVDSSQHKGFINKVIDSKSVGLKINELLVVEYYSRQI

SEQ ID NO: 2555 - protein, 185 aa, Lotus japonicus
MSRYRGPRFKKIRRLGALPGLTSKRPTVGSELRNQSRSTKKSQYRIRLEEKQKLRFHYGLTERQLLKYVRIAGKAKGSTGQVLLQLLEMRLDNILFRLGMASTIPQARQLVNHRHVFVNGHIVDIPSYRCKPQDIITAKDNKKSKTLIQNSLESAPREELPTHLTLQPFQYKGLVNQIIDSKWVG

SEQ ID NO: 2556 - protein, 189 aa, Nuphar advena
MSRYRGPRFKKIRRLGALPGLTSKKPRSASDLRNQSRSGKRSQYRIRLEEKQKLRFHYGLTERQLLRYVRIAGKANGSTGQVLLQLLEMRLDNILFRLGMASTIPGARQLVNHGHILVNGRLVDIPSYRCKPRDIITTKDKQRSRALIQNHMDSSSNAELPKHLTLHSLQYKGVVNQIIDSKWVGLKIN

SEQ ID NO: 2557 - protein, 113 aa, Lotus japonicus
MRLDNILFRLGMASTIPQARQLVNHRHVFVNGHIVDIPSYRCKPQDIITAKDNKKSKTLIQNSLESAPREELPTHLTLQPFQYKGLVNQIIDSKWVGLKINELLVVEYYSRQT

SEQ ID NO: 2558 - protein, 113 aa, Solanum phureja
MRLDYIIFRLGMASTIPAARQLVNHRHILVNGHIVDILSYRCKPRYIITAKDEQKSRALIQISLDSSPHEELPNHLTLQPFQYKGLVNQIIDSKWVGLKINELLVVEYYSRQT

SEQ ID NO: 2559 - protein, 111 aa, Brassica oleracea
MSRYRGPRFKKIRRLGALPGLTSKRPRAGSDLRNQSRSGKKSQYRIRLEEKQKLRFHYGLTERQLLKYVRIAGKAKGSTGQVLLQLLEMRLDNILFRLGMALTIPQARQLG

SEQ ID NO: 2560 - protein, 298 aa, Saccharum officinarum
MRCAAAALAFALIAAVAGATAAGSPAAGTCARRGAPPFLDAVGSRCPFVRIEPSPPLEVRGEAVDTELNLRRRGASYSILFYAAWCPFSSKFRPTFEALSTMYPQIHHFAVEESSATPSLFSRYGVRGFPAILFVNETTMVRYRGSKDLNSLVDFYKETTGLDPIAYIDVVQQESTGSLSSVMPWDHSLREMAKDELYLLVAVLFIILKVAANFIPVVMSHLRAFLVVRVQNLNLGIRRGSNQLLERALNVLDMRRLWSKLRLSNKATDLRKGASNARAWASSFASVSLGEPSSSRQA

SEQ ID NO: 2561 - protein, 299 aa, Zea mays
MMRCAAAALAVALIAAVAAATAAGSPAAGTCARRGAPPFLDAVGSRCPFVRIDPSPPLEVRGETVDTELNLRRRGASYSILFYAAWCPFSSKLRPIFGTLSTMYPQIHHFTVEESSATPSLFSRYGVRGFPAILLVNETTMVRYRGSKDLNSLVDFYKETTGLDPIAYIDVVEQESTGSLSSVMPWDRSIREMAKDEMYLLVAVLFIIVKVVAHFIPVVMSHLRAFLVVRVQNLNLGIRRGSNQLLERALNVLDVRRLWSKLRLSNKATDLRKGANNARAWASSFPSVSLGEPSSSRQA

SEQ ID NO: 2562 - protein, 300 aa, Zea mays
MRCAAAALAVALIAVVAGATAPGSPAAGTCARRGALPFLDAVGSRCPFVRIEPSPPLEVRGEAVDTELNLRRRGASYSILFYAAWCPFSSKFRPIFETVSTMYPQVHHFAVEESSATPSLFSRYGVRGFPAILLVNETTMVRYRGSKDLNSLVDFYKETTGLDPVAYIDVVVQQESTASLSSVAPWDRSPLEMAKDEPPYLLVAVLFIILKAAARLVPAAMSHLRAFLAVRVQNLNLGIRRGSSQVLERALNALDVRRLCSKLGLSNRATDLRKGASNARAWASSFASVSLGEPSSSRQA

SEQ ID NO: 2563 - protein, 303 aa, Pennisetum glaucum
MMRCAAAAAVAVAVALAAVAGSAVAAESRGPAGTCARRDAPPFLDAVGSRCPFVRIEPSPPLEVSGEAVDTELNLRRRGASYSILFYAAWCPFSSKFLPIFEALSTMYPQIQHFAVEESSATPSLFSRYGVRGFPAILLVNETTMVRYRGSKDLISLVDFYKETTGLDPIAHLDVVQQESSGNLRSIMPWDRSLREMAKDEPFLLLAALFIIMKVVAYFIPVVLSHLRAFLVVRVRNLNLGIRRGSNQLLDRVLNVLDVRRLWSKLRLSNKATDLRKGASNARAWASSFTSVSLGEPSSSRQA

SEQ ID NO: 2564 - protein, 276 aa, Setaria italica
GQGAAGTCARRDAPPFLDAVGSRCPFVRIEPSPPLEVSGEAVDTELNLRRRGASYSILFYAAWCPFSSKFRPIFEALSTMYPQIHHFAVEESSATPSLFSRYGVRGFPAVLLVNETTMVRYRGSKDLSSLVNFYKETTGLDPIAHLDVVQQESTGSLRSIMPWDRSLREMAKHEPFLLLAALFIIMKVVSYFIPVVLSHLRAFLVVRVRNLNLGIRRGSNQLLDRALNVLDVRRLWSKLRLSNKATDLRKGASNARAWASSFTSVSLGEPSSSRQA

SEQ ID NO: 2565 - protein, 95 aa, Panicum virgatum
MPRIPLIKFPKRNLKAPSPSVPAASQPADQHATLMSRLGAKAEAPSSGEIKNYRFRSDVPSPPSHTAVGGPASLLPKRKPLTEEEIEAIMLGGSI

SEQ ID NO: 2566 - protein, 95 aa, Setaria italica
MPRIPLIKFPKRNLKAPSPSAPAASQPADQHATLMSRLGAKVEAPPSGEIKNYRFRSDVPSPPSHTAVGGPASLLPKRKPLTEEEIEAIMLGGSI

SEQ ID NO: 2567 - protein, 95 aa, Pennisetum glaucum
MPRIPLIKFPKRNLKVPSPSAPAASQPADQHATLMSRLGAKVEAPPSGEIKNYRFKSDVPSPPSHTAVGGPASLLPKRKPLTEEEIEAIMLGGTI

SEQ ID NO: 2568 - protein, 93 aa, Sorghum bicolor
MPRIPLIKFPKRNLKAPSAPAPSQPADQHATLMSRLGAKAEAPSSGGIKNYRFRSDVPSPPSHTAVGGPASLLPKRKPLTEEEIEAIMLGGSI

SEQ ID NO: 2569 - protein, 93 aa, Saccharum officinarum
MPRIPLIKFPKRNLKVPSAPAPSQPADQHATLMSRLGAKAEAPSSGGIKNYRFRSDVPSPPSHTAVGGPASLLPKRKPLTEEEIEAIMLGGSI

SEQ ID NO: 2570 - protein, 95 aa, Cenchrus ciliaris
  misc_feature (35)..(35): Xaa can be any naturally occurring amino acid
  misc_feature (45)..(45): Xaa can be any naturally occurring amino acid
MPRIPLIKFPKRNLKVPSPSAPAASQPADQHATLXSRLGAKIEAXPSGEIKNYRFKSDVPSPPSHTAVGGPASLLPKRKPLTEEEIEAIMLGGTI

SEQ ID NO: 2571 - protein, 95 aa, Zea mays
MPRIPLIRFPKRNLKAPSPSAPAASQPADQHATLMFRLGAKAEAPSSGEIKNYRFRSDVPCPPSHTAVGGPASLLPKRKPLTEEEIEAIMLGGSI

SEQ ID NO: 2572 - protein, 93 aa, Zea mays
MPRIPLIKFPKRNLKAPSAPVPSQPADQHATLMSRLGAKAEAPSSGGIKNYRFSSDVPSPPSHTAVGGPASLLPKRKPLTEEEIEAIMLGGSI

SEQ ID NO: 2573 - protein, 92 aa, Triticum aestivum
MPRIPMIRFPKRHLKVPSPPAAQPADQHATLMSRLGAKVEAPSSGEKKNYRFRSDVPSAPSHNAVGGPASQLPKRKPLSEEEIEAIMQGGVF

SEQ ID NO: 2574 - protein, 97 aa, Cynodon dactylon
MPRIPMIKFPKRNLKVPSPSPSTPAASQPADQHATLMSRLGAKVEAPPAGEVKNYRFRSDVPSPPSHTAVGGPASLLPKRKPLTEEEIEAIMLGGSI

SEQ ID NO: 2575 - protein, 88 aa, Zea mays
MPRIPLIKFPKRNLKAPSAPVPSQPADQHATLMSRLGAKAEAPSSGGIKNYRFSSDVPSPPSHTAVGGPASLLPKRKPLTEEEIEAIM

SEQ ID NO: 2576 - protein, 93 aa, Zea mays
MPRIPLIKFPKRNLKAPSAPVPSQPADQHATLMSRLGAKAEAPSSGGIKNYRFSSDVPSPPSHTAVGGPASLLPKRKPLTEEEIEAIMVCLLF

SEQ ID NO: 2577 - protein, 92 aa, Triticum aestivum
MPRIPMIRFPKRHLKVPSPAAAQPADQHATLMSRLGAKVEAPSSGEKKNYRFRSDVPSAPSHNAVGGPASQLPKRKPLSEEEIEAIMQGGVF

SEQ ID NO: 2578 - protein, 262 aa, Triticum aestivum
MPLLQLPTACGAAAASASAPGPFLLSRPPPSRLRASHVLFAFPRLRKYGRRSREPVPTTLDDDDEDEADEDDDDDVEEAVDEDIFLKNRPKPAGFGVGKTYTTDVEEQLLREMGIGGAGRKSKSAAPKNLKANGSDTETGADRSNDGVHVRIWNLPKKKNIHKDLNLAFKGFPGLVTINPANSGTKKTRDPICKGFAFVKLESVDAATRFVELYSRKAVSFGKVEKPIKCCIVEGHVSTDPSGPASSSQPPGSNPQRLVAVR

SEQ ID NO: 2579 - protein, 262 aa, Triticum aestivum
EFGTRLQLPTACGAAAASSAPGPFSLSRPPPSRLRASHVLFAFPRLRKYGRRNREPVPTTLDDDEDEADEDDDDDVEEAVDEDIFLKNRPKPAGFGVGKTYTTDVEEQLLREMGIGGAGRKSKSAAPKNLKANGSDTETGADRSNDGVHVRIWNLPKKKNIHKDLNLAFKGFPGLVTINPANSGTKKTRDPICKGFAFVKLESVDAATRFVELYSRKAVSFGKVEKPIKCCIVEGHVSTDPSGPASSSQPPGSNPQRLVAVR

SEQ ID NO: 2580 - protein, 262 aa, Pseudoroegneria spicata
  misc_feature (30)..(30): Xaa can be any naturally occurring amino acid
  misc_feature (206)..(206): Xaa can be any naturally occurring amino acid
PLLQLPSACCAAAASASASGPLSFSRTPPXRLRASHILFAFPRLRKYGRRNREPVPTTLDDEEEEADEDEDDDDDVEEAVDEDIFLKNRPKPAGFGVGKTYTTDVEEQLLREMGIGGAGRKSKSAPPKNSKTNGSSTETGAGLSNDGVHVRIWNLPKKKNIHKDLNLAFKGFPGLVTINPANSGTKKTRDPICKGFAFIKLESVDXATRFVELYSRKAVSFGKVEKPIKCCIVEGHVSTDPSAPASSSQPPGSNPQRLVAVR

SEQ ID NO: 2581 - protein, 227 aa, Leymus cinereus x Leymus triticoides
  misc_feature (12)..(12): Xaa can be any naturally occurring amino acid
ASHILFAFPRLXKYGRRNREPVPTTFDEEEEEADEDDDDDVEEAVDEDIFLKNRPKPAGFGVGKTYTTDVEEQLLREMGLGGAGRKSKSAPPKNVKTNGSATETGADLTKDGVHVRIWNLPKKKNIHKDLNLAFKGFPGLVTINPANSGTKKTRDPVCKGFAFVKLESVDAATRFVELYSRKAVSFGKVEKPIKCCIVEGHVSTNPSSQASSSQAPGSNPQRLVAVR

SEQ ID NO: 2582 - protein, 300 aa, Arabidopsis lyrata
MDSRVSILFVCAIAVSCFTSGSASSRVDFSVCNYEFEVFRFDLEAKCPPSLYPSPPIEVDGDSLDRVMDSNHGNAYMSVLFYASWCPFSRAVRPKFDMLSSMFPHIQHLAVEHSQALPSVFSRYGIHSLPSILMVNQTLKARYHGRKDLTSLIEFYEEATGLQPVHYVAEGEPTGLDAGDGNLITWLRNGTSIREIFKQDPFLVLSLLFICLQMAILVFPIAESRMKALWASYVPNLNLGRFGEISQLFSRGIHMVDVRRLWLKLSLVKTRNFHERAKNAQAWASSLASVSLGQTSSDQS

SEQ ID NO: 2583 - protein, 302 aa, Raphanus sativus
MDLHVPILLFCVIAVSCFPSGLASSPVDFSVCNHEFKLFRFDLHSKCPLSLHPSPPIKVDGDSLDRLMALNHDGNAFMSVLFYASWCPFSRAVRPKFDMLSSMFPQIQHLSVEHSQALPSVFSRYGIHSLPSILMVNQTFKARYRGRKDLTSLIEFYEESTGLKPVQYVAEAEPATTLDATDDNLITWLRNGASISEIFKRDPFLVLSLLFLCLRMAILVFPIAKSRMKALWASYVPNLNLERFGEVSQVFSRALHMVDVRRLWLKLRLVKTRNFHERAKNAQAWASSLASVSLGQTSSEQS

SEQ ID NO: 2584 - protein, 303 aa, Brassica napus
MDLHLPILLLCVIAASCFPSRLASSPVDSSICNHEFELFRFDLASKCPPSLRPSPPIEVDGDSLDRLMALSHGDGDAYMAVLFYASSCPFSRGVRTKFDMLSLMFPQIQHFAIEHSQALPSVFSRYGIHSLPSILMVNQTLKARYHGRKDLTSLIEFYEESTGLKPVQYVAEGEPATSLDAADGNLITWLRNGTSISEIFKRDPFLVLSLLVICLQMAILVFPIAESRMKALWASYAPNLNLERFGEVSQVFSRALHMVDVRRLWLKLRLVKTRSFHERAKNAQAWASSLASVSLGQTSSDQS

SEQ ID NO: 2585 - protein, 868 aa, Sorghum bicolor
MCHQCQRNDNGRVVRCQGCVKEKRKYRYCVKCINRWYPHLSEDDFANNCPVCQKNCNCKACLRGDITRTNAKVTEGYSVSEQDKIQFSMRIVRFLLPWLKEFHQEQMQEKSAEAATKGIDAGKLEVPLTICGKNERIYCDNCRTSIVDFHRTCNKCNYDLCLRCCRELRRGLVPGNGVKVDGGGKEDLQLGVSHDKIVSKGPSDGQNGMLIDSVVPADKSTSSLREWSVNNDGTIPCPPNAFGGCGSSLLELKCLFEETFIAELLEKANSAVNNGMEVKMEGSKCSCFTESGDIDDGISRKTACRENSCDNYIYCPTATDVQNGSLDHFQEHWLKGEPVIVRDTLALTSGLSWEPMVMWRALREKRDKVERLSVLALECLGWCEVDVNIHMFFAGYSRGLVGPDDLPLLLKLKDWPPHSSFEERLPRHGAEFMSALPFREYTDPKCGPLNLAVKLPKGVNKPDLGPKTYIAYGVSKELGIGDSVTKLHCDMSDAVNILTHTDEIKLKAKRIAAVEKKKQCLEMKSLSTKEASGDLQWHADFASIPAVLSESNKEPRPEEFGNELGIKQPVQHVASEEQEGVQDDAKADANDMNVSFDKGKSEDSFGTINGRKNAGDGVNSGDKIESPSGLAERTLAKPTTKGCSKQRGRDSSNARGNRNKRTEEENVPGLITVAPESEDETPFVDGNQAEGGALWDIFRREDVSKLHDYLMKHADEFRHCNFETVKQVTHPIHDQCFYLTNEHKRKLKEEYGIEPWTFEQKLGEAVFIPAGCPHQVRNLKSCIKVALDFVSPENVRECIRLTEQFRLLPKWHRVNEDKLEVKKIALHALNQAIKDISDESSNSNESSPNNDVKDEPSSSESAEIEQGE

SEQ ID NO: 2586 - protein, 192 aa, Arabidopsis lyrata
MSEEMVKDEAMQIMGMFQILPRLVVFDLDYTLWPFYCECRSKREMPSMYPQAKGILSALKEKGIEMAIASRSPTSDIANTFLDKLNIKPMFVAKEIYSSWSHKTEHFQKIHTRTGVPFTAMLFFDDEDRNIKSVSKMGVTSILVGDGVTLGAFRQGLTEFTQNHNSIEKNKQVWRDKYSGKPTSSESETDKD

SEQ ID NO: 2587 - protein, 190 aa, Thellungiella halophila
MTEEKVKDEAMQIIGMFQILPRLVVFDLDYTLWPFYCECRSKREMPSLYPQAKGILSALKEKGIEMAIASRSPTSDIANTFIDKLNIKSMFVAKEIFSSWTHKTEHFQKIHTRTTVPFTAMLFFDDEDRNIKSVSKMGVTSILVGNGVTLGALRQGLTEFSQNHNTIEKNKHVWRNKYSGKAASSETDKD

SEQ ID NO: 2588 - protein, 190 aa, Raphanus sativus
MADEKVRDEAMQIIGMFQILPRLVVFDLDYTLWPFYCECRSKREMPSLYPQAKGIVSALKEKGIQMAIASRSPTSDIANTFIDKLNIKSMFVAKEIFSSWSHKTEHFQKIHTRTGVPFTDMLFFDDEDRNIKSVSKMGVTSILVGDGVTLGALRQGLTEFSHNHNTIEKNKQVWRNKYSGKSASSETDKD

SEQ ID NO: 2589 - protein, 190 aa, Raphanus sativus
MADEKVRDEAMQIIGMFQILPRLVVFDLDYTLWPFYCECRSKREMPSLYPQAKGIVSALKEKGIQMAIASRSPTSDIANTFIDKLNIKSMFVAKEIFSSWTHKTEHFQKIHTRTGVPFTDMLFFDDEDRNIKSVSKMGVTSILVGDGVTLGALRQGLTEFSQNHNTIEKNKQVWRNKYSGKAASSETDKD

SEQ ID NO: 2590 - protein, 190 aa, Brassica napus
MADDKVRDEAMQIIGMFQILPRLVVFDLDYTLWPFYCECRSKREMPSLYPQAKGIMSGLKEKGIQMAIASRSPTSDIANTFIDKLNIKSLFVAKEIFSSWSHKTEHFQKIHTRTGVPFTDMLFFDDEDRNIKSVSKMGVTSILVGDGVTLGALRQGLTEFSQNHNTIEKNKKVWRNKYSGKAASSETEKD

SEQ ID NO: 2591 - protein, 190 aa, Unknown
  Sequence found in Organisms: Brassica napus, Brassica oleracea
MADDKVRDEAMQIIGMFQILPRLVVFDLDYTLWPFYCECRPKREMPSLYPQAKGIMSGLKEKGIQMAIASRSPTSDIANTFIDKLNIKSLFVAKEIFSSWTHKTEHFQKIHTRTGVPFTDMLFFDDEDRNIKSVSKMGVTSILVGDGVTLGALRQGLTEFSQNHNTIEKNKKVWRNKYSGKAPSSETDKD

SEQ ID NO: 2592 - protein, 189 aa, Cleome spinosa
MAEEKVRDEAMQMMGMFQVLPRLVVFDLDYTLWPFYCECRSKREMPSLYPNAKGILKALQEKGIDMAIASRSPTADIANTFLDKLNIKPMFITKEIFSSWSHKTEHFQRIHARTSVPFTSMLFFDDEDRNIKSVSKMGVTSILVGNGVTLGAFRQGLTEFAQNQNNIEKNKQRWRKFSGKSSSEIDDED

SEQ ID NO: 2593 - protein, 671 aa, Sorghum bicolor
MQPIRRRHRGFPLLCLSAALLAAATLLPGAAVAEGVTPSEARRLRDEVKDMFYHAFDGYMKYAFPLDELRPLSCQGEDSLGGYALTLIDSLDTLALLGDKEKFGAAVEWVGKNVRFDINKTVSVFETNIRILGGLLSAHLIASDYATGMRIQSYDDQLLHLAADLAQRLLPAFDTPTGIPFGSVNLMYGVDENESKITSTAGGGTLTLEFGILSRLTNNTVFERVTKKSVRGIWSRRSKLNLVGAHINVFTGEWTQKDAGIGTSIDSFYEYLLKARKTTMFIIFGAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDHRYLDVGRDILASLQYGARCPCGYCHIADVETHKQDDHMESFFLAETVKYLWLLFDLAAGPDNIVESGPYKYIFSTEGHLLPVTPEIALVDEHCSYFGAFCNGGADHGYGASASSTKHQNGNYTQLDDIQTHSSLYSTSNVLFKTGGYIKGVCPGLTHAQKLGISYSDGEDNFIEQTSESREHHGESAVESSIQDQSSSIILISHPVTSQQDEALESGSGSQDHGNIVVTSDSDSDSDSTSRDNIVGANTEELMEDIEGTSGQDKR

SEQ ID NO: 2594 - protein, 88 aa, Setaria italica
MVLDALVATVETHKQDDHMESFFLAETVKYLWLLFDLAAGPDNIVENGPYKYIFSTEGHLLPVTPEIVLVDEHCSYFGAFCNGGADRC

SEQ ID NO: 2595 - protein, 875 aa, Brachypodium distachyon
MTTNKNSTDNTYKRICEYTNTRSGTLNSRGLKISGSAATSVEAPPQQRKNQGTFIRDGIAISAIVLSIRTKQLKYANTLNNVRRNRGFPPPPHAKTAAGGEGNANLNGDGGGTALVETTEAIDLSKLCRLFGKIDGYRALYRRSFIGFSLCGETRLLESCLYAGAWKQEIWNPFDPIPASRLPHTPGLSGSSQLRAPDPNTMRLRRQGSPLLCLSAALLAVALLTGAAVADGVTPSEARRLRDEVKDMFYHAFDGYMQHAFPLDELRPLSCKGEDSLGGYALTLIDSLDTLALLGDKEKFGAGVEWVGKNVRFDINKTVSVFETNIRILGGLLSAHLIASDYATGMRIQSYDDQLLHLAVDLAQRLLPAFDTPTGIPFGSVNLLYGVDDDESKASFFSGGGTLALEFGILSRLTNNTVFEEVTKNAVRGIWSRRSKLNLVGAHINVFTGEWTQKDAGIGTSIDSFYEYLLKAYLLFGDEEYLYIFQEAYKAAMHYLHLDPWYVEVNMNTGVTVWPLFNSLQAFWPGLQVLAGDVDPAIRTHAAFFSVWKKYGFTPEGFNLATSTVQNGQRSYPLRPELIESTYWLFKATRDYKYLDVGRDILASLQYGARCPCGYCHISDVETHKQDDHMESFFLAETVKYLWLLFDLAVGPDNIVENGPYKYIFSTEGHLLPATPEIALVDEHCSYFGAFCNGSTDRGYSKSDSSSKHQSANNTQFDDRQTASSKYSMSNVLFTTRGYIKGVCPGLTHAQKLGISFYDEGDNSVEQNSKSPENPDESHVVESSVHAQSSAVILMSHHVTSQPDEPLKTKLINWHHETIVVTADSDPMRTDATGGLSEGSTEELSEETISISEQTEVTEEDIASQDIQPNEDSTS

SEQ ID NO: 2596 - protein, 149 aa, Saccharum officinarum
SPPVSPHFVHGLQSRERRKKSRRRRPMCCYVGKATKIFLCLVAALLVAGLVLGFGLARHTWGADRAQQQQQPDCRWPDCQQQEGSAYGGDPLLPATATTPTNPLTQPAVAVFPGATPSSSAGAAAPPTGVPYFGPPGPFVVGLGPAAHA

SEQ ID NO: 2597 - protein, 158 aa, Pseudoroegneria spicata
MEGEKNSSGDLMSSSKLVAEAAKTAYEKKSVEGIDKEKVAAASAEILDSAAKYGKLEDKPVGQYLEKAEGYLKQYSSGGTEKEKTDAPAAADAPKPDAPKEPAPASAPAAEEEKSSDGFGLDDVMKGAASLSGKKSGEEEKESGGGGGFMKMAQGFMK

SEQ ID NO: 2598 - protein, 158 aa, Triticum aestivum
MEGEKNSSGDLMSSSKLVAEAAKTAYEKKSVEGIDKEKVAAASADILDSAAKYGKLEDKPVGQYLEKAEGYLKQYSSGGTEKEKTDAPAAADAPKPDAPKEPAPAPAPAAEEEKASGGFGLDDVMKGAASLSGKKSGEDEKESGGGGGFMKMAQGFMK

SEQ ID NO: 2599 - protein, 156 aa, Setaria italica
MEGEKNSSGDLMSSSKLVAEAAKTAYEKKSVEGIDKEKVAGASAEMLDSAAKYGKLEDKPVGQYLEKAEGYLKQYSSGGTEKEKTDAPAAADAPKPDAPKEAAPAPAAEEEKASDGFGLDDVMKGAASLSGKKSGEEEKESGGGGGFMKMAQGFMK

SEQ ID NO: 2600 - protein, 156 aa, Triticum aestivum
MEGEKNSSGDLMSSSKLVAEAAKTAYEQKSVEGIDKEKVAGASAEMLDSAAKYGKLEDKPVGQYLEKAEGYLKQYSSGGTEKEKTDAPAAADAPKPDAPKEAAPAPAAEEEKASDGFGLDDVMKGAASLSGKKSGEEEKESGGGGGFMKMAQGFMK

SEQ ID NO: 2601 - protein, 156 aa, Triticum aestivum
MEGEKNSSGDLMSSSKLVAEAAKTAYEQKSVEGIDKEKVAGASAEMLDSAAKYGKLEDKPVGQYLEKAEGYLKQYSSGGTEKEKTDAPAAADAPKPDAPKEAAPAPAAEEEKASDGFGLDDVMKGAASLSGKKSDEEEKESGGGGGFMKMAQGFMK

SEQ ID NO: 2602 - protein, 157 aa, Hordeum vulgare
MEGEKNSSGDLMSSSKLVAEAARTAYEKKSVEGIDKEKVAAASADILDSAAKYGKLEDKPVGQYLEKAEEYLKQYSSGGAEKTDAPAAADAPKPDAPKEPAPAPAPAPAVEEEKSSDGFGLDDVMKGAASLSGKKGDGEEKESGGGGFMKMAQGFMK

SEQ ID NO: 2603 - protein, 114 aa, Triticum aestivum
MSRSNLIAEAPKTPYEKKSLEAIHKGKGSRRLPPTSWTPPPSTASWRTSRWASTSRRLRGTCNSTAPAAPRRRKPTHLLPLTHGSRMHPRRQRLRLPIPRRKRNRPMGSVSKTS

SEQ ID NO: 2604 - protein, 600 aa, Sorghum bicolor
MDRNNADGGLGRRKKGGFRTMPLILASEVCDRFATAGFSANLITYLTQQLHLPMVEASNTLTNFGGTSAFTPILGAFAADSFAGRFWTIIAGSVVYQFGMIGVVVSALLPSLRPPPCKPPATPCQRASGWQLALLYLSLLLTSLGSGGIRPCVVAFGADQFEQDSSGAAEAAAKAEAERKRRYFNLYFFTMGFAVLLALTVVVYIQENVGWGWGFGIPAIGMFISIVVFLAGYPLYVLLRPGGSPFTRLAQVVAAAFKKRNAAVPEDPGLLYQDKELDALISTNGRLLHTNQLTFFDRAAIVTPGDITPSGQPDLWRLSTVHRVEELKSILRLLPIWSAGIMLATAGSHNYTFTIMQARTMDRHLGPGHFQLPPATLTIFSTAAMLVTLAFYDRVFVPLARRVTGLPSGITYFQRMGIGLAISVLSVASAALVETKRRDAAARHGLLDSPAAVVPISVFWLVPQFAVHGIGDAFSSVAHMEFLYDQAPESMRSSAVALFWLAGSIGSYMGTVLVTAVQSATRGAWLQDNINKGRLDYYYWLVTCIMVLNFGYFLVCFYFYTMKPLEVAGDDNGGDHDKECELSSSSLRKNGGGGTGGGMV

SEQ ID NO: 2605 - protein, 123 aa, Triticum aestivum
MEIYGDLEAGCLSHSVSPIKPASPPRKAGPGRLFCDPCDDAGELLGHHHYLDICFSCRKLLAGNKDIFMYRGDTPFCSEECRQEQIEIDEAREKRSNQTGRAEEQRQRQQQKQSTPRIPVWAW

SEQ ID NO: 2606 - protein, 123 aa, Leymus cinereus x Leymus triticoides
MEIYGDLEAGCLSHSVSPIKPASSPRKAGPGRLFCDPCDDAGELLGHHHYLDICFSCRKLLAGNKDIFMYRGDMPFCSEECRQEQIEIDEAREKRSNQTGRAEEQRQRQQQKQSTPRIPVWAW

SEQ ID NO: 2607 - protein, 123 aa, Triticum aestivum
MEIYGDLEAGCLSHSVSPIKPASPPRKAGPGRLFCDPCDDSDQLLGHHHYLDICFSCRKLLAGNKDIFMYRGDTPFCSEECRQEQIEIDEAREKRSSQTGRAEEQRQRQQQKQSTPRIPVWAW

SEQ ID NO: 2608 - protein, 123 aa, Hordeum vulgare
MEIYGDLEAGCLSHSVSPIKPASSPRKPGPGRLFCDPCDDADELLGRHHYLDICFSCRKLLAENKDIFMYRGDTPFCSEECRQEQIEIDEAREKRSNQTGRAEEQRQRQQRKQSTPRIPVWAW

SEQ ID NO: 2609 - protein, 120 aa, Avena sativa
MEVYGDLEAGCLSYSASPVKPASSPRKPGRLFCDPCDDAEELHGHHHYLDICFSCRKLLAGNRDIFMYRGDMPFCSEECRQEQIEIDEAREKRSKQTGRAEEQQRQQQKQSPHRIPVWAW

SEQ ID NO: 2610 - protein, 120 aa, Avena sativa
MEVYGDLEAGCLSYSDSPVKPASSPRKPGRLFCDPCDDAEELHGHHHYLDICFSCRKLLSGNRDIFMYRGDMPFCSEECRQEQIEIDEAREKRSKQTGRAEEQQRQQQKQSPHRIPVWAW

SEQ ID NO: 2611 - protein, 122 aa, Avena sativa
MEVYGDLEAGCLSYSDSPVKPASSPRKPGRLFCDPCDDAEELHGHHHYLDICFSCRKLLSGNRDIFMYRGDMPFCSEECRQEQIEIDEAREKRSKQTGRAEEQQRQSQQQKQSPHRIPVWAW

SEQ ID NO: 2612 - protein, 120 aa, Brachypodium distachyon
MEVYGDLEAGCLSHSASPLKPASSSRKPVRLFCDPCDDTDDLLGHRHYLDICCSCRKLIAGNRDIFMYRGDMPFCSEECRQEQIEIDEAREKRSKQTGRAEEQRQRQQKQSPQRIPVWAW

SEQ ID NO: 2613 - protein, 173 aa, Saccharum officinarum
MGDERVKAEALQILGLFQVLPRLVVFDLDYTLWPFYCECRSKRDSPSLFRHARGIMYALKEKGIDMAIASRSPTPDIAKVFLDKLELQSMFVAQEIFSSWTHKTEHFQKIQRKTGIPYKSMLFFDDEDRNIDPVSNLGVTSVLVENGVNLDMFKLGLSNFATNYAASSRKEDK

SEQ ID NO: 2614 - protein, 173 aa, Panicum virgatum
MGDERVKAEALQILGLFQVLPRLVVFDLDYTLWPFYCECRSKRDSPSLFRHARGIMYALKEKGIDMAIASRSPTPDIAKVFIDKLELQSMFVAQEIFSSWTHKTEHFQKIQRKTGIPYKSMLFFDDEDRNIQTVSKMGVTSVLVENGVNLDMFKLGLSNFATNFAASSRKQDE

SEQ ID NO: 2615 - protein, 173 aa, Zea mays
MSDERVKAEALQILGLFQVLPRLVVFDLDYTLWPFYCECRSKRDSPSLFRHARGIMYALKEKGIDMAIASRSPTPDIAKVFLDKLEFQSMFVAQEIFSSWTHKTEHFQKIQRKTGIPYKSMLFFDDENRNIEAVSKMGVTSVLVENGVNLDMFKLGLSNFATNCAASSRKDDE

SEQ ID NO: 2616 - protein, 173 aa, Panicum virgatum
MGDERVKAEALQILGLFQVLPRLVVFDLDYTLWPFYCECRSKRDSPSLFRHARGIMYALKEKGVDMAIASRSPTPDIAKVFIDKLELQSMFVAQEIFSSWTHKTEHFQKIQRKTGIPYKSMLFFDDEDRNIKTVSKMGVTSVLVENGVNLDMFKLGLSNFASNFAASSRKQDE

SEQ ID NO: 2617 - protein, 173 aa, Pennisetum glaucum
MGDDRVKAEALQILGLFQVLPRLVVFDLDYTLWPFYCECRSKRDSPSLFRHARGIMYALKEKGVDMAIASRSPTPDIAKVFIDKLELQSMFVAQEIFSSWTHKTEHFQKIHRKTGIPYKSMLFFDDESRNIETVSKMGVTSVLVENGVNLDMFKLGLSNFASNFAASSRNQDE

SEQ ID NO: 2618 - protein, 173 aa, Oryza sativa
MGDERVKAEALQILGLFQALPRLVVFDLDYTLWPFYCECRSKRESPSLYRHAKGIMFALREKGIDMAIASRSPTPDIAKVFIDKLEIKSMFVAQEIFSSWTHKTEHFQKIQRKTGIPYKSMLFFDDEDRNIESISKMGVTSVLVENGVNLDMFKLGLSNFATNVAASSTSKDE

SEQ ID NO: 2619 - protein, 186 aa, Setaria italica
MGDERVKAEALQILGLFQVLPRLVVFDLDYTLWPFYCECRSKRDSPSLFRHARGIMYALKEKGIDMAIASRSPTPDIAKVFIDKLELQSMFVAQEIFSSWTHKTEHFQKIQRKTGIPYKSMLFFDDEDRNIETVSKMGVTSVLVENGVNLDMFKLGLSNFATNFAASSRNQDEKPQGESKAFKKEL

SEQ ID NO: 2620 - protein, 172 aa, Avena sativa
MGDERVKAEALQILGLFQVLPRLVVFDLDYTLWPFYCECRSKRESPSLYRHAKGIMCALKEKGVDMAIASRSPTSDIARVFIDKLELQPMFVAQEIYSSWTHKTEHFQKIQRKTGVPYKSMLFFDDEDRNIESVSKMGVTSVLVDNGVNLDMFKLGLSNFATAAAAAAPQDK

SEQ ID NO: 2621 - protein, 173 aa, Avena sativa
MGDERVKAEALQILGLFQVLPRLVVFDLDYTLWPFYCECRSKRESPSLYRHAKGIMCALKEKGVDMAIASRSPTSDIARVFIDKLELQPMFVAQEIYSSWTHKTEHFQKIQRKTGVPYKSMLFFDDEDRNIESVSKMGVTSVLVDNGVNLDMFKLGLSNFATAAAAAAAPQDK

SEQ ID NO: 2622 - protein, 176 aa, Triticum aestivum
MGDERVKAEALQILGLFQVLPRLVVFDLDYTLWPFYCECRSKRESPSLYRHAKGIICALKEKGVDMAIASRSPTSDIARVFIDKLELQPMFVAQEIFSSWTHKTEHFQKIHRKTGVPYKSMLFFDDEDRNIQSVSKMGVTSVLVNNGLNLDMFKLGLSNFATTVAASEPAPAPEDN

SEQ ID NO: 2623 - protein, 170 aa, Brachypodium distachyon
MGDERVKAEALQILGLFQVLPRLVVFDLDYTLWPFYCECRSKRESPSLYRHAKGIVCALKEKGVDMAIASRSPTPDIATAFIGKLELQPMFVTQEIFSSWTHKTEHFQKIQRKTGVPYKSMLFFDDEDRNIESVSKMGVTSVLVENGLNLDMFKLGLSNFASNVAATQDK

SEQ ID NO: 2624 - protein, 176 aa, Triticum aestivum
MGDERVKAEALQILGLFQVLPRLVVFDLDYTLWPFYCECRSKRESPSLYRHAKGIMCALKEKGVDMAIASRSPTSDIARVFIDKLELQPMFVAQEIFSSWTHKTEHFQKIHRKTGVPYKSMLFFDDEDRNIQSVSKMGVTSVLVNNGLNLDMFKLGLSNFATTVAAPEPTPAPEDK

SEQ ID NO: 2625 - protein, 176 aa, Triticum aestivum
MGDERVKAEALQILGLFQVLPRLVVFDLDYTLWPFYCECRSKRESPSLYRHAKGIMCALKEKGVDMAIASRSPTSDIARVFIDKLELQPMFVAQEIFSSWTHKTEHFQKIHRKTGVPYKSMLFFDDEDRNIQSVSKMGVTSVLVNNGLNLDMFKLGLSNFATTAAAPEPAPAPEDK

SEQ ID NO: 2626 - protein, 176 aa, Triticum aestivum
MGDERVKAEALQILGLFQVLPRLVVFDLDYTLWPFYCECRSKRESPSLYRHAKGIMCALKEKGVDMAIASRSPTSDIARVFIDKLELQPMFVAQEIFSSWTHKTEHFQKIHRKTGVPYKSMLFFDDEDRNIQSVSKMGVTSVLVNNGLNLDMFKLGLSNFATTVAAPEPAPAPEDK

SEQ ID NO: 2627 - protein, 174 aa, Hordeum vulgare
MGDERVKAEALQILGLFQVLPRLVVFDLDYTLWPFYCECRSKRESPSLYRHAKGIMCALKEKGVDMAIASRSPTSDIARAFIDKLELQPMFVAQEIFSSWTHKTEHFQKIHRKTGVPYKSMLFFDDENRNIQSVSKMGVTSVLVDNGLNLDMFKLGLSNFATTVVAPAPAPENK

SEQ ID NO: 2628 - protein, 165 aa, Triticum aestivum
MSRPSRSDAHLSPVDEAVRVDEVRGYYDGAAPKRHSKPSRSDHSAVYTDALAGPGADGSHPELDKFQDLEAHSEKLVCEGGKAGEEFVETEYYKDLGCVGKQHHTTGTGFIKVDRPAGASFELSEDPDATERHASSKGNPATNEWISSADTVYQEESDKPNRSDS

SEQ ID NO: 2629 - protein, 194 aa, Triticum aestivum
MSRPSRSDAHLSPVDEAVRVDEVRGYYDGAAPKRHSKPSRSDHSAVYTDALAGPGADGSHPELDKFQDLEAHSEKLVCEGGKAGEEFVETEYYKDLGCVGKQHHTAAELNRGRWTWCRLARASSRWTGPPAPRSSSPRTRMRRSAMLPPRETPPQTSGSRQLTRCIRRSQTSPTEATAEPGNGLHSTANMIRCV

SEQ ID NO: 2630 - protein, 161 aa, Avena sativa
MSRPSRSDAHLSPVDEAMRVAEVREYYDDAAPKRHTKPSRSEHSAVYTDDALVDSSHPELDKLHELEAHTEKLVCEGGKAGEEFVETEYYKDLGGVDKQHHTTGTGFIKMDKPTGASFELSEDPDASERHASCKGNPATNEWIPSADTVYEASDKPNRSDS

SEQ ID NO: 2631 - protein, 160 aa, Brachypodium distachyon
MSRPSRSDAHLSPVDEATRVAEVREYYDDAAPKRHTKPSRSEHSAVYADALADDSHPELDKLQQLEAHTGKLVCEGGKAGEEFVETEYYRDLGCVGKQHHTTGTGFIKMDKPTGASFELSDDPDATERHASCKGNPATNEWIPSADTVYLASDKPSRSDS

SEQ ID NO: 2632 - protein, 353 aa, Zea mays
MSPAAATTTFVAISIAVPNPTAPSRGRVRLPLGGVPAAPRRAVASMAVSAPRSGAATSFLERRESERALHFVKYQGLGNDFIMVDNRDSSVPKVTPEEAAKLCDRNFGIGADGVIFVMPGVNGADYTMRIFNSDGSEPEMCGNGVRCFARFIAEIENLQGTNRFTIHTGAGKIVPEIQSDGQVKVDMGEPILSGLDIPTKLLATKNKAVVQAELAVEGLTWHVTCVSMGNPHCVTFGANELKVLQVDDLKLSEIGPKFEHHEMFPARTNTEFVQVLSRSHLKMRVWERGAGATLACGTGACAVVVAAVLEGRAERKCVVDLPGGPLEIEWREDDNHVYMTGPAEVVFYGSVVH

SEQ ID NO: 2633 - protein, 352 aa, Zea mays
MSSAAATAFAGVSVATPNLTTPFRGRVRLPLRGVSAAPRRAVASMAVSAPRSGAAASFLERRESERALHFVKYQGLGNDFIMVDNRDSSVPKVTPEEAAKLCDRNFGIGADGVIFVMPGVNDADYTMRIFNSDGSEPEMCGNGVRCFARFIGELENLQGTHSFTIHTGAGKIIPEIQSDGQVKVDMGEPILSGADIPTKLVATKNKAVIQAELAVEGLTWHVTCVSMGNPHCVTFGANELKTLQIDDLKLSEIGPKFEHHEMFPARTNTEFVQVLSRSHLKMRVWERGAGATLACGTGACAVVVAAVLEGRAERKCVVDLPGGPLEIEWREDDNHVYMTGPAEAVFYGSVVH

SEQ ID NO: 2634 - protein, 352 aa, Panicum virgatum
MSPAAATTFFAAAATVAAPTAPFRACVLLPLRGGPGAPRRAVTSMAVSTPRSAAAASFLERRESERALHFVKYQGLGNDFIMVDNRDSSVPKVTPEEAAKLCDRNFGIGADGVIFVMPGSNGADYTMRIFNSDGSEPEMCGNGVRCFARFIAELENLQGTHSFTIHTGAGLIIPEIQSDGQVKVDMGEPILSGPEIPTKLLATKNKAVVQAELDVEGRTWHVTCVSMGNPHCVTFGAKDLKVLQVDDLKLSEIGPNFEHHEMFPARTNTEFVQVLSRSHLKMRVWERGAGATLACGTGACAVVVAAVLEGRAERKCIVDLPGGPLKIEWREDDNHVYMTGPAEAVFYGSVVH

SEQ ID NO: 2635 - protein, 106 aa, Zea mays
TAPSRGRVRLPLRGVPAAPHRVVASMAVSAPRSGAATSFLERRESERALHFVKYQGFGNDFIMVDNRDSSVPKVMPEEAAKLCDRNFGISADGSLSCRGSMVPTTP

SEQ ID NO: 2636 - protein, 338 aa, Pennisetum glaucum
ATVASLAAPSRGCVRLPVRGGPGAPRRAVASMAVSTPRSAAASFLERRESERALHFVKYQGLGNDFIMVDNRDSSVPKVTPEEAAKLCDRNFGIGADGVIFVMPGTNGADYTMRIFNSDGSEPEMCGNGVRCFARFIAELENLQGTHSFTIHTGAGLIIPEIQSDGQVKVDMGEPILSGPDIPTKLLATKNKAVVQAELEVEGSTWHVTCVSMGNPHCVTFGANDLKVLQVDDLKLSEIGPKFEHHEMFPARTNTEFVQVLSRSHLKMRVWERGAGATLACGTGACAVVVSAVLEGRAERKCVVDLPGGPLEIEWREDDNHVYMTGPAEAVFYGSVVH

SEQ ID NO: 2637 - protein, 355 aa, Brachypodium distachyon
MSPAAAAAAATAKSFAANFAASTAPSSRVRPNLSLRGTPAPRRAVASMAVSAPKSPAAASFLERRESERAIHFVKYQGLGNDFIMVDNRDSSVPKVTPEEAAKLCDRNFGIGADGVIFVMPGVNGADYTMRIFNSDGSEPEMCGNGVRCFARFIAELENLQGTHSFKIHTGAGLIIPEIQNDGKVKVDMGQPILNGPDVPTKLPSTKNEAVVQAELAIDGLVWHVTCVSMGNPHCVTFGAKELKVLHVDDLKLSDIGPKFEHHEMFPARTNTEFVQVLSRSHLKMRVWERGAGATLACGTGACAVVVAAILEGRAERKCVVDLPGGPLEIEWREDNNHVYMTGPAEAVFYGSVVH

SEQ ID NO: 2638 - protein, 352 aa, Avena sativa
MSPAAAARVTSFAATFSASTAPSSRGLLHRPFRGTPAHRRAVASMAVSAPRSSAAASFLERRESERALHFVKYQGLGNDFIMVDNRDSAEPKVTPEDAAKLCDRNFGIGADGVIFVMPGVNGADYTMRIFNSDGSEPEMCGNGVRCFARFIAEIENLKGTHSFKIHTGAGLIIPEIQNDGKVKVDMGQPILNGPDVPTKLPSTKNEAVVQAELAIDGLAWHVTCVSMGNPHCVTFGAKELKDLHVDDLKLSDIGPKFEHHEMFPARTNTEFVQVLSRSHLKMRVWERGAGATLACGTGACAVVVAAVLEGRAERKCVVELPGGPLEIEWREDNNHVYMTGPAEAVFYGSIVH

SEQ ID NO: 2639 - protein, 353 aa, Triticum aestivum
MSPAAAAARATSFAANFTTSTAPSSGGRLLRPFCGNPRPRRAVASMAVSAPKSPAAASFLERRESERALHFVKYQGLGNDFIMVDNRDSAVPKVTPEEAAKLCDRNFGIGADGVIFVLPGVNGADYTMRIFNSDGSEPEMCGNGVRCFARFIAEVENLQGTHSFKIHTGAGLIIPEIQDDGKVKVDMGEPILYGPDVPTKLPSTKNEAVVKAELAIDGLAWHVTCVSMGNPHCITFGSKELKVLHVDDLKLSDIGPKFEHHEMFPARTNTEFVEVLSRSHLKMRVWERGAGATLACGTGACAVVVAAVLEGRAERKCVVDLPGGPLEIEWREDNNHVYMTGPAEAVFYGSVVH

SEQ ID NO: 2640 - protein, 353 aa, Triticum aestivum
MSPAAAAARVTSFAANFTTSTAPSSGGRLLRPFCGNPRPRRAVASMAVSAPKSPAAASFLERRESERALHFVKYQGLGNDFIMVDNRDSAVPKVTPEEAAKLCDRNFGIGADGVIFVLPGVNGADYTMRIFNSDGSEPEMCGNGVRCFARFIAEVENLQGTHSFKIHTGAGLIIPEIQDDGKVKVDMGEPILYGPDVPTKLPSTKNEAVVKAELAIDGLAWHVTCVSMGNPHCITFGSKELKVLHVDDLKLSDIGPKFEHHEMFPARTNTEFVEVLSRSHLKMRVWERGAGATLACGTGACAVVVAAVLEGRAERKCVVDLPGGPLEIEWREDNNHVYMTGPAEAVFYGSVVH

SEQ ID NO: 2641 - protein, 354 aa, Oryza sativa
MSSATAAATATIAAAAAKLAATPAPAPSRRRLTLRGNPTARRCVAAMAVSTPRSAAAAAFLERRESERALHFVKYQGLGNDFIMVDNRDSAVPKVTPEEAAKLCDRNFGVGADGVIFVMPGVNGADYTMRIFNSDGSEPEMCGNGVRCFARFIAELENLQGTHSFKIHTGAGLIIPEIQNDGKVKVDMGQPILSGPDIPTKLPSTKNEAVVQADLAVDGSTWQVTCVSMGNPHCVTFGTKELKVLHVDDLKLSDIGPKFEHHEMFPARTNTEFVEVLSRSHLKMRVWERGAGATLACGTGACAVVVAAVLEGRAERKCVVDLPGGPLEIEWREDDNHIYMTGPAEAVFYGSAVH

SEQ ID NO: 2642 - protein, 351 aa, Hordeum vulgare
MSAAAARVTSNFTNFTTSTAPSSGGRLLRPFRGTPPSRRAVASMAVSTPRSPSAASFLERRESERALHFVKYQGLGNDFIMVDNRDSAVPKVTPEEAAKLCDRNFGVGADGVIFVMPGINGADYTMRIFNSDGSEPEMCGNGVRCFARFIAEVENLQGTHSFKIHTGAGLIIPEIQDDGKVKVDMGQPILHGPDVPTKLPSTRNEAVVQAELAIDGSTWHATCVSMGNPHCVTFGSKELKVLQVDDLKLSDIGPKFEHHEMFPARTNTEFVQVLSRSHLKMRVWERGAGATLACGTGACAVVVAAVLEGRAERKCIVDLPGGPLEIEWREDNNHVYMTGPAEAVFYGSIVH

SEQ ID NO: 2643 - protein, 161 aa, Leymus cinereus x Leymus triticoides
  misc_feature (12)..(13): Xaa can be any naturally occurring amino acid
EPLPALALVAMXXAAAAARVTSFAANFTTPTAPSSGGRVLRPFRRNPRPRRVVASMAVSAPKSPAAASFLERRESERALRFVKYQGLGNDFIMVDNRDSAVPKVTPEEAAKLCDRNFGVGADGVIFVMPGANGADYTMRIFNSDGSEPEMCGNGVRCFARL

SEQ ID NO: 2644 - protein, 336 aa, Pseudoroegneria spicata
TTSTAPSSGSRLLRPFRGNPRPRRAVASMAVSAPKSPAAASFLERRESERALHFVKYQGLGNDFIMVDNRDSAVPKVTPEEAAKLCDRNFGVGADGVIFVMPGVNGADYTMRIFNSDGSEPEMCGNGVRCFARFIAEVENLQGTHSFKIHTGAGLIIPEIQDDGKVKVDMGQPILYGPDVPTKLPSTMNEAVVKAELAIDGLAWHVTCVSMGNPHCITFGSKELKVLHVDDLKLSDIGPKFEHHEMFPARTNTEFVEVLSRSHLKMRVWERGAGATLACGTGACAVVVAAVLEGRAERKCVVDLPGGPLEIEWREDNNHVYMTGPAEAVFYGSVVH

SEQ ID NO: 2645 - protein, 105 aa, Triticum aestivum
MWASPGRLPAMEEEEEECEADAGRRAPMASCWGRFGLAALWHRLRHLFLARRRARHGRSILGAGGLNYDPLSYAQNFDDSSLELHEPDFTARFAPARNACSPRRA

SEQ ID NO: 2646 - protein, 104 aa, Hordeum vulgare
MWASPGRLPAMEEEEECEADAGHRAPMASCWGRFGLAALWHRLRHLFLARRRARHGRSILGAGGLNYDPLSYAQNFDDSSLEHHEPDFTARFAPARNASSPRPV

SEQ ID NO: 2647 - protein, 875 aa, Solanum phureja
MATPETTATPATPTENNEIVPKNEMIHEHGDEMVPQNEMIHEHSHEIVLENEMIHEHSHEIVPVNEMIHEHSHEIVPEKEMIHEHSHEIVPENEMIHEHSHETVPQNEMIHEHSHEMVPENEMTHEHSHAMVRENEMTHEHNHEMVPEHEMMHEHSHEMVPEHEMMHEHRHEMMPEHEMMHEHHMVLGNEIVPSNEMVPDDEMIPLNEMVLAEPQPNYIETPPNNPETQPSKRRKKKSIVWEHFTIENVGSGTRRAQCKQCKQSFAYSTGSKVAGTSHLKRHIAKGTCPVVLRNQQNNQLSPYSTPPKMSGYGGSTDAPKRRYRTASAPYLAFDPDRCRQEISKMIIMHDYPLHMVEHPGFLAFVQNLQPRFDMVSFNTVQGDCVATYLREKQAIQKVIEGVPGRICLTLDMWSSCYTVGYVFITGQYIDSEWKIHRKILNIIMEPYPDSETAFSHAVAACLSDWSMEGKLFSVTINQPLGDAAVDNLRALLSVKNPLVLNGQLLVGSCLARTLSSIAQGAFKLLQETVKKVRDSVKYVKTSEFHEEKFIELKQQLQVPSTKTLALDDQTQWNTTYEMLLAASELKEVFSCLDTSDPDYKDALTMEDWKQVEVLCTYLKILFDTANLLTAPTIPTTNTFFHEAWKIQLELARAAVSEDPSISSLTKTMQEEFDKYWKSCCLILAIAVVMDPRFKMKLVEFSFTKIYGEEAATYVKFVEEGIHELFLEYVALPLPLTPAYAEEVNDGTLKQENGGGGLTDFDAYIMETTSQQSRSELDQYLDESLLPRVHEFDVVGWWKLNRMKYPTLSKMARDILSVPVSTVTADSVFSTIGKEMDRYRCSLRPETVEALICAKDWLQNASVNTLHAPIKMEVPI

SEQ ID NO: 2648 - protein, 232 aa, Solanum phureja
MAGLTNLKLSLFPNSCSLSSSSSLSSNPFLVSTSIFRRTSHSFPKIFAFSSNDIKVGSNIEVDGSPCKVIEFLHVKPGKGAAFVRTTLRNYVTGNSVEKTFRAGSKIEEANIYKETKQFTYKDGAQYVFMDLTSYEEYRLNEKDVGDKAKFLKEGMDCTLLFWNGKVIDFELPITVKLTVVDVDPGVKGDTAQGGSKPATLDTGAIVSVPLFINRGEEIMVDTRNGQYMSRA

SEQ ID NO: 2649 - protein, 231 aa, Solanum tuberosum
AGLTNLKLSLFPNSCSLSSSSSLSSNPFLVSTSIFRRTSHSFPKIFAFSSNDIKVGSNIEVDGSPCKVIEFLHVKPGKGAAFVRTTLRNYVTGNSVEKTFRAGSKIEEANIYKETKQFTYKDGAQYVFMDLTSYEEYRLNEKDVGDKAKFLKEGMDCTLLFWNGKVIDFELPITVKLIVVDVDPGVKGDTAQGGSKPATLDTGAIVSVPLFINRGEEIMVDTRNGQYMSRA

SEQ ID NO: 2650 - protein, 207 aa, Capsicum annuum
MAGLPNLKLSLFPNSCSLSSSSSSLCSNPFIVSTSIFRRTPYRFPKFLHVKPGKGAAFVRTTLRNYITGNSVEKTFRAGSKIEEANIYKETKQFTYRDGAQYVFMDLITYEEYRLNEKEVGDKAKFLKEGMDCNLLFWNGKVIDFELPITVKLTVVDVDPGLKGDTAQGGSKPATLDTGAVVNVPLFINRGEEIMVDTRNGQYMSRA

SEQ ID NO: 2651 - protein, 106 aa, Nicotiana tabacum
  misc_feature (96)..(96): Xaa can be any naturally occurring amino acid
MDLTSYEEYRLNEKVVGDKAKFLKEGMDCSLLFWNGKVIDFELPITVKLTVVDVDPGLKGDTAQGGSKPATVDTGAVINVPLFIGRGEEILVDTRXGQYMSRAKEA

SEQ ID NO: 2652 - protein, 315 aa, Solanum phureja
MCSTKQNQKQNLHHKRSVVPTSTSAAGGEGGGGGDWREESITGGSLKHVDLDKGKNGWASPPGDLFNLRGPNYLTKKVKVPSGAWLLQPAGVDWLRSNSKLDHVLARHDNRVMNALKKSHSEGKSMKTFIVAVNLQVPGRDQHSAVFYFATNDDEPLEPGSLLYRFVNGDDAYRNSRFKIVNRIVKGPWIVKAAVGNYSACILGKALNCYYHRGPNYLEIDVDIGSSAIASAILHLALGSVTSVTIDMGFLVESQTEEELPEKLFGAVRICQMEMSSATFIDTTSSRKVLPTANLHNPSNSSRVQAEEVGENKDD

SEQ ID NO: 2653 - protein, 315 aa, Solanum tuberosum
MCSTKQKQKQNLHHKRSVVPTSTSAAGGEGGGGGGWREESITGGSLKHVDLDNGKNGWASPPGDLFNLRGPNYLTKKVKVPSGAWLLQPAGVDWLRSNSKLDHVLARHDNRVMNALKKSHSEGKSMKTFVVAVNLQVPGRDQHSAVFYFATNDDEPLEPGSLLYRFVNGDDAYRNSRFKIVNRIVKGPWIVKAAVGNYSACILGKALNCYYHRGPNYLEIDVDIGSSAIASAILHLALGSVTSVTIDMGFLVESQTEEELPEKLFGAVRICQMEMSSATFIDTMSSRKVLPTANLHNPSNSSRVQAEENGENKDD

SEQ ID NO: 2654 - protein, 699 aa, Sorghum bicolor
MNGGGGGRRRYSSEQLLFDVPTNAGAAARWAQQRGGVRRGDGEIFVSVEPATPARLRGGDAAAGDSPGQRQQLSPGLLDLHAFDTELIPDFQVPGMYDGAQKFGYGGGLDESDMRFTANKLMSKSTVFPDGNYLKAFTEKEKAAPVAKIKVVVRKRPLNKKEVSKKEEDIIDIEQNSLTVHETKLKVDLTEYVEKHEFVFDAVLDEDVSNDEVYRETVEPVVPAIFNRTKATCFAYGQTGSGKTYTMRPLPLKASQDILRLMHHTYRNQGFQLYVSFFEIYGGKLFDLLNDRSKLCMREDGKQKVCIVGLQEYRVSDVETIKELIEKGSATRSTGTTGANEESSRSHAILQLAIKCRVDGNDSKPPRPVGKLSFIDLAGSERGADTTDNDKQTRIEGAEINKSLLALKECIRALDNDQTHIPFRGSKLTEVLRDSFIGDSRTVMISCISPSSGSCEHTLNTLRYADRVKSLSKGSNAKKDVSLAVPMRESSPSPLTSVVPSFSASEVMNDITERSNFGWPKQQYVKEQPAPTFAERMPKVKDSVEFTSSYGAYSKQQRSKGFVAPNMAEVPDIMYQQGRQPTRKARDTTFGKDMRNSVTYPTRRVEPDEDEHLNNLLQEEEDLVSAHRKQVEETLDILKEEMNILGEADQPGFQLDDYLGRLSSILSQKAAGIVDLQARLEQFQRLLNENNVLLYDQSP

SEQ ID NO: 2655 - protein, 682 aa, Zea mays
MNGGSRRQRYSSEQLLFDVPANAGAGRWAQQRGGVRRGDGEIFVSVEPATPARLCGGDAAAGDSPGQRQQLSPGLLDLHAFDTELIPDFQVPGIYDGAQKFGYGGGLDESDMRFTSNKMMSKSTIFPDGNYLKAFTEKEKAAPVAKIKVVVRKRPLNKKEVSKKEEDIVDIEQRSNSLTVHETKLKVDLTEYVEKHEFVFDAVLDEDVSNDEVYRETVEPVVPAIFNRTKATCFAYGQTGSGKTYTMRPLPLKASQDVLRLMHHTYRNQGFQLYVSFFEIYGGKLFDLLNDRSKLCMREDGKQKVCIVGLQEYRVSDVETIKELIEKGSATRSTGTTGANEESSRSHAILQLAIKRRVDGNDSKPPRPVGKLSFIDLAGSERGADTTDNDKQTRIEGAEINKSLLALKECIRALDNDQTHIPFRGSKLTEVLRDSFIGDSRTVMISCISPSSGSCEHTLNTLRYADRVKSLSKGSNAKKDVSLAVPLRESNSSPLPSVVPSFSASEVMNDITGRSNFGWPKQQYVKEQPAPTFVERMPKAKDAVEFTSSNIAEVPDIMYQLGRQPSRKDVTLANNMRNSVAYPTRRVEPDDDDEHLNNLLQEEEELVSAHRKQVEETLDILKEEMNILGDADQPGFQLDDYITRLSSMLSQKAAVIVDLQARLEQFQRLLNENNVLLYAQSP

SEQ ID NO: 2656 - protein, 682 aa, Zea mays
MNGGSRRQRYSSEQLLFDVPANAGAGRWAQQRGGVRRGDGEIFVSVEPATPARLCGGDAAAGDSPGQRQQLSPGLLDLHAFDTELIPDFQVPGIYDGAQKFGYGGGLDESDMRFTSNKMMSKSTIFPDGNYLKAFTEKEKAAPVAKIKVVVRKRPLNKKEVSKKEEDIVDIEQRSNSLTVHETKLKVDLTEYVEKHEFVFDAVLDEDVSNDEVYRETVEPVVPAIFNRTKATCFAYGQTGSGKTYTMRPLPLKASQDVLRLMHHTYRNQGFQLYVSFFEIYGGKLFDLLNDRSKLCMREDGKQKVCIVGLQEYRVSDIETIKELIEKGSATRSTGTTGANEESSRSHAILQLAIKRRVDGNDSKPPRPVGKLSFIDLAGSERGADTTDNDKQTRIEGAEINKSLLALKECIRALDNDQTHIPFRGSKLTEVLRDSFIGDSRTVMISCISPSSGSCEHTLNTLRYADRVKSLSKGSNAKKDVSLAVPLRESNSSPLPSVVPSFSASEVMNDITGRSNFGWPKQQYVKEQPAPTFVERMPKAKDAVEFTSSNIAEVPDIMYQLGRQPSRKDVTLANNMRNSVAYPTRRVEPDDDDEHLNNLLQEEEELVSAHRKQVEETLDILKEEMNILGDADQPGFQLDDYITRLSSMLSQKAAVIVDLQARLEQFQRLLNENNVLLYAQSP

SEQ ID NO: 2657 - protein, 707 aa, Oryza sativa
MNGGGRRRYSSEQLMFDVPANAGGGAGKWGQRGGVRRGDGEIFVSVEPTTPARLRGGEAAAAAAGESPGQRQQLSPGLLDLHAFDTELISDFQVPGIGMYDGAQKFGYGNGGFDDSDPTFAPNKQMSKSTVFAESNFLKAFPEKEKAAPVAKIKVVVRKRPLNKKEISKKEEDIIDIEQQSNSLTVHETKLKVDLTEYVEKHEFVFDAVLDEDVSNDEVYRETVEPVVPAIFNRTKATCFAYGQTGSGKTYTMRPLPLKASQDILRLMHHTYRNQGYQLFVSFFEIYGGKLFDLLNERSKLCMREDGKQKVCIVGLQEYRVSDVETIKELIEKGNATRSTGTTGANEESSRSHAILQLAIKKRVDGNDSKPPRLAGKLSFIDLAGSERGADTTDNDKQTRIEGAEINKSLLALKECIRALDNDQTHIPFRGSKLTEVLRDSFIGDSRTVMISCISPSSGSCEHTLNTLRYADRVKSLSKGSNTKKDLSLAAAPLRESSPSLLASAVPSFSSAEVMNDITERSNFGWTKQQYVKEHQAPTFVDRMQKVKEDTEFSLSNGGYFKEQRTKGSVPVGIAEVPDTVYQQGRQPTRKARDLTSDNNMRNSIAYPIIRRVVPDEDEHLNELLQEEEDLVSAHRKQVEETLDMIKEEMNLLVEADQPGNQLDDYITRLSGILSQKAAGIVDLQARLAQFQRRLNENNVLLYAQCP

SEQ ID NO: 2658 - protein, 609 aa, Brachypodium distachyon
MYDGAQKFSSANGVGFDDSDVSFATNKQISKSTVFAESNYLTAFPEKEKVAPVAKIKVVVRKRPLNKKEISKREEDIIDIEQSSNSLTVHETKLKVDLTEYVEKHGFVFDAVLDEDVSNDEVYRETVEPVVPAIFNRTKATCFAYGQTGSGKTYTMRPLPLKASQDILRLMNHTYRNQGFQLFFSFFEIYGGKLFDLLNERNKLCMREDGKQKVCIVGLQEHRVSDLETIKELIERGNATRSTGTTGANEESSRSHAILQLAIKRRVDGNGSKPPRLAGKLSFIDLAGSERGADTTDNDKQTRIEGAEINKSLLALKECIRALDNDQTHIPFRGSKLTEVLRDSFIGDSRTVMISCISPSSGSCEHTLNTLRYADRVKSLSKGSNSKKDVPLASAPLRESSPSPLPSLVPSFSAAEVMNDITERNNFGWPKQQYAKEQPAPSFVDRMPKARENMEFSLSNGGYFNGQETKGASATGIAVVPDTMYQQGRQQARKGRDPASENNMRNSIAYPVRRAAVDEDDHLNDLLQEEEDLVSAHRKQVEETLDIIKEEMNLLVEADQPGNQLDDYVTRLSSILSQKAAGIVDLQDRLAQFQRRLSENNVLLCSESP

SEQ ID NO: 2659 - protein, 145 aa, Triticum aestivum
MALLLSPTVSFIAPSPSSAPRARALSSSTATAASNNAFPYLASRLQCKTGASVSHVSLAKKMPVVVHASAEAGATDTAEQPEKPKPAASIEDMPLESKQQMILEQRARMKVAKKLRQRRKRLVQKRRLRKKGRWPPSKMKKLKNV

SEQ ID NO: 2660 - protein, 142 aa, Triticum aestivum
MALLLSPTVSFLAPSSSSAPRARALSSSAANNNVVPYLASRLQCKTGASVSHVSLAKKMPVVVHASAEAGATDAAEQPEKPKPAASIEDMPLESKQQMILEQRARMKVAKKLRQRRKRLVQKRRLRKKGRWPPSKMKKLKNV

SEQ ID NO: 2661 - protein, 141 aa, Pseudoroegneria spicata
LSPTVSFLAPSSSSAPRARVLSSSTATAAINNVVPYLASRLQCKTTASVSHVSLAKKMPVVVHASAEAGATDAAEQPEKPKPAASIEDMPLESKQQMILEQRARMKVAKKLRQRRKRLVQKRRLRKKGRWPPSKMKKLKNV

SEQ ID NO: 2662 - protein, 151 aa, Hordeum vulgare
MALLLSPTVSFLAPSPSPSSSSAPRARALSSSTATATATSNNVAPYHASRLQCKTTASVSHVSRAKKVPVVVHASAEAGATDAAEQPEKPKPAASIEDMPLQSKQQMILEQRARMKVAKKLRQRRRRLVQKRRLRKKGSWPPSKMKKLKNV

SEQ ID NO: 2663 - protein, 142 aa, Avena sativa
MALLLSPTVSFLASSSASPPRVRALSNPSAANNAVPFSAPRLQCKNTASFSHVSLSKKMPVTVHASAEAGSTDAAEQPEKPKPAASVEDMPLESKQQMILEQRARMKVAKKLRQRRRRLVQKRRLRKKGRWPPSKMKKLKNV

SEQ ID NO: 2664 - protein, 134 aa, Triticum aestivum
  misc_feature (6)..(6): Xaa can be any naturally occurring amino acid
MAKLLXAGVAFLLALAAAAALAPSPASALKGAGGLGLGGAAAAVVMRRGGRTCRGTVGECMEYFGVDGEGESEVAAMAGKRRVLQDGSGYIGYDALRRDNVPCSQRGASYYNCQPGAEANPYSRGCSAITQCRG

SEQ ID NO: 2665 - protein, 137 aa, Hordeum vulgare
MAKLLPAAVAFLLALAAAAALAPSSASAFTTTVNGAGELGLGGAAAVVMRRGGRTCRGTVGECMEYFGVDGEGEGEVAAMAGKRRVLQGGSGYIGYDALRRDNVPCSERGASYYNCQPGAEANPYSRGCSAITQCRG

SEQ ID NO: 2666 - protein, 130 aa, Brachypodium distachyon
MAKLLAAILFLAAALLAALAPSSSSAATAMGSGGGVAAAVVLRRGGRTCRGTVGECMEFFGVDGEGEEEVAAMAGKRRVLQDGSGYIGYDALKRDSVPCSQRGASYYNCQPGAEANPYSRGCSAITQCRG

SEQ ID NO: 2667 - protein, 117 aa, Triticum aestivum
MAKLLPAGLAFLLALAAAAALAPSPASASALKGAGGLGLGGAAAVVMRRGGRTCRGTVGECMEYFGVDGEGEGEVAAMAGKRRVLHDGSGYSATTRCGGTTCVLAPRRLLLQLPTRR

SEQ ID NO: 2668 - protein, 704 aa, Solanum phureja
MNAVGRQRSGTSTGHHQRQYSDNFLETSSNGRWLQSAGLQHLQTSNNNVPQAPQEYGYYGGAQGSRMLRGAQRTYSGGSDLFAEPLTPPGNHRQSSQRRNGDEEVYPNEFSPGLLDLHSLDTELLPEMPVAGLYDAPSMHHFARAKSFDDSEQFLANNKQTGRVRGLPESNVSKSFAVDKDKASNVAKIKVVVRKRPLNKKELTKNEEDIVETRFNSLVVHETKLKVDLTQYVEKHEFVFDAVLNEEVSNDEVYHETVEPIVPIIFQRTKATCFAYGQTGSGKTYTMKPLPLRASRDLLRLIHHTYRNQGFQLFFSFFEIYGGKLYDLLNDRKKLCMREDGKQQVCIVGLQEYRVSDVEMIKELIDRGNATRSTGTTGANEESSRSHAILQLSVKRSADGSESKPPRVIGKLSFIDLAGSERGADTTDNDKQTRIEGAEINKSLLALKECIRALDNDQNHIPFRGSKLTEVLRDSFVGNSRTVMISCISPNAGSCEHTLNTLRYADRVKSLSKGNNSKKDVSSSTLNLKESTTLSFSAVVPSTSTFEDDTGDSWPEQIDKDEYDEDFYVQEKPMWKKNEKLDGYTISNSEDKMKRANAQTKWKEPPRTEAKYSNSDDDLNALLKDEEDLVNAHRKQVEETMDIVREEMNLLVEADQPGNQLDNYISRLNAILSQKAAGILELQNQLAHFQKRLKEHNVLVSSGN

SEQ ID NO: 2669 - protein, 703 aa, Nicotiana tabacum
MNAVGRQRSGTSTAHHQRQYSDNFLENSSNGRWLQSAGLQHLQTSNTSIPPPQDYGYYGGAQGSRMYRGAQRTYSGGSDLFAEPLTPPGNPRQSSQRRNGDEEISPNEFSPGLLDLHSLDTELLPEMPVAGLYDAPSMHHFGRAKSFDDSEQFLANNKQTGRVRGLPESNVSKSFAVDKEKASNVAKIKVVVRNEPLNKKELAKTEEDIVETRFNSLVVHETKLKVDLTQYVEKHEFVFDAVLNEEVSNDEVYHETVEPIVPIIFQRTKATCFAYGQTGSGKTYTMKPLPLRACRDLLRLIHHTYRNQGFQLFFSFFEIYGGKLFDLLNDRKKLCMREDGKQQVCIVGLQEYRVSDVEMIKELIDRGNATRSTGTTGANEESSRSHAILQLSVKRSADGSESKPPRVIGKLSFIDLAGSERGADTTDNDKQTRIEGAEINKSLLALKECIRALDNDQNHIPFRGSKLTEVLRDSFVGNSRTVMISCISPNAGSCEHTLNTLRYADRVKSLSKGNNSKKDVSSSTLNLKESTNLSFSAVVPSTSTFEDDTGDSWPEQTDKDEYDEDFYEQEKSMWKKNEKLDSYSISNSEDKMKRTNVQTKWKEPPRTEAKYSNSDDDLNALLKEEEDLVNAHRKQVEETMDIVKEEMNLLVEADLPGNQLDDYISRLNAILSQKAAGILQLQNQLAHFQKRLKEHNVLVSSGH

SEQ ID NO: 2670 - protein, 746 aa, Manihot esculenta
MSREQKRGKQEKGSDVAEKVVVAVKASKEIPKTALVWALTHVVHAGDCITLLVVVPSQSSGRKLWGFPRFAGDCASGHRKSHSGATSEQKCDITDSCSQMILQLHDVYDPNKINVKIKIVSGSPCGAVAAEAKRAQANWVVLDKQLKHEEKRCMDELQCNIVVMKRSQPKVLRLNLVGSSKEAESVGKLPSEPDEASGEHTKNKNDSSDSIRGPVVTPTSSPELGTPFTATEVGTSSVSSDPGTSPFFTSETNGDLKKEESLIVKENRDVDESSSDTDSEHLSSASASLRFEPWMGEFISSHIQSSRRMEEVSQRSTNMAQESTTKALLEKFSKLDRQIGAGMSNYRTDLELSGNVREATSLSRNAPPGPPPLCSICQHKAPVFGKPPRWFSYAELELATGGFSQANFLAEGGFGSVHRGVLPDGQAVAVKQHKLASSQGDLEFCSEVEVLSCAQHRNVVMLIGFCIEDKRRLLVYEYICNGSLDSHLYGRHREPLEWSARQKVAVGAARGLRYLHEECRVGCIVHRDMRPNNILITHDFEPLVGDFGLARWQPDGDTGVETRVIGTFGYLAPEYAQSGQITEKADVYSFGVVLVELVTGRKAVDLNRPKGQQCLTEWARPLLEEYAIDELIDPRLGNCYSEQEVYCMLHAASLCIRRDPHSRPRMSQVLRILEGDMLMDANYTSTPGYDVGNRSGRIWVERQQQHYSGPMSNEAVEGFSKLSLDTLRPVFWERDKGRKISYEEDL

SEQ ID NO: 2671 - protein, 741 aa, Theobroma cacao
MSREQKKGKQEKGGTDVAEKVVVAVKASKEIPKTALVWALTHVVQPGDCITLLVVVPSHGSGRKWGFPRFAGDCASGSRKSQSGSSSEQKSDITDSCSQMILQLHDVYDPNKINVKIKIVSGSPCGAVAAEAKLAQASWVVLDKQLKNEEKRCMEELQCNIVVMKRSQAKVLRLNLVGSPKKEADASCQLNSEMDERSEKHPKSKNGSSGSIRGPAVTPTSSPELGTPFTATEAGTSSVSSSDPGTSPFFISEGNGDLKKEESIVIKENQDLDESSSDTESENLSLSSASLRFQPWITEYLTSHHRSSQHLEETSGRANDRAQASTTKALLEKFSKLDREAGIGISSFRSDTEFSGNVREAISLSRNAPPGPPPLCSICQHKAPVFGKPPRWFTYAELELATGGFSQANFLAEGGFGSVHRGVLPDGQAIAVKQHKLASSQGDLEFCSEVEVLSCAQHRNVVMLIGFCIEDRRRLLVYEYICNGSLDSHLYGRHREPLEWSARQKIAVGAARGLRYLHEECRVGCIVHRDMRPNNILITHDFEPLVGDFGLARWQPDGDTGVETRVIGTFGYLAPEYAQSGQITEKADVYSFGVVLIELVTGRKAVDLNRPKGQQCLTEWARPLLEEYAIDELVDPRLGDCYSEHEVYCMLHAASSCIRRDPHSRPRMSQVLRILEGDMLMDTNYTSPGYDVGNRSGRIWAEQKQHYSGPLVNEASEGFSGKLSLEGLRPGTRRKSCEEDL

SEQ ID NO: 2672 - protein, 754 aa, Ricinus communis
MSREQKRGGKQEKGGSDVAVKVVVAVKASKEIPKTALVWALTHVVQAGDCITLLVVVPSHSPGRKLWGFPRFAGDCASGHRKSHSGATSEQRCDITDSCSQMILQLHDVYDPNKINVKIKIVSGSPCGSVAAEAKRALANWVVLDKQLKHEEKRCMEELQCNIVVMKRTQPKVLRLNLVGTSKEAESAIPLPSELDEAPDKQTKNKNDSSDSIRGPVVTPTSSPELGTPFTATEVGTSSVSSDPGTSPFFISDTNADLKKEESLVIKEHGDVDESSSDTDSEHLSTASASLRFEPWIGEILSSHIQSSRHMEEGPQRRTSMAQASTTKALLEKFSKLDRQTGIGMSNYRTDSDLSGNVREAISLSRNAPPGPPPLCSICQHKAPVFGKPPRWFSYAELELATGGFSQANFLAEGGFGSVHRGVLPDGQAVAVKQHKLASSQGDLEFCSEVEVLSCAQHRNVVMLIGFCIEDKRRLLVYEYICNGSLDSHLYGRHREPLEWSARQRIAVGAARGLRYLHEECRVGCIVHRDMRPNNILITHDFEPLVGDFGLARWQPDGDTGVETRVIGTFGYLAPEYAQSGQITEKADVYSFGVVLVELVTGRKAVDLNRPKGQQCLTEWARPLLEEYAIDELIDPQLGNNYSEQEVYCMLHAASLCIRRDPHSRPRMSQVLRILEGDMLMDSNYASTPGYDVGNRSGRIWAEQQHQHQHHQQHYSGPLANEALEGFSKLSLDTLRPAFWEREKARRISCEDDL

SEQ ID NO: 2673 - protein, 754 aa, Citrus clementina
MSGEVKKGKQEKGSSDVAEKVVVAVKASKEIPRTALVWALTHVVQPGDCITLLVVVPSHSSGRRFWVFPRFAGDCASGHRKSFSGTISEQRGDITDSCSQMILQLHDVYDPNKINFKIKIVSGSPCGAVAAEAKKAQAGWVVLDKQLKHEEKCCMEELQCNIVVMKRSQAKVLRLNLVGTSKKEAGVACPLPSDPDESFEKDPKNKDSSSGSIRGPVVTPTSSPELGTPFTATEAGTSSVSSSDPGTSPFFISGINGDLKKESSVIREDRNLEDSSSDTDSENLSVSSASMRFQPWMTEFLRSHHQSSHQMEEECSRRTNNKTQASTTKALLEKFSRLDRDAGVGMSSYRTDLEFSGNVREAISLSRNAPPGPPPLCSICQHKAPVFGKPPRWFSYAELELATGGFSQANFLAEGGFGSVHRGVLPDGQAVAVKQHKLASSQGDHEFCSEVEVLSCAQHRNVVMLIGFCIEDRRRLLVYEYICNGSLDSHLYGCHQEPLEWSARQKIAVGAARGLRYLHEECRVGCIVHRDMRPNNILLTHDFEPLVGDFGLARWQPDGDMGVETRVIGTFGYLAPEYAQSGQITEKADVYSFGVVLVELVTGRKAVDLNRPKGQQCLTEWARPLLEEYAIDELVDPRLGNHYSEHEVYCMLHAASLCIRRDPHSRPRMSQVLRILEGDTVIDTYMSTPGYDVGSRSGRIWVEQQQHQQQQLPYSGPLMNEALEGFGRKLPLDSLKAAFWERDKARRTSRENDL

SEQ ID NO: 2674 - protein, 754 aa, Citrus sinensis
MSGEVKKGKQEKGSSDVAEKVVVAVKASKEIPRTALVWALTHVVQPGDCITLLVVVPSHSSGRRFWVFPRFAGDCASGHRKSFSGTISEQRGDITDSCSQMILQLHDVYDPNKINFKIKIVSGSPCGAVAAEAKKAQAGWVVLDKQLKHEEKCCMEELQCNIVVMKRSQAKVLRLNLVGASKKEAGVACPLPSDPDESFEKDPKNKDSSSGSIRGPVVTPISSPELGTPFTATEAGTSSVSSSDPGTSPFFISGINGDLKKESSVIREDRNLEDSSSDTDSENLSVSSASMRFQPWMTEFLRSHHQSSHQMEEECSRRTNNKTQASTTKALLEKFSRLDRDAGVGMSSYRTDLEFSGNVREAISLSRNAPPGPPPLCSICQHKAPVFGKPPRWFSYAELELATGGFSQANFLAEGGFGSVHRGVLPDGQAVAVKQHKLASSQGDHEFCSEVEVLSCAQHRNVVMLIGFCIEDRRRLLVYEYICNGSLDSHLYGCHQEPLEWSARQKIAVGAARGLRYLHEECRVGCIVHRDMRPNNILLTHDFEPLVGDFGLARWQPDGDMGVETRVIGTFGYLAPEYAQSGQITEKADVYSFGVVLVELVTGRKAVDLNRPKGQQCLTEWARPLLEEYAIDELVDPRLGNHYSEHEVYCMLHAASLCIRRDPHSRPRMSQVLRILEGDTVIDTYMSTPGYDVGSRSGRIWVEQQQHQQQQLPYSGPLMNEALEGFGRKLPLDSLKAAFWERDKARRTSRENDL

SEQ ID NO: 2675 - protein, 745 aa, Fragaria vesca
MSREQKRVKQEKGSDDAEKVVVAVKASKEIPKTALVWALTHVVQPGDCITLLVVVPSQSSGRKWGFPRFAGDCASINKKSQPGTTSELKGDISDSCSQMILQLHEVYDPNKINVKIKIISGSPSGSVAVEAKRAQASWVVLDKHLKPEEKRCMEELQCNIVVMKRSQPKVLRLNLNGSPKKDAESGCQVASELERSEKHTKKNNNSLSSLRGPDVTPTSSPELGTPFTATEAGTSSVSSSDPGTSPFFISGVNGDKKKEESMVGKENQVLDDSSSDTDSECLSTSSGSRRFQPWIAEFLNSHHQSSQHTESSHRTNDNPNGPSTKALLAKISKLERDAEIGMSNYRSDMDFSGNLREAISLSRNAPPGPPPLCSICQHKAPVFGKPPRWFSYAELELATGGFSQANFLAEGGFGSVHRGVLPDGQAVAVKQHKLASSQGDQEFCSEVEVLSCAQHRNVVMLIGFCIEDKRRLLVYEYICNGSLDSHLYRRNREPLEWSARQKIAVGAARGLRYLHEECRVGCIVHRDMRPNNILITHDFEPLVGDFGLARWQPDGDLGVDTRVIGTFGYLAPEYAQSGQITEKADVYSFGVVLVELVTGRKAVDLNRPKGQQCLTEWARPLLEEYVIDELVDPSLESFSEHEVYCMLQAASLCIRRDPQTRPRMSQVLRILEGDMVMDSNYMPTPGYDVGCRSGRIWSEHQQKEQYSGPLDEALEGYGKLSLENSRLAFWERDKARRTSSCEDHL

SEQ ID NO: 2676 - protein, 750 aa, Quercus alba
MSQEQKQGKQEKGSDDAEKVVVAVKASKEIPKTALVWALTHVVQPGDCITLLVVVPSQGSGRKLWVFPRFAGDCASGHRRTHSGASSDQKCDITDTCSQMILQLHDVYDPNKINVKIKIVSGSPCGAVAAEAKRAQASWVVLDKQLKHEEKRCMEELQCNIVVMKRSQPKVLRLNLVGSSKKHSEVACPLPSEIDKESEKNPKKKNDSLSSIPGPVVTPTSSPELETPFTATEAGTSSVSSSDLGTSPFFISKMNGDLKKDDSLVIEENEDPDNTSSDADSEHLTSSSRSLRFQPWMGEFITSNFQSSQDTDRSSQRPFHKPQALMSKTLVEKYSKQDGEPGIGMQHYRTDMDFNGNVREAVSLSRNAPPGPPPLCSICQHKAPVFGKPPRWFSYAELELATGGFSKANFLAEGGFGSVHRGVLPDGQVVAVKQHKLASSQGDVEFCSEVEVLSCAQHRNVVMLIGFCIEDRRRLLVYEFICNGSLDSHLYGRHQEPLEWAARQKIAVGAARGLRYLHEECRVGCIVHRDMRPNNILITHDFEPLVGDFGLARWQPDGDMGVDTRVIGTFGYLAPEYAQSGQITEKADVYSFGVVLVELVTGRKAVDLNRPKGQQCLTEWARPLLEDCAIEELVDPQLGNHYSEQEVFCMLNAASLCIQRDPHSRPRMSQVLRILEGDMVMDANYISTPGYDVGSRSNRIWVEQQQQQQHYSGPLLNEAIEGFSGKLSLENSRQSYWERDKARTSCADDL

SEQ ID NO: 2677 - protein, 763 aa, Prunus persica
MSREQKRVRQEKGSDDAEKVVVAVKASKEIPKTALVWALTHVVQPGDCITLLVVVPSQSSGRKFWGFPRFAGDCASGNRKSHSGTTSELKCDISDTCSQMILQLHEVYDPNKINVKIKIISGSPSGSVAVEAKKAQASWVVLDKHLKHEEKHCMEELQCNIVVMKRSQPKVLRLNLNGSSKKEPELARSLPSQLDEGTDKHPKKKNDSLNSIRGPVVTPTSSPELGTPFTATEAGTSSVSSSDPGTSPFFVSEINGDMKKEESLVSKENKVLDDSSSDTDSENLSTSSASMRFQPWIAEFLNSHRPSSQHMEESSHRTNDNSKASTTKALLEKFSKLDKDAGIGMPNYRADMEFSGNLREAISLSRNAPPVPPPLCSICQHKAPVFGKPPRWFSYAELELATGGFSQANFLAEGGFGSVHRGVLPDGQAVAVKQHKLASSQGDQEFCSEVEVLSCAQHRNVVMLIGFCIEDKRRLLVYEYICNGSLDSHLYRRHREPLEWSARQKIAVGAARGLRYLHEECRVGCIVHRDMRPNNILITHDFEPLVGDFGLARWQPDGDTGVDTRVIGTFGYLAPEYAQSGQITEKADVYSFGVVLVELVTGRKAVDLNRPKGQQCLTEWARPLLEEYAIDDLIDPRLDNFYSEQEVYCMLHAASLCIRRDPQSRPRMSQVLRMLEGDMVMDTNYASTPGYDVGCRNGHDVGCRSGRIWSEHQQQHQPQEKERYSGPLLDEPMEGYKKLSLENVRPGFWERDKARRTSSEHHL

SEQ ID NO: 2678 - protein, 738 aa, Gossypium hirsutum
MSREQKGKQEKGGSNVAEKVVVAVKASKEVPKTALVWALTHVVQPGDCITLLVVVPSPSSGRRWGFPRFAGDCASRKSQLGSSSEQKSDITDSCSQMILQLHDVYDPNKINVKIKIVSGSPCGAVAAEAKRALASWVVLDKQLKHEEKRCIEELQCNIVVMKNSQAKVLRLNLVGSPEKEAEASSQLNSGRDEASEKYPQNKDTSSGSIRGPVVTPTSSPELGTPFTATEAGTSSVSSSDLGTSPFFNSAGNGDLKKDESLVIKEIQDLDESGSDPESENLSLSSTSLRFQPWITEYLTSQHQSSRHLEETSVRAHDRVQASTTKALLEKFSKLDREAGIGISSFRSDSEFSGNVREAVSLSRNAPPGPPPLCSICQHKAPVFGKPPRWFTYAELELATGGFSQANFLAEGGFGSVHRGLLPDGQAIAVKQHKLASSQGDLEFCSEVEVLSCAQHRNVVMLIGFCIEDRRRLLVYEYICNGSLDSHLYGRHREPLEWSARQKIAVGAARGLRYLHEECRVGCIVHRDMRPNNILITHDFEPLVGDFGLARWQPDGDTGVETRVIGTFGYLAPEYAQSGQITEKADVYSFGVVLIELVTGRKAVDLNRPKGQQCLTEWARPLLEEYAIDELVDPRLEDRYSEHEVYCMLHAASLCVRRDPHSRPRMSQVLRILEGDVLMNTNYTSPGYDVGNRSGRFWAEQQRSYSGPLTSDSLDEFSGKLSLDGARPRTRRTSCEDHL

SEQ ID NO: 2679 - protein, 738 aa, Gossypium hirsutum
MSREQKGKQEKGGSNVAEKVVVAVKASKEVPKTALVWALTHVVQPGDCITLLVVVPSPSSGRRWGFPRFAGDCASRKSQLGSSSEQKSDITDSCSQMILQLHDVYDPNKINVKIKIVSGSPCGAVAAEAKRALASWVVLDKQLKHEEKRCIEELQCNIVVMKNSQAKVLRLNLVGSPEKEAEASSQLNSGRDEASEKYPQNKDTSSGSIRGPVVTPTSSPELGTPFTATEAGTSSVSSSDLGTSPFFNSAGNGDLKKDESLVIKEIQDLDESGSDPESESLSLSSTSLRFQPWITEYLTSQHQSSRHLEETSVRAHDRVQASTTKALLEKFSKLDREAGIGISSFRSDSEFSGNVREAVSLSRNAPPGPPPLCSICQHKAPVFGKPPRWFTYAELELATGGFSQANFLAEGGFGSVHRGLLPDGQAIAVKQHKLASSQGDLEFCSEVEVLSCAQHRNVVMLIGFCIEDRRRLLVYEYICNGSLDSHLYGRHREPLEWSARQKIAVGAARGLRYLHEECRVGCIVHRDMRPNNILITHDFEPLVGDFGLARWQPDGDTGVETRVIGTFGYLAPEYAQSGQITEKADVYSFGVVLIELVTGRKAVDLNRPKGQQCLTEWARPLLEEYAIDELVDPRLEDRYSEHEVYCMLHAASLCVRRDPHSRPRMSQVLRILEGDVLMNTNYTSPGYDVGNRSGRLWAEQQRSYSGPLTSDSLDEFSGKLSLDGARPRTRRTSCEDNL

SEQ ID NO: 2680 - protein, 730 aa, Populus trichocarpa
MSREQRRGNQEKGGSDVAVKVVVAVKASKEIPKTALVWALTHVVQPGDCITLLVVVPSQSPGRRLWGFPRFAGDCANGHRKSHLGATSDQKFDLTDSCSQMILQLHDVYDPNKINVKIKIVSGSPCGAVSAEAKKAQANWVVLDKQLRHEEKRCMEELQCNIVVMKKSQAKVLRLNLVGSSKEPEVVGSSPSNLDEASEKHSKNKNDSPGSIRGPVVTPTSSPEAGTPFTVTEAGTSSVSSDPGTSPFFISETNGELKKEEPLVIVENRDLDESSSDTDSEHLSSVSSLRFEPWVGELLSSHIHSSRHIEDGSQRSNSLAQTSTTIALLEKFSKLDQQTGIGKSNYRTDLDLSGNMREAISLSRNAPLGPPPLCSICQHKAPVFGKPPRWFSYAELELATGGFSQANFLAEGGFGSVHRGVLPDGQAVAVKQHKLASSQGDIEFCSEVEVLSCAQHRNVVMLIGFCIEDRRRLLVYEYICNGSLDSHLYGRHREPLEWSARQKIAAGAARGLRYLHEECRVGCIVHRDMRPNNILITHDFEPLVGDFGLARWQPDGETGVETRVIGTFGYLAPEYAQSGQITEKADVYSFGVVLVELVTGRKAVDLNRPKGQQCLTEWARPLLEEFAIDELIDPQLGNHYSEQEVYCMLHAASLCIRRDPHSRPRMSQVLRILEGDMLVDANYMATPGYDVGNRSGRIYIEQQQQQPPQHCGGPLPINEAREGFSGKLSF

SEQ ID NO: 2681 - protein, 236 aa, Hordeum vulgare
MAALRHLAGATHNHRIAANSSSLFDLQRPPSCLAAARPLSLAPLRSRFTRLYALSSNDIKVGFNLEVDGAPWKILEFLHVKPGKGAAFVRTKMRNYITGNTVEKTFRAGSTIQEASISKETKQFTYKDGSQFVFMDLTSFEESRLNESDVGDRQKWLKEGMDCTLLYWNGRIIDFDLPITVRLTVTETDPGQGDSAQGGTKPATLETGAVVNVPSFVDVGDDVLIDSRTGQYMSRA

SEQ ID NO: 2682 - protein, 239 aa, Avena sativa
MAALRQLAGATHNHRIAANSSSLFDLQRPPSCLSFAAARPLRLAPLRSRSPTRLYSLSSNDIKVGISLEVDGAPWKIIEFLHVKPGKGAAFVRTKMKNYISGNTVEKTFRAGSTIQEASISKETKQFTYKDGSQFVFMDLTTFEESRLNESDVGDKQKWLKEGMDCILLYWNGKIIDFDLPITVRLTVTETDPGQGDSAQGGTKPATVETGAVINVPSFVDVGDDVLIDSRTGQYMSRA

SEQ ID NO: 2683 - protein, 226 aa, Brachypodium distachyon
MAALRHLAAGATSSSFDLRRPPSFCLAGTRPLRLRSRLARVYALSSNDIKVGLNLEVDGAPWKILEFLHVKPGKGAAFVRTKMRNYVSGNTVEKTFRAGSTIQEASISKETKQFTYKDGPQFVFMDLTTFEESRLNESDVGDKQKWLKEGMDCNLLYWNGRIIDFDLPITVRLTVTETDPGQGDSAQGGTKPATLETGAVVNVPSFVDVGDDVLIDSRTGQYMSRA

SEQ ID NO: 2684 - protein, 229 aa, Oryza sativa
MASLRHGHLSPSGATAPPSSFAQLRRPSSCLAGPRPLRSRLTRVYALSSNDIRVGSNLEVDGAPWKVLEFLHVKPGKGAAFVRTKMRNYITGNTVDKTFRAGSTIPEASISKETKQFTYKDGAQFVFMDLTTFEESRLNESDVGDRQKWLKEGMDCNLLYWNGRIIDFDLPITVRLTVTDTDPGQGDSAQGGTKPATVETGAVVTVPSFVNVGDDILIDSRTGQYMNRA

SEQ ID NO: 2685 - protein, 229 aa, Oryza sativa
MASLRLRHLSPSGATAPPSSFAQLRRPSSCLAGPRPLRSRLTRVYALSSNDIRVGSNLEVDGAPWKVIEFLHVKPGKGAAFVRTKMRNYITGNTVDKTFRAGSTIPEASISKETKQFTYKDGAQFVFMDLTTFEESRLNESDVGDRQKWLKEGMDCNLLYWNGRIIDFDLPITVRLTVTDTDPGQGDSAQGGTKPATVETGAVVTVPSFVNVGDDILIDSRTGQYMNRA

SEQ ID NO: 2686 - protein, 523 aa, Leymus cinereus x Leymus triticoides
  misc_feature (169)..(169): Xaa can be any naturally occurring amino acid
MGGLRLLVGGLWFLALLRLGAAAEAGVVAVDGRRAIAATGEDFVCATLDWWPPDKCDYGTCSWGRASLLNLDLSNKILLNAVRAFSPLVLRLGGSLQDKVVYGTADRRGPCAPFAKSESEMFGFTQGCLPMRRWDELNAFFQKSGAKIVFGLNALNGRVPLQDGAMGGXWDSSNAASLIRYTAGKGYKIHGWELGNELSGSGVGTKIGVGQYVKDAIALKKTVDGMYRGSPAKPLVLAPGGFFDAGWYGELIARTKPNMLNVVSHHIYNLGAGVDTHLVERILDPAALDGMASPFRDLQGLLKAAGTSAVAWVGEAGGAYNSGHHLVTDAFVFSFWFLDQLGMSAKYDTKSYCRQSFIGGNYGLLNTTTFQPNPDYYSALLWHRLMGTKVLEAKFTGTNMVRAYAHCAKHSPGITLLLINLHGNATNHVSVASSGAHAGTARRHGGRFGQSAGATREEYHLTPEGGNIQSQVMMLNGRALVTGADGSIPRMEPVKVDAARHIAVAPRSIVFVHMPNFHAPACS

SEQ ID NO: 2687 - protein, 317 aa, Solanum tuberosum
MAEATEMPYFKLNTGFSIPAVGLGTWQSDPGVVGKAVETAIKMGYRHIDCAQIYKNEKEIGEVLSRLFKDGVVKRQDLFITSKLWNTNHAPEDVPVALDKTLKDLQLEYVDLYLIHWPVSMKPGSVDFKPENLMPTNIPSIWKAMEKVYDSGKARVIGVSNFSTKKLGDLLQVARIRPAVNQVECHPSWQQTKLREFCKSNEVHLSAYSPLGSPGSTWLKSDVLKQPAVISVAEKLGKTPAQVCLRWGIQMGQSVLPKSTHEARIKENLDVLNWSIPDDLLAKFSEIPQARLLRGISFVHETHGQYRTLEELWDDEI

SEQ ID NO: 2688 - protein, 317 aa, Solanum phureja
MAEATEMPYFKLNTGFSIPAVGLGTWQSDPGVVGKAVETAIKMGYRHIDCAQIYKNEKEIGEVLSRLFKDGVVKRQDLFITSKLWNTNHAPEDVPVTLDKTLKDLQLEYVDLYLIHWPVSMKPGSVDFKPENLMPTNIPSIWKAMEKVYDSGKARVIGVSNFSTKKLGDLLQVARIRPAVNQVECHPSWQQTKLREFCESNEVHLSAYSPLGSPGTTWLKSDVLKQPAVISVAEKLGKTPAQVCLRWGIQMGQSVLPKSTHEARIKENLDVLNWSIPDDLLAKFSEIPQARLLRGTSFANETHGQYRTLEELWDDEI

SEQ ID NO: 2689 - protein, 313 aa, Solanum melongena
MAKMSYFDLNTGHCIPAVGLGTWQSDPGVVGKAVEAAIKMGYRHIDCAQIYKNEKEIGEVLNRLFKDGVVKRQDLFITSKLWNTNHAPEDVPVALDKTLKDLQLEYVDLYLIHWPVSMKPGSDFKPENLMPINIPRVWKAMEKVYDSGKARVIGVSNFSTKKLADLLEVARIPPTVNQVECHPSWQQTKLREFCKSKNVHLSAFSPLGSPGTTWLKSDVLKQPVVVSVAEKLGKTPAQVCLRWGIQMGQSVLPKSTNEARIKENLDVLNWSIPDDLLARFSEIPQARLLRGTSFVHETHGQYRTLEELWDGEL

SEQ ID NO: 2690 - protein, 315 aa, Nicotiana tabacum
MAAAIRYFELNTGAKMPSVGLGTWQSDPGVVGHAVEIAIKVGYRHIDCARIYKNEKEIGEVLKKLFKDGVVKREELFVTSKLWNTDHAPEDVPLALNRTLEDLQLDYVDLYLMHWPVTLKPGSADFKPENLMPTNIPSTWQAMEKLYDSGKARAIGVSNFSTKKLGDLLQVARVPPAVNQVECHPSWQQAKLRDFCKSKGVHLSAYSPLGSPGTTWLKSDVLKQPAVISVAEKLGKTPAQVCLRWGIQMGQSVLPKSTHEARIKENLDVLNWSIPDDLFAKFSEIPQARLLRGTSFVHETYGQYRTLEELWDGEL

SEQ ID NO: 2691 - protein, 314 aa, Capsicum annuum
MASNGYFKLNTGFIIPAIGLGTWQSDPGVVGQAVETAIRVGYRHIDCAHVYKNEKEIGEVLKRLINEGVVKRSELFITSKLWNTDHAPEDVPVAIDRTLGNLQLEYVDLYLMHWPVSMKPGSVDFKPENLMPTNIHNIWKAMEKVYDSGKARAIGVSNFSTKKLGDLLQEARIPPAVNQVECHPSWQQAKLREFCKSKGVHLSAYSPLGSPGTTWLKSDVLKQPAVISVAEKLGKTPAQVCLRWGIQMGQSVLPKSTNEARIKENFDVLDWSIPDDLLAKFSEIPQARLLRGTSFVHEKYGQYRTLEELWDGEI

SEQ ID NO: 2692 - protein, 133 aa, Hordeum vulgare
MAATSGLTATVTSPPAALRTSPPPVLFLRPISRCSRLHSLKAKAAAKDQGEKKPEATKKKAYSLVCTACEGNGAIACTQCKGGGENLEDHFGGRFKAGGLCWLCRGKREILCGSCNGAGFLGGFMSTADDTSE

SEQ ID NO: 2693 - protein, 133 aa, Pseudoroegneria spicata
MAATSGLTATVTSPPAALRTSPPPVLFLRPISRCSRPHSLKAKAAAKDQDEKKPEATKKKAYSLVCTACEGNGAIACTQCKGGGENLEDHFGGRFKAGGLCWLCRGKREILCGSCNGAGFLGGFMSTVDDTSE

SEQ ID NO: 2694 - protein, 133 aa, Triticum aestivum
MAATSGLTATVTSPPAALRTLAPPGLFLRPISRCSRPHSLKAKAAAKDQDEKKPEATKKKAYSLVCTACEGNGAIACTQCKGGGENLEDHFGGRFKAGGLCWLCRGKREILCGSCNGAGFLGGFMSTADDTSE

SEQ ID NO: 2695 - protein, 129 aa, Avena sativa
MAATSGLTATVSSPPAALRTSPPPVIFLRPISRCSGVHSVKAKATKKDQGEKKPSKAQSLVCSACEGNGAIACTQCKGGGENLEDHFGGRFKAGALCWLCRGKREILCGSCNGAGFLGGFMSTADDTSE

SEQ ID NO: 2696 - protein, 69 aa, Unknown
  Sequence found in Organisms: Hordeum vulgare, Brachypodium distachyon, Avena sativa, Triticum aestivum
MSDWGPVVIAVVLFVLLSPGLLLQLPGKHHFVEFGNMHTSAMAILVHAIIYFALIALFVIVIGVHITTD

SEQ ID NO: 2697 - protein, 69 aa, Avena sativa
MSDWGPVVIAVVLFVLLSPGLLLQLPGKHRFVEFGNMHTSAMAILVHAIIYFALIALFVIVIGVHITTD

SEQ ID NO: 2698 - protein, 69 aa, Festuca arundinacea
MSDWGPVVIAVVLFVLLSPGLLLQLPGKHHFVEFGNMHTSAMSILVHAIIYFALVALFVIVIGVHITTD

SEQ ID NO: 2699 - protein, 132 aa, Secale cereale
  misc_feature (46)..(47): Xaa can be any naturally occurring amino acid
  misc_feature (49)..(49): Xaa can be any naturally occurring amino acid
  misc_feature (70)..(70): Xaa can be any naturally occurring amino acid
  misc_feature (74)..(74): Xaa can be any naturally occurring amino acid
MSDWGPVVIAVVLFVLLSPGLLLQLPGKHHFVEFGNMHTSAMAILXXAXSTSPSSRSSSSSSACTSPLTXHWLXSITPAGQLQLSSSSSSSFFFSPIHLTPASPFCFVLFRSCCLQLLVRSSVCDQFVCCPW

SEQ ID NO: 2700 - protein, 69 aa, Oryza sativa
MSDWGPVVIAVVLFVLLSPGLLIQLPGRHHFVEFGNLHTSAMSIVVHSIIYFALITLFVIVIGVHITTD

SEQ ID NO: 2701 - protein, 63 aa, Setaria italica
RWCCSCCCRRGCCCSCPGSTTSWSSATCTPAPWPSSSTPSSTSPSSRSSSSSSACTSPLTRHR

SEQ ID NO: 2702 - protein, 70 aa, Cynodon dactylon
MSDWGPVVIAVVLFVLLSPGLLVQLPGRHHIVEFGNLHTSALSILVHSIIYFALITLFVIVIGVHITTDS

SEQ ID NO: 2703 - protein, 70 aa, Setaria italica
MSDWGPVVIAVVLFVLLSPGLLFQLPGRCHFVDFGNLQTSAVSILVHSIIYFALIAIFVIVIGVHITTAD

SEQ ID NO: 2704 - protein, 255 aa, Triticum aestivum
MDCGGEEQARQNGHAGDGGDPAEWKMVAELRAVVEAQDPAAKEEDDFMLRRFLRARDHNVGKASAMFLKYLAWKRAAKPWGSITEAEVRGELVQDKLYVQGFDKTGRPMIYLFGNRHFAAKRDLEEFKRYVVYILDSTCTKLPAGQEKFASVVDLKGWGYANCDIRAKLAALEIMQNYYPERLGRVFLIHVPYVFMAAWKMVYPFIDDNTKKKFVFVADKDLDATLRDAIDVSQLPEQYGGKLRLEGYKSSSTCN

SEQ ID NO: 2705 - protein, 255 aa, Triticum aestivum
MDCGGEEQARQNGHAGDGGDPAEWKMVAELRAVVEAQDPAAKEEDDFMLRRFLRARDHNVGKASAMFLKYLSWKRGAKPRGSITEAEVRGELVQDKLYIQGFDKTGRPMIYLFGNRHFAAKRDLEEFKRYVIYILDNTCTKLPAGQEKFASVVDLKGWGYANCDIRAKLAALEIMQNYYPERLGRVFLIHVPYVFMAAWKMVYPFIDDNTKKKFVFVADKDLDATLRDAIDVSQLPEQYGGKLRLEGYKSSSTCN

SEQ ID NO: 2706 - protein, 253 aa, Hordeum vulgare
MDCGGEEQARQNGHGGDPAEWKKVAELRAVVEAQDPAAKEEDDFMLRRFLRAREQNINKASSMFLKYLSWKGAAKPHGSITEAEVRGELVQDKLYVQGFDKVGRPMIYLFGNRHFAAKRDLEEFKRYVVYILDNTCTKLPAGQEKFASVVDLKGWGYANCDIRAKLAALEIMQNYYPERLGRVFLIHVPYVFMAAWKMVYPFIDDNTKKKFVFVADKDLDATLRDAIDVSQLPEQYGGKLRLEGYKSSSSPPS

SEQ ID NO: 2707 - protein, 260 aa, Pseudoroegneria spicata
  misc_feature (104)..(104): Xaa can be any naturally occurring amino acid
  misc_feature (118)..(118): Xaa can be any naturally occurring amino acid
  misc_feature (132)..(132): Xaa can be any naturally occurring amino acid
  misc_feature (185)..(185): Xaa can be any naturally occurring amino acid
  misc_feature (228)..(228): Xaa can be any naturally occurring amino acid
  misc_feature (231)..(231): Xaa can be any naturally occurring amino acid
  misc_feature (233)..(233): Xaa can be any naturally occurring amino acid
  misc_feature (240)..(240): Xaa can be any naturally occurring amino acid
  misc_feature (252)..(253): Xaa can be any naturally occurring amino acid
  misc_feature (256)..(257): Xaa can be any naturally occurring amino acid
  misc_feature (259)..(259): Xaa can be any naturally occurring amino acid
MDSGADEQGRQNGHGGDGGDPAEWKKVAELRAVVEAQDPAAKEEDDFMLRRFLRARDHNINKASTMFLKYLSWKRTAKPRGSITEAEVRGELVQDKLYVQGFDXTGRPMIYLFGNRHXAAKRDLEEFKRYVXYILDNTCTKLPAGQEKFASVVDLKGWGYANCDIRAKLAALDIMQNYYPERLGXVFLIHVPYVFMAAWKMVYPFIDDNTKKKFVFVADKDLDATLRXAIXVXQLPEQYXGKLRLEGYKSSXXPPXXTXD

SEQ ID NO: 2708 - protein, 278 aa, Triticum aestivum
SRIAARQSTGAGGSVEEGGRGRGMDCGGEEQARQNGHAGDGGDPAEWKKVAELRAVVEAQDPAAKEEDDFMLRRFLRARDHNISKASAMFLKYLSWKRGAKPRGSITEAEVRGELVQDKLYIQGFDKTGRPMIYLFGNRHFAAKRDLEEFKRYVIYILDNTCTKLPAGQEKFASVVDLKGWGYANCDIRAKLAALEIMQNYYPERLGRVFLIHVPYVFMAAWKMVYPFIDDNTKKKFVFVADKDLDGTLRDAIDLSQLPEQYGGKLRLEGYKSSSTTL

SEQ ID NO: 2709 - protein, 182 aa, Leymus cinereus x Leymus triticoides
  misc_feature (132)..(132): Xaa can be any naturally occurring amino acid
  misc_feature (172)..(173): Xaa can be any naturally occurring amino acid
MDSGAEEQARQNGHGGDGGDPAEWKKVAELRAVVEAQDPAAKEEDDLMLRRFLRARDHNINKASAMFLKYLSWKRGAKPRGSISEGEVRGELVQDKLYVQGFDKAGRPMIYLFGNRHFAAKRDLEEFKRYVXYILDNTCTKCVKLNVQVILLVNSGLLMYMCRSMCSSGCRXXRRSSRRWWT

SEQ ID NO: 2710 - protein, 371 aa, Saccharum officinarum
MSDGKDSLDLSALGAAIPNSAELSAEDKAHLVASIKNTLEGLASRHTDVLENLEPKVRKRVEKLREIQGQHDELEAKFFEERAALEAKYQKLYEPLYSKRYEIVNGVVEVEGVTEESAAETPAEQKSGDETSAEQKEEKGVPAFWLNAMKNHEILAEEIQERDEEALKYLKDIKWYRISEPKGFKLEFHFDTNPFFKNSVLTKTYHMIDEDEPILEKAIGTEIEWYPGKCLTQKVLKKKPRKGSKNTKPITKTEDCESFFNFFSPPQVPDDDEEIDEDTAEQLQNQMEQDYDIGSTIRDKIIPHAVSWFTGEAAQDEDFEVMDGEDDEDDDDEDEDDEDEDDDDDYDTKKTKGTAGGEGQQGERPAECKQQ

SEQ ID NO: 2711 - protein, 370 aa, Zea mays
MSDGKDSLDLSALGAAIPNSAELSAEDKANLVASIKNTLEGLASRHTDVLENLEPKVRKRVEKLREIQGEHDELEAKFFEERAALEAKYQKLYEPLYSKRYEIVNGVVEIEGITKESAAETPEEQKSGDETSAEQKEEKGVPAFWLNAMKNHEILAEEIQERDEEALKYLKDIKWYRISEPKGFKLEFHFGTNMFFKNSVLTKTYHMIDEDEPILEKAIGTEIEWYPGKCLTQKVLKKKPRKGSKNTKPITKTEDCESFFNFFSPPQVPDDDEEIDEDTAEQLQNQMEQDYDIGSTIRDKIIPHAVSWFTGEAAQDEDFEVMDGEDDDDEDDDDEDDEDEDDDDYDTKKTKGTAGGEGQQGERPAECKQQ

SEQ ID NO: 2712 - protein, 373 aa, Zea mays
MSDGKDSLDLSALGAAIPNSAELSAEDKANLVASIKNTLEGLASRHTDVLESLEPKVRKRVEKLREIQGEHDELEAKFFEERAALEAKYQKLYEPLYSKRYEIVNGVVEVEGITVESAAETPAEQKTGDETSADQKEEKGVPAFWLNAMKNHEILAEEIQERDEEALKYLKNITWYRISEPKGFKLEFQFGTNPFFKNSVLTKTYHMIDEDEPILEKAIGTEIEWYPGKCLTQKVLKKKPRKGSKNTKPITKTEDCESFFNFFSPPQVPDDDEEIDEDIAEQLQNEMEQDYDIGSTIRDKIIPHAVSWFTGEAAQDEEFEVMDGEDDDDEDNDDEDEDDEDDDDDDDYDSKKTKGTAGGEGQQGERPAECKQQ

SEQ ID NO: 2713 - protein, 373 aa, Zea mays
MSDGKDSLDLSALGAAIPNSAELSAEDKANLVASIKNTLEGLASRHTDVLESLEPKVRKRVEKLREIQGEHDELEAKFFEERAALEAKYQKLYEPLYSKRYEIVNGVVEVEGITVESAAETPAEQKSGDETSADQKEEKGVPAFWLNAMKNHEILAEEIQERDEEALKYLKNITWYRISEPKGFKLEFQFGTNPFFKNSVLTKTYHMIDEDEPILEKAIGTEIEWYPGKCLTQKVLKKKPRKGSKNTKPITKTEDCESFFNFFSPPQVPDDDEEIDEDIAEQLQNEMEQDYDIGSTIRDKIIPHAVSWFTGEAAQDEEFEVMDGEDDDDEDNDDEDEDDEDDDDDDDYDSKKTKGTAGGEGQQGERPAECKQQ

SEQ ID NO: 2714 - protein, 373 aa, Setaria italica
MSDGKDSLDLSGLGAALPNATELSAEDKANLVASIKNTLEGLASRHIDVLESLEPKVRKRVEKLREIQGQHDELEAKFFEERAALEAKYQKLYEPLYSKRYEIVNGVIEVEGVKEESAAETPAEQKSGDEKPAEQKEEKGVPAFWLNAMKNHEILAEEIQERDEEALKYLKDIKWYRISEPKGFKLEFHFDTNPFFKNSVLTKTYHMIDEDEPILEKAIGTEIEWHPGKCLTQKVLKKKPRKGSKNTKPITKTEDCESFFNFFSPPQVPDDDEEIDEDTAEQLQNQMEQDYDIGSTIRDKIIPHAVSWFTGEAAQDDDFEGLIDGDEDDDEDDEDDEDEEDEESEDDYDAKKTQGAAGGEGQQGERPAECKQQ

SEQ ID NO: 2715 - protein, 372 aa, Pennisetum glaucum
MSDGKDSLDLSGLGAALPNANELSAEDKASLVASIKNTLEGLASRHMDVLDNLEPKVRKRVEKLREIQGQHDELEAKFFEERAALEAKYQKLYEPLYSKRYEIVNGVIEVEGVSKESAAETPAEKSGDENPAEQKEEKGVPAFWLNAMKNHEILAEEIQERDEEALKYLKDIKWYRISEPKGFKLEFYFDTNPFFKNSVLTKTYHMIDEDEPILEKAIGTEIEWLPGKCLTQKVLKKKPRKGSKNTKPITKTEDCESFFNFFSPPQVPDDEEEIDEDTAEQLQNQMEQDYDIGSTIRDKIIPHAVSWFTGEAAQDDDFEGLIDGDEDDDEDDEDDEDDEDEESEDDSDTKKTKGAAGGEGQQGERPAECKQQ

SEQ ID NO: 2716 - protein, 372 aa, Panicum virgatum
MSDGKDSLDLSGLGAAVPNSNELSAEDKANLVASLKNTLEGLASQHMDVLEGLEPKVRKRVEKLREIQGQHDELEAKFFEERAALEAKYQKMYEPLYSKRYEIVNGVIEVEGITESADETPAEQKSGDETPAEQKEEKGVPAFWLNAMKNHEILAEEIQERDEEALKYLKDIKWYRISEPKGFKLEFHFDTNPFFKNSVLTKTYHMIDEDEPILEKAIGTEIEWYPGKCLTQKVLKKKPRKGSKNTKPITKTEDCDSFFNFFSPPQVPDDDEEIDEDTAEQLQNQMEQDYDIGSTIRDKIIPHAVSWFTGEAAQDDDFEGLIDGDGDDDEEDDEDEDEEDEESGDDYDTKKTKGAAGGDGQQGERPAECKQQ

SEQ ID NO: 2717 - protein, 364 aa, Oryza sativa
MSDGKDSLDLSGLGAAVPNAKELSAEDKANLVESIKNTLQGLAARHTDVLESLEPKVRKRVEVLREIQSQHDDLEAKFFEERAALEAKYQKMYEPLYSKRYEIVNGVVEVDGVTKEAADETPAEQKEEKGVPEFWLNAMKNHEILSEEIQERDEEALKYLKDIKWYRISEPKGFKLEFYFDTNPFFKNSVLTKTYHMIDEDEPILEKAIGTEIEWFPGKCLTQKVLKKKPKKGSKNTKPITKTENCESFFNFFSPPQVPDDDEEIDEDTAEQLQNQMEQDYDIGSTIRDKIIPHAVSWFTGEAAQDEDFEGIMDDEDDDDEDDDDDEDEDDEGDDEDDEDEKKGGRVPAGEGQQGERPAECKQQ

SEQ ID NO: 2718 - protein, 367 aa, Brachypodium distachyon
MSEEGKDALDLSAISAAVPNAAELSAEDKANLVESIKNTLQGLAAQHSDVLENLEPKVRKRVEALREIQSQHDELEAKFFEERAALEAKYLKMYEPLYSKRYEVVNGVVEVEGVTKDEAAVTAADQKEEKGVPDFWLNAMKNHEILAEEIQERDEEALKYLKDIKWYRINEPKGFKLEFHFDTNPFFKNSVLTKTYHMIDEDEPILEKAIGTEIEWYPGKCLTQKVLKKKPKKGSKNTKPITKTEMCDSFFNFFTPPQVPDDDEEIDEDTAEQLQNQMEQDYDIGSTIRDKIIPHAVSWFTGEAAQDEDFDGIMDGEDDDDEDDDEDEDEDEDDEEDEDDEGDKKKGGRVPAGEGQQGERPAECKQQ

SEQ ID NO: 2719 - protein, 369 aa, Avena sativa
MSDGKDSLDLSALGAAVPNAAELSAEDKANLVESIKNTLQGLAARHTDVLESLEPKVRKRVEALREIQSQHDDLEAKFFEERAALEAKYQKMYEPLYSKRYDVVNGVVEVEGVTKDDAGEAAADKKEEKGVPDFWFNAMKNHEILAEEIQERDEEALKYLKDIKWYRISEPKGFKLEFHFNTNPFFKNEVLTKTYHMIDEDEPILEKAIGTEIEWYPGKCLTQKVLKKKPKKGSKNAKPITKIENCESFFNFFSPPQVPDDDEEIDEDTAEQLQNQMEQDYDIGSTIRDKIIPHAVSWFTGEAVQDEEFDGMMDDDEDEDEDGDEDEDEDEDDEEDEDDDDDDAAPKKKGGRVPAGEGQGERPAECKQQ

SEQ ID NO: 2720 - protein, 366 aa, Triticum aestivum
MSDGKDTLDLSALGAAVPNAAELSAEDKANLVESIKNTLQGLAARHTDVLESLEPKVRKRVEALREIQSQHDEFEAKFFEERAALEAKYQKMYEPLYSKRHDVVNGVVEAEGVTKDSGEAAPDEKEEKGVPDFWLNAMKNHEILAEEIQERDEEALKYLKDIKWYRITEPKGFKLEFHFNTNPFFKNEVLSKTYHMIDEDEPILEKAIGTEIEWYPGKSLTQKVLKKKPKKGSKNTKPITKIENCESFFNFFSPPQVPDDDEEIDEDTAEQLQNQMEQDYDIGSTIRDKIIPHAVSWFTGEAAQDEDFDGIMDDDEDDDEDDEEDEDEDEDDEEDEDDDDGDKKKGGRVPAGEGQAGERPAECKQQ

SEQ ID NO: 2721 - protein, 365 aa, Leymus cinereus x Leymus triticoides
  misc_feature (72)..(72): Xaa can be any naturally occurring amino acid
  misc_feature (75)..(75): Xaa can be any naturally occurring amino acid
  misc_feature (129)..(129): Xaa can be any naturally occurring amino acid
  misc_feature (142)..(142): Xaa can be any naturally occurring amino acid
MSDGKDTLDLSALGAAVPNAAELSAEDKANLVESIKNTLQGLAARHTDVLESLEPKVRKRVEALREIQSQHXEFXAKFFEERAALEAKYQKMYEPLYSKRHDVVNGVVEVEGVTKDDSGEAAADQKEEXGVPDFWLNAMKNXEILAEEIQERDEEALKYLKDIKWYRISEPKGFKLEFHFNTNPFFKNEVLTKTYHMIDEDEPILEKAIGTEIEWYPGKSLTQKVLKKKPKKGSKNTKPITKIENCESFFNFFSPPQVPDDDEEIDEDTAEQLQNQMEQDYDIGSTIRDKIIPHAVSWFTGEAAQDEDFDGIMDDDEDDDEDEDEDEDEDDEEDEDDDDGDKKKGGRVPAGEGQQGERPAECKQQ

SEQ ID NO: 2722 - protein, 181 aa, Triticum aestivum
MSDGKDTLDLSALGAAVPNAAELSAEDKANLVESIKNTLQGLAARHTDVLESLEPKVRKRVEALREIQSQHDEFEAKFFEERAALEAKYQKMYEPLYSKRHDVVNGVVEAEGEAAEDQKEEVGVPDFWLNAMKNHEILAEEIQERDEEALKYLKDIKWYRITEPKGFKLEFPLQYQSILQE

SEQ ID NO: 2723 - protein, 329 aa, Pennisetum glaucum
RGIWTCLITSSPRSGSALRSSERSRANMMNLRQSFFEERAALEAKYQKLYEPLYSKRYEIVNGVIEVEGVSKESAAETPAEKSGDENPAEQKEEKGVPAFWLNAMKNHEILAEEIQERDEEALKYLKDIKWYRISEPKGFKLEFYFDTNPFFKNSVLTKTYHMIDEDEPILEKAIGTEIEWLPGKCLTQKVLKKKPRKGSKNTKPITKTEDCESFFNFFSPPQVPDDEEEIDEDTAEQLQNQMEQDYDIGSTIRDKIIPHAVSWFTGEAAQDDDFEGLIDGDEDDDEDDEDDEDDEDEESEDDSDTKKTKGAAGGEGQQGERPAECKQQ

SEQ ID NO: 2724 - protein, 70 aa, Zea mays
MSDWGPVVIGLVLFVLLSPGLLVQLPGRHHLVEFGNLKTSAVSILVHSIIYFALITLFVIVIGVHITTGD

SEQ ID NO: 2725 - protein, 70 aa, Zea mays
MSDWGPVVIGLVLFVLLSPGLLVQLPGRHHLVEFGNLKTSAVSIVVHSIIYFALITLFVIVIGVHITTGD

SEQ ID NO: 2726 - protein, 70 aa, Pennisetum glaucum
MSDWGPVVIAVVLFVLLSPGLLFQLPGRCNFIDFGNLHTSAVSILVHSIIFFALIAIFVIVIGVHITTGD

SEQ ID NO: 2727 - protein, 74 aa, Panicum virgatum
MSDWGPVVIAVVLFVLLSPGLLFQLPGRCSFVDFGNLHTSAASIVVHSIIFFALITIFVIVVGVHITTGDQSAY

SEQ ID NO: 2728 - protein, 137 aa, Saccharum officinarum
MACLLRAAAVLALLMAVSVAALSAPVSAGGVAVGDLAAHLAGAVVIRRGGRTCRGTVGECMEYFGADAEGEADVAGMATGGSKRRVLQGGSGYIGYDALRRDNVPCSQRGASYYNCQPGAEANPYSRGCSAITQCRG

SEQ ID NO: 2729 - protein, 131 aa, Zea mays
MARLLRAAAGLALLLAVLAPAASAGGDLAQLGAAVVTRRGGGRTTCRGGTVGECMEYLDVDAEGEADVAGMATGGGKRRVLQGGSGYIGYDALRRDNVPCSQRGASYYNCQPGAEANPYSRGCSAITQCRG

SEQ ID NO: 2730 - protein, 142 aa, Sorghum bicolor
MAPRLQLRAAAVLALLMAVVSVAALSAAPASAAGVAVGDLAVAHLAGAVVIRRGGRTCRGTVGECMEYLGADAEGEADVAGMATGGSKRRVLQGGSGYIGYDALRRDNVPCSQRGASYYNCQPGAEANPYSRGCSAITQCRG

SEQ ID NO: 2731 - protein, 135 aa, Setaria italica
MARLLRAAAFLLLAVLAVALAALPAPASAGAGDLASELLVVRRGSSGGRACRGTVGECMEYADVDAEGEGDVAGMATGGSKRRVLQGGSGYIGYDALRRDNVPCSQRGASYYNCQPGAEANPYSRGCNAITQCRG

SEQ ID NO: 2732 - protein, 136 aa, Pennisetum glaucum
MARMLRAAAFLLLAALAVALAALPAPASAGGVSGDLLAGHLVVRRGSGGGRACRGTVGECMAEDVDGEGEGDVAGMATGGSKRRVLQGGSGYIGYDALRRDNVPCSQRGASYYNCQPGAEANPYTRGCSAITQCRG

SEQ ID NO: 2733 - protein, 225 aa, Phaseolus coccineus
MATVTFSFSAKTLTLPYHPKTPISNFYPITNLRFPSSIVTRTRNGNRIRASLDGDFSSKRSSSSNNSDQRETIMLPGCDYNHWLIVMEFPKDPAPTREQMIDTYLDTLATVLGSMEEAKKNMYAFSTTTYTGFQCTVDEATSEKFKGLPGVLWVLPDSYIDVKNKDYGGDKYVNGEIIPCKYPTYQPKRSAPKNESRRYERRRDGPPPDRRRPRQEAAASDSSST

SEQ ID NO: 2734 - protein, 222 aa, Glycine max
MATVTFSFSAKTLTLPYHPKTSISSFAPVTNLRLSHSIVTRTRNCNRIRAALDGDFSAKRSNNNEQRETIMLPGCDYNHWLIVMEFPKDPAPTREQMIDTYLDTLATVLGSMEEAKKNMYAFSTTTYTGFQCTVDEATSEKFKGLPGVLWVLPDSYIDVKNKDYGGDKYINGEIIPCKYPTYQPKRSAPKNESRRYERRRDGPPPDRRRPRQEAAASDSSST

SEQ ID NO: 2735 - protein, 222 aa, Cajanus cajan
MATVTFSFSAKTLTPPYHPKTPISSFTPVTNLRLPHSMVTRTRNPIRIRATLDGDFSAKRSSSSEQRETIMLPGCDYNHWLIVMEFPKDPAPTREQMIDTYLETLATVLGSMEEAKKNMYAFSTTTYTGFQCTVDEATSEKFKGLPGVLWVLPDSYIDVKNKDYGGDKYINGEIIPCKYPTYQPKRSGPKNESKRYERRRDGPPPDRRRPRQEAAASDSSST

SEQ ID NO: 2736 - protein, 225 aa, Vigna unguiculata
MATVTFSFSAKTLTLTLPYKPKTPISNFYKVTNVRLRSSIVTQTRIGNRIRASLDGDFSAKRSSSNSDQRETIMLPGCDYNHWLIVMEFPKDPAPTREQMIDTYLDTLATVLGSMEEAKKNMYAFSTTTYTGFQCTVDEATSEKFKGLPGVLWVLPDSYIDVKNKDYGGDKYVNGEIIPCKYPTYQPKRSAPKNESRRYERRRDGPPPDRRRPRQEAAASDSSST

SEQ ID NO: 2737 - protein, 221 aa, Glycyrrhiza uralensis
MTTINLTFSAKTLTLPHHPKTPILNFNRVPPHSIRARTRTRNPIRIRAVLDEDYSSKRSSSSEQRETIMLPGCDYNHWLIVMEFPKDPAPTREQMIDTYLQTLATVLGSMEEAKKNMYAFSTTTYTGFQCTVDEATSEKFKGLPGVLWVLPDSYIDVKNKDYGGDKYINGEIIPCKYPTYQPKRSGSKNESRRYERRRDGPPAERQRPRRQETAASDSSSS

SEQ ID NO: 2738 - protein, 225 aa, Arachis hypogaea
MATVTFSLSAKTLTLPSHPKTPIFNQVKNVGFLRRVPSSGSVVGRRKSVILGALDGEYSSKRSSSSEQRETIMLPGCDYNHWLIVMEFPKDPAPTREQMIDTYLNTLASVLGSMEEAKKNMYAFSTTTYTGFQCTVDEATSEKFKGLPGVLWVLPDSYIDVKNKDYGGDKYINGEIIPCKYPTYQPKRSSGPKNESRRYERRRDGPPPERRRPRQEAAASDSAST

SEQ ID NO: 2739 - protein, 225 aa, Arachis hypogaea
MATVTFSLSAKTLTLPSHPKTPIFNQVKNVGYLRRVPSSGSVVGRRKSVILGALDGEYSSKRSSSSEQRETIMLPGCDYNHWLIVMEFPKDPAPTREQMIDTYLNTLASVLGSMEEAKKNMYAFSTTTYTGFQCTVDEATSEKFKGLPGVLWVLPDSYIDVKNKDYGGDKYINGEIIPCKYPTYQPKRSSGPKNESRRYERRRDGPPPERRRPRQEAAASDSAST

SEQ ID NO: 2740 - protein, 231 aa, Lotus japonicus
MATITFSFSAKTLTLPFHSKTPSLFNFFNPSLNFNRVAPRSIRAVTRARNPTRIRAALDEDYSAKRSSSSEQRETIMLPGCDYNHWLIVMEFPKDPAPSREQMIETYLFTLSTVLGSMEEAKKNMYAFSTTTYTGFQCTVDEATSEKFKGLPGVLWVLPDSYIDVKNKDYGGDKYINGEIIPSKYPTYQPKRSGGSRNDSRRYERKRDGPPTDRRRPKQEAETTSKDSSST

SEQ ID NO: 2741 - protein, 254 aa, Hordeum vulgare
MAAPRPTVLVTGAGGRTGQIVFNKLRERSDQFAARGLVRSEESKQKIGGADDVFVADIREAGHLAPAVQGADALVILTSASPKMKPGFDPTKGGRPEFYYDHGAYPEQVDWIGQKNQIDAAKAAGVKHIVLVGSMGGTNPNHPLNSLGNGNILVWKRKSEQYLADSGVPYTIIRPGGLQDKDGGVRELIVGKDDELLQTDTKAIPRADVAEVCVQALQYEEVKFKAFDLASKPEGEGTPTKDFKALFSQVTARF

SEQ ID NO: 2742 - protein, 254 aa, Triticum aestivum
MAAPRPTVLVTGAGGRTGQIVFNKLRERSDQFAARGLVRSEESKHKIGGADDVYVADIREADHLAPAVQGADALIILTSASPKMKPGFDPTKGGRPEFYYEDGAYPEQVDWIGQKNQIDAAKAAGVKHIVLVGSMGGTNPNHPLNNLGNGNILVWKRKSEQYLADSGVPYTIIRPGGLQDKDRGVRELIVGKDDELLQTDTKAIPRADVAEVCVQALQYEEVKFKAFDLASKPEGEGTPTKDFKALFSKVTARF

SEQ ID NO: 2743 - protein, 257 aa, Avena sativa
MADSAAPRPTVLVTGAGGRTGQLVFNKLKERSDQFAARGLVRTEESKQKIGGADDVYVADIREADHLAPAVQGVDALVILTSASPKMKPGFDPTKGGRPEFYYEDGAYPEQVDWIGQKNQIDAAKAAGVKHIVLVGSMGGTNPNHPLNSLGNGNILVWKRKSEQYLADSGVPYTIIRPGGLQDKDGGVRELIVGKDDELLQTDTKAIPRADVAEVCVQALQYEEVKFKAFDLASKPEGVGTPTKDFKALFSQVTARF

SEQ ID NO: 2744 - protein, 257 aa, Festuca arundinacea
  misc_feature (118)..(118): Xaa can be any naturally occurring amino acid
MADSAAPRPTVLVTGAGGRTGHLVFSKLKERSDQFSARGLVRTEESKQKIGGADDVYVADIREADHLAPAVQGVDALVILTSASPKMKPGFDPTKGGRPEFYYEDGAYPEQVDWIGQXNQIDAAKAAGVKHIVLVGSMGGTNPNHPLNSLGNGNILIWKRKSEQYLADSGVPYTIIRPGGLQDKDGGVRELIVGKDDELLQTDTKAIPRADVAEVCVQALQYEEVKFKAFDLASKPEGVGTPTKDFKALFSQVTARF

SEQ ID NO: 2745 - protein, 257 aa, Brachypodium distachyon
MADPAAPRSTVLVTGAGGRTGQIVFNKLKERSDQFVARGLVRTEESKQKIGGADDVYVADIREADSVVPAVQGVDALVILTSATPKMKPGFDPSKGGRPEFYYEDGAYPEQVDWIGQKNQIDAAKAAGVKHIVLVGSMGGTNPNHPLNSLGNGNILVWKRKSEQYLADSGVPYTIVRPGGLQDKDGGVRELIVGKDDELLQTDTKAIPRADVAEVCVQALQYEETKFKAFDLASKPEGVGTPTKDFKALFSQVTSRF

SEQ ID NO: 2746 - protein, 257 aa, Cynodon dactylon
MADTAAPRPTVLVTGAGGRTGQIVYNKLKERSEQFVARGLVRSEESKQKIGGADDVYIADIRDAGRLAPAVQGADALIILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVPYTIIRPGGLQDKDGGLRELIVGKDDELLQTETKAIPRADVAEVCVQALQYEEAKFKAFDLASKPEGVGTPTKDFKALFSQITTRF

SEQ ID NO: 2747 - protein, 257 aa, Pennisetum glaucum
MAESAAPRPTVLVTGAGGRTGHIVYTKLKERSEQFIARGLVRTEESKQKIGGADDVYIADIRDADHIAPAVQGADALVILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVPYTIIRPGGLQDKDGGVRELVVGKDDELLQTDTKSIPRADVAEVCVQALQYEEAKLKAFDLASKPEGVGTPTKDFRALFSQITARF

SEQ ID NO: 2748 - protein, 257 aa, Setaria italica
MADSAAPRPTVLVTGAGGRTGHIVYNKLKERSEQFIARGLVRTEESKQKIGGADDVYIADIRDADHLVPAVQGADALIILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVPYTIIRPGGLQDKDGGVRELVVGKDDELLQTDTKSIPRADVAEVCVQALQYEEAKFKAFDLASKPEGVGTPTKDFRALFSQIMARF

SEQ ID NO: 2749 - protein, 257 aa, Saccharum officinarum
MADSAASRPTVLVTGAGGRTGQIVYNKLKERSEKFVARGLVRTEESKQKIGGASDVYIADIRDADRLAPAVQGVDALIILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVPYTIIRPGGLQDKDGGVRELIVGKDDELLQTDTKSIPRADVAEVCVQALQYEEAKFKAFDLASKPEGVGTPTKDFRALFSQVTARF

SEQ ID NO: 2750 - protein, 257 aa, Panicum virgatum
MADSTAPRPTVLVTGAGGRTGHIVYNKLKERSEQFVARGLVRTEESKQKIGGADDVYIADIRDADRLAPAVQGADALIILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVLYTIIRPGGLQDKDGGVRELIVGKDDELLQTDTKSIPRADVAEVCVQALQYEEAKFKAFDLASKPEGVGTPTKDFRALFAQITARF

SEQ ID NO: 2751 - protein, 257 aa, Sorghum bicolor
MADSAASRPTVLVTGAGGRTGQIVYNKLKERSEQFVARGLVRTEESKQKIGGASDVYIADIRDTDRLAPAVQGVDALIILTSAVPKMKPGFDPSKGGRPEFYYEDGMYPEQVDWVGQKNQIDAAKAAGVKHIVLVGSMGGTNPNHPLNSLGNGNILVWKRKAEQYLADSGVPYTIIRPGGLQDKDGGVRELIVGKDDELLQTDTKSIPRADVAEVCVQALQYEEAKFKAFDLASKPEGVGTPTKDFRALFSQITARF

SEQ ID NO: 2752 - protein, 257 aa, Cenchrus ciliaris
  misc_feature (71)..(71): Xaa can be any naturally occurring amino acid
MADSAAPRPTVLVTGAGGRTGHIVYNKLKERCDQFIARGLVRTEESKQKIGGADDVYIADIRDADHIVPAXQGADALIILTSAVPKMKPGFDPSKGGRPEFYYEDGMYPEQVDWIGQKNQIDAAKAAGVKHIVLVGSMGGTNPNHPLNQLGNGNILVWKRKAEQYLADSGVPYTIIRPGGLQDKDGGVRELVVGKDDELLQTDTKSIPRADVAEVCVQALQYEEAKLKAFDLASKPEGVGTPTKDFRALFSQITARF

SEQ ID NO: 2753 - protein, 230 aa, Pseudoroegneria spicata
  misc_feature (10)..(11): Xaa can be any naturally occurring amino acid
  misc_feature (207)..(207): Xaa can be any naturally occurring amino acid
LKERSDQFAXXGLVRSEESKQKIGGADDVYVADIREAEHLAPAVQGADALVILTSASPKMKPGFDPTKGGRPEFYYEDGAYPEQVDWIGQKNQIDAAKAAGVKHIVLVGSMGGTNPNHPLNSLGNGNILVWKRKSEQYLADSGVPYTIIRPGGLQDKDGGVRELIVGKDDELLQTDTKAIPRADVAEVCVQALQYEEVKFKAFDLTXKPEGEGIPTKDFKALFSQVTARF

SEQ ID NO: 2754 - protein, 257 aa, Oryza sativa
MADSSAARPTVLVTGAGGRTGNIVYNKLKERSDQFVVRGLVRTEESKQKIGGGNDVYIADIRDRDHLVPAVQGVDALIILTSAVPKMKPGFDPSKGGRPEFYYEDGMYPEQVDWIGQKNQIDTAKAAGVKHIVLVGSMGGTNPNHPLNSLGNGNILVWKRKSEQYLADSGVPYTIIRPGGLQDKDGGVRELIVGNDDELLQTDTKSIPRADVAEVCVQALQYEETKFKAFDLASKPEGTGTPTKDFKSLFSQVTARF

SEQ ID NO: 2755 - protein, 290 aa, Triticum aestivum
MAAPRPTVLVTGAGGRTDTLSLLPSPPVSPTKTRRIRLPRRAIPVLTLVESIAGQIVFSKLRERSDQFAARGLVRSEESKQKIGGADDVYVADIREAEHLAPAVQGADALVILTSASPKMKPGFDPTKGGRPEFYYEDGAYPEQVDWIGQKNQIDAAKAAGVKHIVLVGSMGGTNPNHPLNSLGNGNILVWKRKSEQYLADSGVPYTIIRPGGLQDKDGGVRELIVGKDDELLQTDTKAIPRADVAEVCVQALQYEEVKFKAFDLASKPEGEGTPTKDFKALFSQVTARF

SEQ ID NO: 2756 - protein, 257 aa, Zea mays
MADSATSRPTVLVTGAGGRTGQIVYNKLKERSEQFVARGLVRTEESKQKIGAAGDVYVADIRDADRLAPAVQGVDALIILTSAAPKMKPGFDPSKGGRPEFYYEDGMYPEQVDWVGQKNQIDAAKAAGVKHIVLVGSMGGTNPNHPLNSMGNGNILVWKRKAEQYLADSGIPYTIIRPGGLQDKDGGVRELLVGKDDELLQTDTKSIPRADVAEVCVQALQYEEAKFKAFDLASKPEGVGTPTKDFRALFSQITARF

SEQ ID NO: 2757 - protein, 242 aa, Pennisetum glaucum
AGGRTGHIVYTKLKERSEQFIARGLVRTEESKQKIGGADDVYIADIRDADHIAPAVQGADALVILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVPYTIIRPGGLQDKDGGVRELVVGKDDELLQTDTKSIPRADVAEVCVQALQYEEAKLKAFDLASKPEGVGTPTKDFRALFSQITARF

SEQ ID NO: 2758 - protein, 244 aa, Panicum virgatum
MADSAAPRPTVLVTGAGGRTGHIVYNKLKERSEQIVARGLVRSEESKQKIGGADDVYIADIRDADRLAPAVQGADALIILTSAVPKMKPGFDPSKGGRPEFYYEDGMYPEQVDWIGQKNQIDAAKAAGVKHIVLVGSMGGTNPNHPLNSLGNGNILVWKRKAEQYLADSGVPYTIIRPGGLQDKDGGVRELIVGKDDELLQTDTKSIPRADVAEVCVQALQYEEAKFKAFDLASKPESVGTPTK

SEQ ID NO: 2759 - protein, 255 aa, Cucumis melo
MADSAPPTVLVTGAGGRTGQIVYKKLKERSDQYAARGLVRTEESKQGIGGADDLFVGDIRDADSLGPAIQGIDALIILTSAVPKMKPGFDPTKGGRPEFYFEDGAYPEQVDWIGQKNQIDAAKAAGVKQIVLVGSMGGTNINHPLNSLGNGNILVWKRKAEQYLADSGIPYTIIRAGGLQDKDGGIRELLVGKDDELLQTETRTIARADVAEVCIQALQFEEAKFKAFDLASKPEGVGTPTKDFKALFSQVTTRF

SEQ ID NO: 2760 - protein, 255 aa, Cajanus cajan
MADSSPKTVLVTGAGGRTGQIVYKKLKERSNLYVTRGLVRTQESKQKIGGADDVFVGDIRDAGSITPALQGTDALIILTSAVPQMKPGFDPTKGGRPEFYYADGAYPEQVDWIGQKNQIDAAKDAGVKHIVLVGSMGGTNPNHPLNSLGNGNILIWKRKAEQYLADSGVPYTIIRPGGLLDKEGGLRELIVGKDDELLQTETKAIPRADVAEVCVQALNFEEVKFKAFDLASKPEGEGTPTKNFKALFSQITARF

SEQ ID NO: 2761 - protein, 255 aa, Cucumis sativus
MADSAPPTVLVTGAGGRTGQIVYKKLKERSDHYAARGLVRTEESKQSIGGADDLFVGDIRDADSLGPAIQGIDALIILTSAVPKMKPGFDPTKGGRPEFYFEDGAYPEQVDWIGQKNQIDAAKAAGVKQIVLVGSMGGTNINHPLNSLGNGNILVWKRKAEQYLADSGIPYTIIRAGGLQDKDGGIRELLVGKDDELLQTETRTIARADVAEVCIQALQFEEAKFKALDLASKPEGVGTPTKDFKALFSQVTTRF

SEQ ID NO: 2762 - protein, 255 aa, Manihot esculenta
MADSRPSTVLVTGAGGRTGSIVYRKLKERSGQYVARGLVRTEESKEKIGGAKDVYVGDIREAESIAPAIQGIDALIILTSAVPKMKHGFDPSKGERPEFYYEDGAYPEQVDWIGQKYQIDAAKDAGVKHIVLVGSMGGTNPNNPLNSLGNGNILIWKRKAEQYLADSGIPYTIIRAGGLQDKEGGIRELLVGKDDELLQTETRTIARADVAEVCIQALQFEEAKFKAIDLASKPEGTGTPTKDFKALFSQVTARF

SEQ ID NO: 2763 - protein, 250 aa, Lotus japonicus
MAPSTVLVTGAGGRTGQIVYKTLKERQYVARGLVRTEESKQKIGGADDVFIGDIRDAGSIVPAIQGIDALIILTSATPKMKPGFDPTKGGRPEFYFDDGAYPEQVDWIGQKNQIDAAKAAGVKRVVLVGSMGGTNLNHPLNSLGNGNILVWKRKAEQYLADSGIPYTIIRPGGLLDKDGGLRELILGKDDELLQTETKTIPRADVAEVCVQALNYEETQFKAFDLASKPEGVGTPTKDFKALFSQITSRF

SEQ ID NO: 2764 - protein, 255 aa, Medicago truncatula
MAGSSQTTVLVTGAGGRTGQIVYKKLKEKRDQYIARGLVRSEESKQKIGGADDIFLGDIRNAESIVPAIQGTDALIILTSAVPQMKPGFDPTKGGRPEFYFDDGAYPEQVDWIGQKNQIDAAKAAGVKHIVLVGSMGGTNPNHPLNSLGNGNILVWKRKAEEYLSNSGVPYTIIRPGGLLDKEGGVRELIVGKDDELLQTETKTIPRADVAEVCVQVLNYEETKLKAFDLASKPEGAGEPTKDFKALFSQLTSRF

SEQ ID NO: 2765 - protein, 255 aa, Arachis hypogaea
MAASSPITVLVTGAGGRTGQIVYRKLKEKPNQFVARGLVRTEESKQKIGGDDDVFVGDIRDAASIVPAIQGIDSLIILTSAVPLMKPGFDPTKGQRPEFYFDDGAYPEQVDWIGQKNQIDAAKAAGVKHIVLVGSMGGTNPNHPLNSLGNGNILVWKRKAEQYLADSGVPYTIIRAGGLLDKDGGLRELIVGKDDELLQTETKTIPRADVAEVCIQAVNYEEAKFKAFDLASKPEGVAAPTKDFKALFSRITTRF

SEQ ID NO: 2766 - protein, 255 aa, Arachis hypogaea
MAASSPITVLVTGAGGRTGQIVYRKLKEKPNQFVARGLVRTEESKQKIGGADDVFVGDIRDAASIVPAIQGIDSLIILTSAVPLMKPGFDPTKGQRPEFYFDDGAYPEQVDWIGQKNQIDAAKEAGVKHIVLVGSMGGTNPNHPLNSLGNGNILVWKRKAEQYLADSGVPYTIIRAGGLLDKDGGLRELIVGKDDELLQTETKTIPRADVAEVCIQAVNYEEAKFKAFDLASKPEGVAAPTKDFKALFSRITTRF

SEQ ID NO: 2767 - protein, 255 aa, Capsicum annuum
MADLSINTVLVTGAGGRTGSIVYKKLKERSEKYTARGLVRTEESKQKICGADDVYIGDIRNTESLVPAIQGIDALVILTSAVPKMKPGFDPTKGGRPEFYFEDGANPEQVDWIGQKNQIDAAKAAGVKQIVLVGSMGGTNPNHPLNSLGNGNILIWKRKAEQYLADSGIPYTIIRAGGLQDKEGGIRELLVGKDDELLQTETKTVARADVAEVCIQALQYEEAKFKAFDLASKPEGTGTPTKDFKALFAQITTRF

SEQ ID NO: 2768 - protein, 229 aa, Cucumis melo
  misc_feature (156)..(156): Xaa can be any naturally occurring amino acid
MADSAPPTVLVTGAGGRTGQIVYKKLKERSDQYAARGLVRTEESKQGIGGADDLFVGDIRDADSLGPAIQGIDALIILTSAVPKMKPGFDPTKGGRPEFYFEDGAYPEQVDWIGQKNQIDAAKAAGVKQIVLVGSMGGTNINHPLNSLGNGNILVXKRKAEQYLADSGIPYTIIRAGGLQDKDGGIRELLVGKDDELLQTETRTIARADVAEVCIQALQFEEAKFRHSI

SEQ ID NO: 2769 - protein, 256 aa, Zingiber officinale
  misc_feature (125)..(127): Xaa can be any naturally occurring amino acid
  misc_feature (252)..(252): Xaa can be any naturally occurring amino acid
MADASSRITVLVTGAAGRTGQIVFKKLKERSDQFIARGLVRTEESKEKIGGADDIFVADIRDDKAIVPAVQGIDALIILTSAVPKMKPGFDPSKGGRPEFYFEDGLYPEQVDWIGQKNQIDAAKXXXVKHIVLVGSMGGTNPNHPLNSLGNGNILVWKRKAEQYLAESGVPYTIIRPGGLLDKDGSQRELVVGKDDELLQTETKSIPRADVAEVCIQALLNEETKFKAFDLASKPEGAGTATKDFKSLFSQXTARF

SEQ ID NO: 2770 - protein, 255 aa, Arachis hypogaea
MAASSPITVLVTGAGGRTGQIVYRKLKEKPNQFVARGLVRTEESKQKIGGDDDVFVGDIRDAASIVPAIQGIDSLIILTSAVPLMKPGFDPTKGQRPEFYFDDGAYPEQVDWIGQKNQIDAAKEAGVKHIVLVGSMGGTNPNHPLNSLGNGNILVWKRKAEQYLADSGVPYTIIRAGGLLDKDGGLRELIVGKDDELLQTETKTIPRADVAEVCIQAVNYEEAKFKAFDLASKPEGVAAPTKDFKALFSRITTRF

SEQ ID NO: 2771 - protein, 255 aa, Castanea mollissima
MADLAPSTVLVTGAGGRTGQIVYKKLKERSEQYVARGLVRTEESKEKIGGADDVFVGDIRDAGSLVPAIQGIDALVILTSAVPKMKPGFDPSKGGRPEFYFEDGAYPEQVDWIGQKNQIDAAKAAGVKQIVLVGSMGGTDLNNPLNSLGNGNILVWKRKAEQYLADSGVPYTIIRAGGLQDKEGGIRELLIGKDDELLKTDTRTIARADVAEVCLQALQFEEAKFKAFDLSSKPEGAGTPTKDFKALFAQITTRF

SEQ ID NO: 2772 - protein, 255 aa, Unknown
  Sequence found in Organisms: Solanum tuberosum, Solanum phureja
MADLNTSTVLVTGAGGRTGSIVYKKLKERSENYTARGLVRTEESKQKIGGADDVYIGDIRNTESLIPAIQGIDALVILTSAVPKMKPGFDPTKGGRPEFYFEDGANPEQVDWIGQKNQIDAAKAAGVKQIVLVGSMGGTNPNHPLNSLGNGNILIWKRKAEQYLADSGIPYTIIRAGGLQDKEGGIRELLVGKDDELLETDTKTVARADVAEVCIQALQYEEAKFKAFDLASKPEGTGTPTKDFKTLFAQIATRF

SEQ ID NO: 2773 - protein, 328 aa, Cleome gynandra
MMILACPVVAPVTGYKSGIMASSSVSARRSPSLSCSSSSSSLRYSSLVSDPKSCSIRRNCVVKYRRVSVVVAAAAISEPRTVLVTGAGGRTGQIVYRKLKERPDQFVARGLVRTNESKEKIGGEDDVYVGDIRDVAAIAPAVQGIDALIILTSAVPQMKPGFDPTKGGRPEFYFEDGAYPEEVDWIGQKNQIDAAKAAGVKQIVVVGSMGGTNPNHPLNSIGNGNILVWKRKAEQYLADSGIPYTIIRAGGLQDKEGGIRELLVGKDDELLETDTRTIARADVAEVCVQALQFEEAKYKALDLASKPEGTGTPTKDFKALFAQVTTRF

SEQ ID NO: 2774 - protein, 328 aa, Cleome spinosa
METMMTLVSPPVVPVSGYKSGIVTCSSVSVHRSPSLSCLSSLRSGSSVWDLKSCSGRRKCVAKFSRMSVVVAAAAIAEPRTVLVTGAGGRTGQIVYTKLKERPDQFVARGLVRTDESKEKIGGEDDVYVGDIRDAAAIAPAVQGIDALIILTSAVPKMKPGFDPTKGGRPEFYFEDGAYPEQVDWIGQKNQIDAAMAAGVKQIVLVGSMGGTNLNNPLNSIGNGNILVWKRKAEQYLADSGVPYTIVRAGGLQDKEGGIRELLVGKDDELLETDTRTIARADVAEVCIQALQLEEAKNKAIDLASKPEGTGTPTKDFKSLFAQVTSRF

SEQ ID NO: 2775 - protein, 255 aa, Solanum melongena
MADLNTSTVLVTGAGGRTGSIVYKKLKERSEKYMARGFVRTEESKQKIGGADDVYIGDIRNSESLVPAVQGIDALVILTSAVPKMKPGFDPSKGGRPEFYFEDGAYPEQVDWIGQKNQIDAAKAAGVKQIVLVGSMGGTNPNHPLNSLGNGNILIWKRKAEQYLADSGIPYTIIRAGGLQDTEGGIRELLVGKDDELLATETKTVTRADVAEVCIQALQYEEAKFKAFDLASKPEGSGTPTKDFKSLFAQITTRF

SEQ ID NO: 2776 - protein, 255 aa, Helianthus annuus
MAESNRTTVLVTGAGGRTGQLVYKKLKERSGEYIARGFVRSEESKQKIGGADDVLIGDITNAATLEPAIQGTDAIVILTSAVPKMKPGFDPTKGGRPEFYFEEGAYPEQVDWEGQKNQIDAAKAAGVKHIVLVGSMGGTNLNHPLNSLGNGNILVWKRKAEQYLADSGIPYTIIRAGGLQDKEGGIRELLVGKDDELLQTETKTIARADVAEVCIQALQFEEAKFKAFDLASKPEGSGTPTKDFKSLFAQITSRF

SEQ ID NO: 2777 - protein, 255 aa, Eucalyptus grandis
MAAAPPPTVLVTGAGGRTGQIVYKKLKERPDQFVARGLVRTEESKGKIEGADDVYVGDIRDAGSILPAIQGTDFLVILTSAVPKMKPGFDPTKGGRPEFYFEEGAYPEQVDWLGQKNQIDAAKAAGVKQIVLVGSMGGTNLNHPLNSLGNGNILVWKRKAEQYLADSGIPYTIIRAGGLQDKEGGVRELIVGKDDELLQTPTRTITREDVAEVCIQALQFEESKYKALDLASKPEDSGTPTKDFKALFASVTTKF

SEQ ID NO: 2778 - protein, 255 aa, Manihot esculenta
MADSRPTTVLVTGAGGRTGSIVYKKLKERSDEYVARGLVTTQDSKEKIGGAEDVFVGDIREAESITPAFQGIDALIILTSAVPKMKPGFDPSKGGRPEFYYEDGAYPEQVDWIGQKNQIDAAKAVGVKQIVLVGSMGGTNPNHPLNSLGNGNILIWKRKAEQYLADSGIPYTIIRAGGLQDKEGGVRELLVAKDDVLLQTDTKSITRSDVAEVCIQALAFEEAKFKAFDLASKPEGTGTPTKDFKALFAQVTSRF

SEQ ID NO: 2779 - protein, 255 aa, Aristolochia fimbriata
MATSSLPTVLVTGAGGRTGQIVYKKLKEKTDQFIAKGLVRTEESKEKIGGADDVYVGDIRNADSIAPAIQGIDALIILTSAVPKMKPGFDPSAGGRPEFYFEDGAYPEQVDWVGQKNQIDAAKAVGVKQIVLVGSMGGTNLNHPLNSLGNGNILVWKRKSEQYLADSGIPYTIIRAGGLQDKEGGVRELVVGKDDELLQTEIRTIARADVAEVCIQALLIEESKFKAFDLASKPEGTGTPTNDFKTLFSQITTRF

SEQ ID NO: 2780 - protein, 252 aa, Artemisia annua
MAESNRSTVLVTGAGGRTGQIVYKKLKERSSEFTARGLVRSEESKSKIGGADDVFIGDITKPETLAPAIGGIDALVILTSAVPKMKPGFDPTKGGRPEFYFEDGQYPEQVDWEGQKSQIDAAKAAGVKQIVLVGSMGGTNINHPLNSLGNGNILVWKRKAEQYLADSGIPYTIIRAGGLQDKEGGIRELLIGKDDELLQTETKTVASAEVCVQALQIEEAKFKAFDLASKPEGTGTPTKDFKALFSQITTRF

SEQ ID NO: 2781 - protein, 255 aa, Eucalyptus grandis
MAAAPPPTVLVTGAGGRTGQIVYKKLKERPDQFVARGLVRTEESKGKIEGADDVYVGDIRDAGSILPAIQGTDFLVILTSAVPKIKPGFDPTKGGRPEFYFEEGAYPEQVDWLGQKNQIDAAKAAGVKQIVLVGSMGGTNLNHPLNSLGNGNILVWKRKAEQYLADSGIPYTIIRAGGLQDKEGGVRELIVGKDDELLQTPTRTITREDVAEVCIQALQFEESKYKALDLASKPEDSGTPTKDFKALFASVTTKF

SEQ ID NO: 2782 - protein, 255 aa, Quercus alba
MADLAPSTVLVTGAGGRAGQIVYKKLKERSEQYVARGLVRTEESKEKIGGADDVFVGDIRDAGSLVPAIQGVDALVILTSAVPKMKPGFDPSKGERPEFYFEDGAYPEQVDWIGQKNQIDAAKAAGVKQIVLVGSMGGTDLNNPLNSLGNGNILVWKRKAEQYLADSGVPYTIIRAGGLQDKEGGIRELLIGKDDELLKTDTRTIARADVAEVCLQALQFEEAKFKAFDLSSKPEGAGTPTKDFKALFAQITTRF

SEQ ID NO: 2783 - protein, 255 aa, Quercus alba
MADLAPSTVLVTGAGGRTGQIVYKKLKERSEQYVARGLVRTEESKEKIGGAEDVFVGDIRDVGSLVPAIQGIDALVILTSAVPKMKPGFDPSKGGRPEFYFEDGAYPEQVDWIGQKNQIDAAKAAGVKQIVLVGSMGGTDLNNPLNSLGNGNILVWKRKAEQYLADSGVPYTIIRAGGLQDKEGGIRELLIGKDDELLKTDTRTIARADVAEVCLQALQFEEAKFKAFDLSSKPEGAGTPTKDFKALFAQITTRF

SEQ ID NO: 2784 - protein, 323 aa, Brassica napus
MAMTTTTLFHALVPSTTYKPGAVSSSFVSVPSSSPSLQFRSLVSDTTSIYGRRKFTGNLRRVSLTVSAAAAAEPLTVLVTGAGGRTGQIVYKKLKERSDQFVARGLVRTKESKEKIGGEDEVFVGDIRDPEAIAPAVQGIDALVILTSAVPKMKPGFDPSKGERPEFYFEEGAYPEQVDWIGQKNQIDAAKAAGVKQIVLVGSMGGTNINNPLNSIGNANILVWKRKAEQYLADSGIPYTIIRAGGLQDKEGGIRELIVGKDDEILETEMRTIARADVAEVCVQALQLEEAKFKALDLASKPEGTGTPTKDFKALFAQVTARF

SEQ ID NO: 2785 - protein, 173 aa, Petunia hybrida
MADLNTSTVLVTGAGGRTGSIVYKKLKERSENYTARGLVRTEESKQKIGGADDVYIGDIRNTESIVPAIQGIDALVILTSAVPKMKPGFDPTQGGRPEFYFEDGANPEQVDWIGQKNQIDAAKAAGVKQIVLVGSMGGTNPNHPLNSIGNGNILVWKRKLNNTWLIPVFHTQS

SEQ ID NO: 2786 - protein, 321 aa, Raphanus sativus
MTTATLFHALVPSNSYKTGAVSSSLVSVPSSSSSLQFRSLVSDSTSVYARRKLTGDLRRVSLTVSAAAATEPLTVLVTGAGGRTGQIVYKKLKERSDQFVARGLVRTKESKEKIGGEEEVFVGDIRDLEAIAPAVQGIDALVILTSAVPKMKPGFDPSKGERPEFYFEEGAYPEQVDWIGQKNQIDAAKAAGVKQIVLVGSMGGTNINNPLNSIGNANILVWKRKAEQYLADSGIPYTIIRAGGLQDKEGGIRELIVGKDDEILETETRTIARADVAEVCVQALQLEEAKFKALDLASKPEGTGTPTKDFKALFAQVTARF

SEQ ID NO: 2787 - protein, 255 aa, Vigna unguiculata
MADSSPKTVLVTGSGGRTGQIVYKKLKERPNQYVTRGLVRTEESKQKIGGANDVFIGDIRDAGSITPAFQGIDALIILTSAVPQMKPGFDPTKGGRPEFYFDDGAYPEQVDWIGQKNQIDAAKAAGVKHVVLVGSMGGTNTNHPLNSLGNGNILIWKRKAEQYLADSGLPYTIIRPGGLLDKEGGIRELIVGKDDELLQTETKTIPRADVAEVCIQALNFEEVQFKAFDLASKPEGVGTPTKDFKALFANITARF

SEQ ID NO: 2788 - protein, 255 aa, Solanum lycopersicum
MADLNTSTVLVTGAGGRTGSIVYKKLKERSETYTARGLVRTEESKQKVGGADDVYIGDIRNIESLVPAIQGIDALVILTSAVPKMKPGYDPTKGGRPEFYFEDGANPEQVDWIGQKNQIDAAKAAGVKRIVLVGSMGGTNPNHPLNSLGNGNILIWKRKAEQYLADSGIPYTIIRAGGLQDKEGGIRELLVGKDDELLETETKTVARTDVAEVCIQALQYEEAKFKAFDLASKPEGTGTPTKDFKALFAQISTRF

SEQ ID NO: 2789 - protein, 255 aa, Tropaeolum majus
MADLNRTTVLVTGAGGRTGQIVYRKLKERSDHFAAKGLVRTQESKEKIGAADDVFIGDIRDASSIVPAIEGTDALVILTSAVPKMKPGFDPSKGGRPEFYFEEGGYPEEVDWIGQKNQIDAAKTAGVKHIVLVGSMGGTDVNHPLNSLGNGNILVWKRKAEQYLADSGIPYTIIRAGGLQDKEGGVRELLVGKDDELLKTETKLIARADVAEVCIQALQFEEAKFKAFDLASKPEGSGTPTKDFKALFSQITTRF

SEQ ID NO: 2790 - protein, 326 aa, Brassica rapa
MTTTTLFHALVPSNTYKPGAVSSSFVSVPRSSTPPSSPSLQFRSLVSDTTSIYGRRKFTGNLRRVSLTVSAAAAAEPLTVLVTGAGGRTGQIVYKKLKERADQFVARGLVRTKESKEKIGGEDEVFVGDIRDPEAIAPAVQGIDALVILTSAVPKMKPGFDPSKGERPEFYFEEGAYPEQVDWIGQKNQIDAAKAAGVKQIVLVGSMGGTNINNPLNSIGNANILVWKRKAEQYLADSGIPYTIIRAGGLQDKEGGIRELIVGKDDEILETEMRTIARADVAEVCVQALQLEEAKFKALDLASKPEGTGTPTKDFKALFAQVTARF

SEQ ID NO: 2791 - protein, 331 aa, Citrus clementina
MATLTRVTFISASSPSGSIGHSRNKCRQVASSIPFLNSLPEFSSHAFRARYSPSSLTSLPRTRYRRSCVSKTEAVKVLSMAKSTVLVTGAGGRTGQIVYKKLKERSEQYAARGLVRTEESKQKIGGADDLFIGDIRDSNSIIPAIQGIDALLILTSAVPKMKPDFDPAKGGRPEFYFEEGAYPEQVDWIGQKNQIDAAKAAGVKQIVLVGSMGGTNLNHPLNSLGNGNILVWKRKAEQYLADSGIPYTIIRAGGLQDKEGGIRELLVGKDDELLQTETRTIARADVAEVCIQALQFEEAKFKAFDLASKPEGTGTPTKDFKALFSQITTRF

SEQ ID NO: 2792 - protein, 253 aa, Cleome spinosa
MADHPTVLVTGASGRTGQIVYKKLKERSDQFVAKGLVRTPEGKEKIGGKDDVFVGDIRDEHSINPAIQGIDSLIILTSAVPKMKPGFDPTAGGRPEFTFEDGQYPEQVDWIGQKNQIDVAKAAGVKHIVLVGSMGGTNPNHPLNKLGNGNILIWKRKAEQYLADSGIPYTIIRAGGLIDKEGGARELIVGKDDELLQTDTKTIPRADVAEVCVQALLFEEAKFKAFDLASKPEGTGTPTKDFKALFSQLTSRF

SEQ ID NO: 2793 - protein, 253 aa, Gossypium hirsutum
MADLSTVLVTGAAGRTGQIVYKKLKERSDQFVVRGLVRTPESKETIGGADDVFVGDIRDTTSLVPAMQGIDALIILTSAVPRMKPGFDPTKGGRPEFYFEDGAYPEQVDWIGQKNQIDVAEEAGVKQIVLVGSMGGTNPNHPLNSLGNGNILVWKRKAEQYLADSGVPYTIIRAGGLQDRDGGIRELLVGKDDELLQTETKAIARPDVAEVCIQALKFEEAKFKAFDLASKPEGVGNPTKDFKALFSQITTRF

SEQ ID NO: 2794 - protein, 332 aa, Gossypium hirsutum
MATLTRVPLVFSSNRVAPAPAASLNHKCNCVASSSPLTRKLPHCSTPSSLSFNPFSSSFPSFSTRQNKGFRRTSLVVASMADLSTVLVTGAAGRTGQIVYKKLKERSDQFVVRGLVRTPESKETIGGADDVFVGDIRDTTTLVPAMQGIDALIILTSAVPRMKPGFDPTKGGRPEFYFEDGAYPEQVDWIGQKNQIDVAKEAGVKQIVLVGSMGGTNPNHPLNSLGNGNILVWKRKAEQYLADSGVPYTIIRAGGLQDRDGGIRELLVGKDDELLQTETKTIARPDVAEVCIQALKFEEAKFKAFDLASKPEGVGNPTKDFKALFSQITTRF

SEQ ID NO: 2795 - protein, 255 aa, Nicotiana tabacum
  misc_feature (66)..(66): Xaa can be any naturally occurring amino acid
  misc_feature (73)..(73): Xaa can be any naturally occurring amino acid
  misc_feature (145)..(145): Xaa can be any naturally occurring amino acid
MADLNTSTVLVTGAGGRTGSIVYKKLKERSEKYTARGLVRTEESKQKIGGADDVYIGDIRDTESIXPAIQGIXALVILTSAVPKMKPGFDPTQGGRPEFYFEDGAYPEQVDWIGQKNQIDAAKAAGVKQIVLVGSMGGTNPNHPXNSIGNGNILVWKRKAEQYLADSGIPYTIIRAGGLQDKEGGIRELLVGKDDELLQTETRTIARADVAEVCIQALEYEEAKFKALDLASKPEGTGTPTTDFKALFAQISARF

SEQ ID NO: 2796 - protein, 255 aa, Centaurea maculosa
MAESNRTTVLVTGAGGRTGQIVYKKLKERSGEYIARGLVRSEESKEKIGGADDVFIGDITKAETIVPAIEGIDALVILTSAVPKMKPGFDPSKGGRPEFYFEEGANPEQVDWEGQKNQIDAAKAVGVKQIVLVGSMGGTNINHPLNSLGNGNILVWKRKAEQYLADSGIPYTIIRAGGLQDKEGGVRELLIGKDDELLQTETKTIARADVAEVCIQALQIEEAKCKALDLASKPEGTGTPTTDFKALFSQVTTRF

SEQ ID NO: 2797 - protein, 255 aa, Cichorium intybus
MAEPNRSTVLVTGAGGRTGQIVYKKLKERSTEYIARGLVRSEESKEKIGGADDVFIGDIRNTETILPAIQGIDALVILTSAVPKMKPGFDPSKGGRPEFYFEEGQNPEQVDWEGQQNQIDAAKAAGVKQIILVGSMGGTNINHPLNSLGNGNILVWKRKAEQYLADSGIPYTIIRAGGLQDKEGGVRELLIGKDDELLETETKTIARPDVAEVCIQALKFEEAKFKAFDLASKPEGSGTPTKDFKALFSQVTTRF

SEQ ID NO: 2798 - protein, 328 aa, Brassica napus
MAMSTTTLFHALVPSNTYKSRAVSSSFVSVPRSSTPPSSPSLQFRSLVSDTTSIYGRRKFTGNLRRVSLTVSAAAAAEPLTVLVTGAGGRTGQIVYKKLKERSDQFVARGLVRTKESKEKIGGEDEVFVGDIRDPESIAPAVQGIDALVILTSAVPKMKPGFDPSKGERPEFYFEEGAYPEQVDWIGQKNQIDAAKAAGIKQIVLVGSMGGTNINNPLNSIGNANILVWKRKAEQYLADSGIPYTIIRAGGLQDKEGGIRELIVGKDDEILETEMRTIARADVAEVCVQALQLEEAKYKALDLASKPEGTGTPTKDFKALFTQVTARF

SEQ ID NO: 2799 - protein, 300 aa, Aquilegia formosa
MAIVPRVTFPSNLSAYKCSSSLPEISTGFSSQNKLRTSRVIVAMATDSSSRSTVLVTGAAGRTGQIVYKKLKERVDQYVARGLVRTEESKEKIGGADDVFLGDIRDAESITPAIQGIDALVILTSGVPKMKPGFDPSKGGRPEFYFEEGAYPEQVDWIGQKNQIDAAKEAGVKQIVLVGSMGGTDLNHPLNSLGNGNILVWKRKAEQYLADSGIPYTIIRAGGLQDKEGGLRELIVGKDDELLQTETRTIARADVAEVCIQALQFEEAKFKAFDLASKPEGTGEPTKDFKALFSKIAARF

SEQ ID NO: 2800 - protein, 300 aa, Aquilegia formosa
MAIVPRVTFPSNLSAYKCFSSLPEISTGFSSQNKLRTSRVIIAMATDSSSRSTVLVTGAAGRTGQIVYKKLKERVDQYVARGLVRTEESKEKIGGADDVFLGDIRDAESITPAIQGIDALVILTSGVPKMKPGFDPSKGGRPEFYFEEGAYPEQVDWIGQKNQIDAAKEAGVKQIVLVGSMGGTDLNHPLNSLGNGNILVWKRKAEQYLADSGIPYTIIRAGGLQDKEGGLRELIVGKDDELLQTETRTIARADVAEVCIQALQFEEAKFKAFDLASKPEGTGEPTKDFKALFSKIAARF

SEQ ID NO: 2801 - protein, 323 aa, Populus trichocarpa
MTTTVTVTRVPLIFSGHFLNNKNGRASQSAVHLLGSISNSNTSSASRSSFSSSLTATTRIRRAGFAVLASNSMAPSIVLVTGAGGRTGSIVYKKLKERSEQYVARGLVRTEESKEKIGGAEDVFVGDIRESKSIVPAIQGIDSLIILTSAVPKMKPGSDPSKGRPEFYFEDGAFPEQVDWIGQKNQIDAAKAAGVKQIVLVGSMGGTNLNHPLNSLGNGNILVWKRKAEQYLADSGVPYTILRAGGLQDKEGGVRELLVGKDDELLQTETRTIARADVAEVCIQALQYEEAQFKAFDLASKPEGTGTPANDFKALFSQVTARF

SEQ ID NO: 2802 - protein, 331 aa, Citrus sinensis
MATLTRVTFISASSPSGSIGHSRNKCRQVASSIPFLNSLPEFSSHAFRARYSPSSLTSLPRTRYRRSCVSKTEAVKVLSMAKSTVLVTGAGGRTGQIVYKKLKERSEQYAARGLVRTEESKQKIGGADDLFIGDIRDSNSIIPAIQGIDALIILTSAVPKMKPDFDPAKGGRPEFYFEEGAYPEQVDWIGQKNQIDAAKAAGVKQIVLVGSMGGTNLNHPLNSLGNGNILVWKRKAEQYLADSGIPYTIIRAGGLQDKEGGIRELLVGKDDELLQTETRTIARADVAEVCIQALQFEEAKFKAFDLASKPEGTGTPTKDFKALFSQITTHF

SEQ ID NO: 2803 - protein, 254 aa, Prunus persica
MADSGPSTVLVTGAGGRTGKIVYKKLREADQYVARGLVRTEESKESIGGADDIFIGDIRDANSILPAIQGIDALVILTSAVPKMKPGFDPTKGGRPEFYFDDGSYPEQVDWIGQKNQIDAAKAAGVKQIVLVGSMGGTDINNPLNSLGNGNILVWKRKAEQYLADSGVPYTIIRAGGLQDKEGGIRELLIGKDDELLKTETRTIARADVAEVCIQALQFEEAKFKAFDLASKPEGTGTPTKDFKALFSQITTRF

SEQ ID NO: 2804 - protein, 255 aa, Ricinus communis
MTDSTSSTVLVTGAGGRTGSIVYKKLKERSGQYVARGLVRTQESKDKISGAEDVFIGDIRETESIVPAIQGIDALIILTSAVPKMKPGFDPTKGGRPEFYFEDGAYPEQVDWTGQKNQIDAAKAAGVKQIVLVGSMGGTNLNHPLNSLGNGNILVWKRKAEQYLADSGIPYTIIRAGGLQDKEGGVRELLIGKDDELLQTETRTIARADVAEVCIQALQFEEAKFKAFDLASKPEGTGSPTKDFKALFSQVTTRF

SEQ ID NO: 2805 - protein, 255 aa, Tragopogon dubius
MAESNRSTVLVTGAGGRTGQIVYKKLKERSTEYIARGLVRTEESKEKIGGADDVFIGDIRNTETFLPAIQGIDALVILTSAVPKMKPGFDPSKGGRPEFFFEEGSYPEQVDWEGQKGQIDAAKAAGVKQIVLVGSMGGTNINHPLNSLGNGNILVWKRKAEQYLADSGIPYTIIRAGGLQDKEGGVRELLIGKDDELLQTETKTVARADVAEVCIQALQIEEAKCKAFDLASKPEGSGTPTKDFKALFSQITTRF

SEQ ID NO: 2806 - protein, 331 aa, Citrus sinensis
MATLTRVTFISASSPSGSIGHSRNKCRQVASSIPFLNSLPEFSSHAFHARSSPSSLTSLPRTRYRRSCVSKTEAVKVLSMAKSTVLVTGAGGRTGQIVYKKLKERSEQYAARGLVRTEESKQKIGGADDLFIGDIRDSNSIIPAIQGIDALIILTSAVPKMKPDFDPAKGGRPEFYFEEGAYPEQVDWIGQKNQIDAAKAAGAKQIVLVGSMGGTNLNHPLNSLGNGNILVWKRKAEQYLADSGIPYTIIRAGGLQDKEGGIRELLVGKDDELLQTETRTIARADVAEVCIQALQFEEAKFKAFDLASKPEGTGTPTKDFKALFSQITTHF

SEQ ID NO: 2807 - protein, 254 aa, Glycine max
MAESKSTVLVTGAGGRTGQIVYKKLRERPNQYVARGLVRTDESKQNIGAADDVIVGDIRDAESIVPAIQGIDALIILTSAVPQIKPGFDPTKGQRPEFYFEDGAYPEQVDWIGQKNQIDVAKAAGVKHIVLVGSMGGTDLNHPLNSLGNGNILVWKRKAEQYLADSGIPYTIIRAGGLQDKDGGLRELLVGKDDELLQTETRTISRSDVAEVCIQALNFEEAKFKAFDLASKPEGAGSATKDFKALFSQITTRF

SEQ ID NO: 2808 - protein, 253 aa, Raphanus sativus
MANPPTVLVTGASGRTGQIVYKKLKERSDKFVAKGLVRTPEGKDKIGGEADVFIGDIRDADSITPAVQGIDALVILTSAVPKMKPGFDPTKGGRPEFIFDDGQYPEQVDWIGQKNQIDAAKVAGVKHIVLVGSMGGTNPDHPLNKLGNGNILVWKRKAEQYLADSGTPYTIIRAGGLLDKEGGARELLVGKDDELLQTDTKTVPRADVAEVCIQALLFEEAKNKAFDLGSKPEGTSSPTKDFKALFSQVTARF

SEQ ID NO: 2809 - protein, 252 aa, Artemisia annua
MAESNRTTVLVTGAGGRTGQLVYKKLKERSSEYIARGLVRSEESKTKIGGADDVFIGDITKPDTLAPAIGGIDALVILTSAVPKMKPGFDPTKGGRPEFYFEEGQYPEQVDWEGQKSQIDAAKAAGVKQIVLVGSMGGTNINHPLNSLGNGNILVWKRKAEQYLADSGIPYTIIRAGGLQDKEGGIRELLIGKDDELLQTETKTVASAEVCVQALQIEEAKFKAFDLASKPEGTGTPTKDFKALFSQITTRF

SEQ ID NO: 2810 - protein, 130 aa, Persea americana
MADAPLPTVLVTGAGGRTGHIVYKKLKERTDQFIARGLVRTPESKEKIRGGDDVFVGDIRDAESIVPAVQGIDALIILTSAMVKVRPSSDPSKGGREFYFEDGAYPEQVDWIGQKDQIDAAKSAGVKHIV

SEQ ID NO: 2811 - protein, 325 aa, Brassica juncea
MAMTTTTTFFHSLLPSNSYKTGSVSSSFVSVPSSSSSSLQFRSLVSDTKSIYGRMKFTGNIRRVSVTVSAVASAEPLTVLVTGAGGRTGQIVYKKLKERSDQFVARGLVRTKESKEKIGGEDDVFIGDIRDTEAIAPAIQGIDALVILTSAVPKMKPGFDPSKGERPEFYFEEGAYPEQVDWIGQKNQIDAAKAAGVKQIVLVGSMGGTNINNPLNKIGNANILVWKRKAEQYLADSGIPYTIIRAGGLQDKEGGIRELLVGKDDEILETEMRTIARADVAEVCVQALQLEEAKFKALDLASKPEGTGTPTKDFKALFAQVTARF

SEQ ID NO: 2812 - protein, 255 aa, Vigna unguiculata
MAESPNSTVLVTGAGGRTGQIVYKKLKERPNQYVARGLVRTEESKQNIGAAEDVYVGDIRDAGSLVPAIQGIDALIILTSAVPLIKPGFDPTTGQRPEFYFEDGAYPEQVDWIGQKNQIDSAKAAGVKHIVLVGSMGGTDLNNPLNSLGNGNILVWKRKAEQYLADSGIPYTIIRAGGLQDKDGGLRELLVGKDDELLKTETRTISRADVAEVCIQALNYEEAKFKAFDLSSKPEGAGSPTKDFKALFSQITTRF

SEQ ID NO: 2813 - protein, 58 aa, Camellia sinensis
MANFKPSTVLVTGAGGRTGQIVYKKLKERTDQYDTKGLVRREESKEKIGGTDMFLLGI

SEQ ID NO: 2814 - protein, 255 aa, Malus domestica
MADSGASTVLVTGAGGRTGKLVYEKLKERSDQYVARGLVRSEESKQSIGGADDLYIGDIRDADSILPAIQGIDALVILTSAVPKMKPGFDPTKGGRPEFYFEDGSYPEQVDWIGQKNQIDAAKAAGVKQIVLVGSMGGTDLNNPLNKLGDGNILVWKRKAEQYLADSGIPYTIIRAGGLQDKEGGIRELLIGKDDELLKTETRTIARPDVAEVCIQALQFEEAKFKAFDLASKPEGTGTPTKDFKALFSQITTRF

SEQ ID NO: 2815 - protein, 171 aa, Coffea canephora
MKPGFDPTKGGRPEFYFEDGAYPEQVDWIGQKNQIDAAKAAGVKHIVLVGSMGGTNPNHPLNSLGNGNILIWKRTAEQYLADSGIPYTIIRAGGLQDKEGGVRELLIGKDDELLQLETRTLPRADVAEVSIQAVQFEEAKNKAFDLASKPEGTAAPTKDFKALFSQVTTRF

SEQ ID NO: 2816 - protein, 255 aa, Tropaeolum majus
MADLNPSTVLVTGAGGRTGQLVYRKLKERPDNFVARGLVRTEESKEKLGAADDVFVGDIRDASSIVSAIQGIDALVILTSAVPKMKPGFDPSKGGRPEFYFEDGAYPEQVDWIGQKNQIDAAKAAGVKQIVLVGSMGGTDLNNPLNKLGNANILVWKRKAEQYLADSGIPYTIIRAGGLQDKEGGVRELLVGKDDELVKTETRTIARADVAEVCIQALQLEEAKFKAFDLSSKPEGSGTPTKDFKALFSQVTSRF

SEQ ID NO: 2817 - protein, 254 aa, Prunus persica
  misc_feature (83)..(83): Xaa can be any naturally occurring amino acid
MADSGPSTVLVTGAGGRTGKIVYKKLREADQYVARGLVRTEESKESIGGADDIFIGDIRDANSILPAIQGIDALVILTSAVPXMKPGFDPTKGGRPEFYFEDGSNPEQVDWIGQKNQIDAAKAAGVKQIVLVGSMGGTDINNPLNSLGNGNILVWKRKAEQYLADSGVPYTIIRAGGLQDKEGGIRELLIGKDDELLKTETRTIARADVAEVCIQALQFEEAKFKAFDLASKPEGTGTPTKDFKALFSQITTRF

SEQ ID NO: 2818 - protein, 421 aa, Triticum aestivum
MLPTGRSRPQPRPAPRSWSFSDMDLSDPKRNSRYLSKIIMVALLTAMCVVMLTQPPCHRKAPSVFSIHELGVTHVLVTGGAGYIGSHAALRLLKDSFRVTIVDNLSRGNIGAVKVLQNLFPDPGRLQFIHADLGDPIAVNRIFAENAFDAVMHFAAVAYVGESTLEPLRYYHNITANTLVVLEAMATHNVKTLIYSSTCATYGEPEKMPITEETPQFPINPYGKAKKMAEDIILDFSKSRKSDMSVMILRYFNVIGSDPEGRLGEAPPPELREHGRISGACFDAALGIIPGLKVKGTDYETADGTCVRDYIDVTDLVDAHVKALNKAERGKVGIYNVGTGRGRSVKEFVEACKKATGVDIKVDYFPRRPGDYAEVYSNPARINRELNWTAQHTELQESLRVAWTWQKKHRSGYADSGRYIF

SEQ ID NO: 2819 - protein, 421 aa, Triticum aestivum
MLPTGRGRPQPRPAPRSWSFSDMDFSDPKRNSRYLSKIIMVALLTAMCVVMLTQPPCHRKAPSVFSIHELGVTHVLVTGGAGYIGSHAALRLLKDSFRVTIVDNLSRGNIGAVKVLQNLFPDPGRLQFIHADLGDPKAVNRIFAENAFDAVMHFAAVAYVGESTLEPLRYYHNITANTLVVLEAMATHNVKTLIYSSTCATYGEPEKMPITEETPQFPINPYGKAKKMAEDIILDFSKLRKSDMSVMILRYFNVIGSDPEGRLGEAPPPELREHGRISGACFDAALGIIPGLKVKGTDYETADGTCVRDYIDVTDLVDAHVKALNKAERGKVGIYNVGTGRGRSVMEFVEACKKATGVDIKVDYFPRRPGDYAEVYSNPARINRELNWTAQHTELQESLRVAWTWQKKHRSGYADSGRYIF

SEQ ID NO: 2820 - protein, 421 aa, Hordeum vulgare
MLPTGRSRPQPRPAPRSWSFSDMDFSDPKRKSRYLSKIIMVALLTAMCVVMLTQPPCHRKAPSVFSIHELGVTHVLVTGGAGYIGSHAALRLLNDSFRVTIVDNLSRGNIGAVKVLQNLFPDPGRLQFIHADLGDAKAVNRIFAENAFDAVMHFAAVAYVGESTLEPLRYYHNITANTLVVLEAMAMHNVKTLIYSSTCATYGEPEKMPITEETPQFPINPYGKAKKMAEDIILDFSKSRKSDMSVMILRYFNVIGSDPEGRLGEAPPPELREHGRISGACFDAALGIIPGLKVKGTDYETPDGTCVRDYIDVTDLVDAHVKALNKAERGKVGIYNVGTGRGRSVKEFVEACKKATGVDIKVDYFPRRPGDYAEVYSNPARINRELNWTAQHTELQESLRVAWTWQKKHRSGYADSGRYIL

SEQ ID NO: 2821 - protein, 421 aa, Brachypodium distachyon
MLPSSRSRPQPRPAGRSWSFSEMDFSDPKRKPRYLSKVIMAALLIAMCVVMLTQPPCHRRLPSVFSIHEPGVTHVLVTGGAGYIGSHAALRLLKDSFRVTIVDNLSRGNIGAVKVLQSLFPEPGRLQFIYADLGDPKAVNKIFAENAFDAVMHFAAVAYVGESTLEPLRYYHNITANTLVVLEAMATHDVRTLIYSSTCATYGEPEKMPITEETPQFPINPYGKAKKMAEDIILDFSKSRKSDMSVMILRYFNVIGSDPEGRLGEAPPPELREHGRISGACFDAALGIIPGLKVKGTDYETSDGTCVRDYIDVTDLVDAHVKALNKAERGKVGIYNVGTGRGRSVKEFVEACKKATGVDIKVDYFNRRPGDYAEVYSDPAKINRELNWTAQHTELQESLRVAWTWQKKHRSGYGPPQAMIL

SEQ ID NO: 2822 - protein, 421 aa, Oryza sativa
MLPTNRNRPQQRPARSWYFISDMDFSDPKRKPRYLSKILMVALLTAMCVVMLTQPPCHRRTPSVFSIHEPGVTHVLVTGGAGYIGSHAALRLLKDSFRVTIVDNLSRGNMGAIKVLQNLFSEPGRLQFIYADLGDPKAVNRIFAENAFDAVMHFAAVAYVGESTLEPLRYYHNITSNTLVVLEAMAAHNVRTLIYSSTCATYGEPEKMPITEGTPQFPINPYGKAKKMAEDIILDFSKSKKADMAVMILRYFNVIGSDPEGRLGEAPKPELREHGRISGACFDAALGIIPGLKVKGTDYETPDGTCVRDYIDVTDLVDAHVKALNKAERGKVGIYNVGTGKGRSVKEFVEACKKATGVDIKVDYFPRRPGDYAEVYSDPAKINSELNWTAQHTDLLESLRVAWTWQKKHRSGYGPPQAMVL

SEQ ID NO: 2823 - protein, 422 aa, Cenchrus ciliaris
  misc_feature (59)..(60): Xaa can be any naturally occurring amino acid
  misc_feature (73)..(73): Xaa can be any naturally occurring amino acid
MLPTNTRGRPQQRPPRSWSFSEMVDFSDPKRRPRYLSKVVMVALLTAMCVVMLTQPPCXXRTPSVFSVHQPGXTHVLVTGGAGYIGSHAALRLLKDSFRVTIVDNLSRGNIGAIKVLQSLFPEPGRLQFIQADLGDPKAVNRIFAENAFDAVMHFAAVAYVGESTLEPLRYYHNITANTLVVLEAMATHSVKTLIYSSTCATYGEPEKMPITEETPQFPINPYGKAKKMAEDIILDFSKSKKADMAVMILRYFNVIGSDPEGRLGEAPRPELREHGRISGACFDAALGIIPGLKVKGSDYETPDGTCVRDYIDVTDLVDAHVKALNKAERGRVGIYNVGTGKGRSVKEFVEACKKATGVDIKVDYFPRRPGDYAEVYSDPAKINRELNWTAQHTDLHESLRVAWTWQKAHRSGYEPPQAMIL

SEQ ID NO: 2824 - protein, 425 aa, Panicum virgatum
MLPTNRGRPQQRPPPPRSWSFLSEMVDFSDPKRRPRYLTKLVMAALLTAMCVLMLTQPPCHRRASPSVFSIRQPGVTHVLVTGGAGYIGSHAALRLLKDSFRVTIVDNLSRGNIGAIKVLQNLFPEPGRLQFIQADLGDPKAVNRIFAENAFDAVMHFAAVAYVGESTLEPLRYYHNITANTLVVLEAMATHNVKTLIYSSTCATYGEPDKMPITEETPQFPINPYGKAKKMAEDIILDFSKSKKADMAVMILRYFNVIGSDPEGRLGEAPRPELREHGRISGACFDAALGIIPGLKVKGTDYETPDGTCVRDYIDVTDLVDAHVKALNKAEKGRVGIYNVGTGKGRSVKEFVEACKKATGVDIKVDYFPRRPGDYAEVYSDPAKINRELNWTAQHTDLHESLRVAWTWQKAHRSGYEPPQAMIL

SEQ ID NO: 2825 - protein, 422 aa, Pennisetum glaucum
STNTARGRLPQQRPPRSWSFSDMVDFSDPKRRPRYLSKVVMVALLTAMCVVMLTQPPCHRRTPSVFSVRQPGVTHVLVTGGAGYIGSHAALRLLKDSFRVTIVDNLSRGNIGAIKVLRNLYPEPGRLQFIQADLGDPRAVNRIFAENAFDAVMHFAAVAYVGESTLEPLRYYHNITANTLVVLEAMATHSVKTLIYSSTCATYGEPEKMPITEETPQFPINPYGKAKKMAEDIILDFSKSKKADMAVMILRYFNVIGSDPEGRLGEAPRPELREHGRISGACFDAALGIIPGLKVKGSDYETPDGTCVRDYIDVTDLVDAHVKALNKAERGRVGIYNVGTGKGRSVKEFVEACKKATGVDIKVDYFPRRPGDYAEVYSDPAKINRELNWTAQHTDLHESLRVAWTWQKAHRSGYEPPQAMIL

SEQ ID NO: 2826 - protein, 429 aa, Saccharum officinarum
MLPASRGSRPPQRPAARSCSASLSEIMDLSSDPKRKPRCLSKVVMLALLAAMCVVMLTQPPCRRRTPPTPTLFSIHEPGVTHVLVTGGAGYIGSHAALRLLKDSFRVTIVDNLSRGNIGAIRVLQNLFPKPGRLQFIQADLGDPEAVNRIFAENAFDAVMHFAAVAYVGESTLEPLRYYHNITANTLVVLEAMATHNVKTLIYSSTCATYGEPEKMPITEGTPQFPINPYGKAKKMAEDIILDFSESKKSDMAVMILRYFNVIGSDPEGRLGEAPRPELREHGRISGACFDAALGIIPGLKVKGTDYETPDGTCVRDYIDVTDLVDAHVKALNKAQRGRVGIYNVGTGKGRSVKEFVDACKKATGVDIKVDYFPRRPGDYAEVYSDPAKINRELNWTAQRTNLHESLRVAWTWQKAHRSGYEPPQAMIL

SEQ ID NO: 2827 - protein, 430 aa, Sorghum bicolor
MLPSTRGSRPPQRPAARSCSSALSEIMDLSSSDPKRKPRCLSKVVMLALLAAMCVVMLTQPPCHRTRPPTPTLFSIHEPGVTHVLVTGGAGYIGSHAALRLLKDSFRVTIVDNLSRGNIGAIKVLQNLFPEPGRLQFIQADLGDPEAVNRIFAENAFDAVMHFAAVAYVGESTLEPLRYYHNITANTLVVLEAMATHNVKTLIYSSTCATYGEPEKMPITEGTPQFPINPYGKAKKMAEDIILDFSKSKRSDMAVMILRYFNVIGSDPEGRLGEAPRPELREHGRISGACFDAALGIIPGLKVKGTDYETPDGTCVRDYIDVTDLVDAHVKALNKAQRGRVGIYNVGTGKGRSVKEFVDACKKATGVDIKVDYFPRRPGDYAEVYSDPAKINKELNWTAQRTDLHESLRVAWTWQKAHRSGYEPPQAMIL

SEQ ID NO: 2828 - protein, 270 aa, Festuca arundinacea
  misc_feature (135)..(135): Xaa can be any naturally occurring amino acid
  misc_feature (208)..(208): Xaa can be any naturally occurring amino acid
MHFAAVAYVGESTLEPLRYYHNITANTLVVLEAMATHHVKTLIYSSTCATYGEPEKMPITEETPQFPINPYGKAKKMAEDIILDFSKSRKSDMSVMILRYFNVIGSDPEGRLGEAPPPELREHGRISGACFDAAXGIIPGLKVKGTDYETPDGTCVRDYIDVTDLVDAHVKALNKAERGKVGIYNVGTGRGRSVKEFVEACKKATGVXIKVDYFSRRPGDYAEVFSNPAKINRELNWTAQHTELQESLRIAWMWQMRHRSGYGGPQAMIL

SEQ ID NO: 2829 - protein, 493 aa, Brachypodium distachyon
MHSSCGADILTHHGPLCDFQKFHCYVCSSEFRVRCFLNIHHSFAGRKFEHALKHGPRNGLFVVTLGWFVDCVRRNMRLDESLYSIKNMGENGLPLGEFNRLVGVPVSEQSCLPPMIFQDKACSGATQKHQLQGPREKPEHDLFVFANDTIYIDPGISGEMKKKISDAATREGAKLLDHWFIGCHATYVVCEDASVKRYVGHSDNIVTPLWILKTVKEKNLQRLVHLSSDLARQVAVVLENFQTSQENRKLGSVPSLDSKGTGLPPTGMEVNEIHQERQNFVEVAKKDIRERRVRRMQSCEVPIHPLTPVTLLDSICWTISESASSACIYTDSSWSDDANEQQSTTYFDANGDGKDRDQSADNFSRPLRESERSEVIFKNHFFTILFPLDRFGELGPSSRTFFSHGGFTCAQVLDHIYNFYQENMSTDEINVALHTDSRHADRLRSLYASAESVERGFVAVRRIDFLGSRRSFEALKRLNRENNSNVYELVIRA

SEQ ID NO: 2830 - protein, 548 aa, Oryza sativa
MSRSGVEVVVSRGCSRLVLPGMQPSSASAASSSSFSRGGHGGGGDRRPLPDGPFAGLVICVTGLSKEARTQVKEATERMGGEYSGSLHPKCTHLVVQSFAGRKFEHAVKHGAKNGLFVVTLGWLVDCVRRSMRLDESLYSIKNIGENGMPLGEFNRLVGAPVSGNSCLPPMMFQEKTFSDTTEKHRLQTSRKEHDHDEFLFTNDSIYIDPGISGEMRKKVSDAATREGAKLLDHWFIGCHATYVVCEDASVKRYVGHSDNIVTPLWILKTAKEKGLQRLVHLSSDLARQVATILENAQTFQENRKIGDVPSVNSNSSGVPSTQGEIDEIHQERQKFVEVAKKNVRDRRARRMQSCEVPIHPITPVKLMESICWTVSEPTTSACIYTEFSWSDDAFEQQSTTFFDANGDGKDDQSSDSFTRPLRESEKSEVIFKNHFLTVLFPIDRFGELGPSSRTFFSNGGFTRIQVLDHIYNFYQENMSSDEINVALQTDSRHADRLRSLYASTESAERGFVTFKRIDFLGSRRSFEGLKRLSRENNSNVYELVIRA

SEQ ID NO: 2831 - protein, 69 aa, Hordeum vulgare
MASFASQLLDVFYDLVERVTGYSARAEDDKDLEKHSKLATTEAFRTEEVVEIRSRNHPEVPGGSGAQVN

SEQ ID NO: 2832 - protein, 69 aa, Triticum aestivum
MASFASQLLDVFYDLVERVTGYSARAQDDKDLQKHSMLATREAFRTEEVVEIRSRNHPEVPGGSGAQVN

SEQ ID NO: 2833 - protein, 42 aa, Triticum aestivum
MGSELVLGNSSRCATTTSLATRTVLAAYCFALLGLLLLSAQL

SEQ ID NO: 2834 - protein, 73 aa, Triticum aestivum
MASFASQLLDVFYDLVQRVTGYSARAEDDKDLQKHSKLATTEVFRTEEVVEIRSRNHPVVSGGSGGQVNMDGM

SEQ ID NO: 2835 - protein, 69 aa, Triticum aestivum
MASYAAQLLDVFYDLVERVTGYSARAQDDKDLQKHSKLATTEAFRTEEVVEIRSRNLPVVSGGSEGQVN

SEQ ID NO: 2836 - protein, 73 aa, Triticum aestivum
MASFASQLLDVFYDLVERVTGYSARAEDDKDLQKHSKLATTEVFRTEEVVEIRSRNLPVVSGGSGAQVNMDGM

SEQ ID NO: 2837 - protein, 69 aa, Triticum aestivum
  misc_feature (36)..(36): Xaa can be any naturally occurring amino acid
MASYAAQLLDVFYDLVERVTGYSARAQDDKDLQKHXKLATTEAFRTEEVVEIRSRNLPVVSGGSEGQVN

SEQ ID NO: 2838 - protein, 76 aa, Hordeum vulgare
MASFAAQLLDVFYDLVERVAGYSARAEDDKAHADLQKRTMLATTEAFRTEEVVEIRSRNHPDVSGGSGAQVNMDGM

SEQ ID NO: 2839 - protein, 309 aa, Triticum aestivum
MASHFVLSTGAKIPSVGLGTWQSEPGVVGDAVYAAVKAGYRHIDCAQVYGNEKEIGFALKKVFDEGITSRQDLFITSKLWCTNHAPEDVPVALDGTLQDLQTDYVDLYLVHWPIRMKKGAGFSPENVIPADIPATWAAMEGLYDSGKARAIGVSNFSCKKLEELLAAARVPPAANQVECHPVWQQAKLRDLCASKGIHFSAYSPLGSPGTFKAFSVLEHPVVVSAAEKLGKTPAQVALRWGIQAGHSVLPKSTHEERIRANFDVFDWSIPSDLFASFSEIEQTRLIRGKFWTHPEGVFKSEEEIWDGEI

SEQ ID NO: 2840 - protein, 309 aa, Triticum aestivum
MASHFVLSTGAKIPSVGLGTWQSEPGVVGDAVYAAVKAGYRHIDCAQVYGNEKEIGFALKKVFDEGITSRKDLFITSKLWCTNHAPEDVPVALDGTLQDLQTGYVDLYLVHWPIRMKKGAGFSPENVIPADIPATWAAMEGLYDSGKARAIGVSNFSCKKLEELLAVARVPPAANQVECHPVWQQAKLRDLCASKGIHFSAYSPLGSPGTFKSYSVLEHPVVVSTAEKLGKTPAQVALRWGIQAGHSVLPKSTHEERIRANFDVFDWSIPSDLFAGFSEIEQTRLIRGKFWTHPEGVFKSEEEIWDGEI

SEQ ID NO: 2841 - protein, 309 aa, Pseudoroegneria spicata
MASHFVLSTGAKIPSVGLGTWQSEPGVVGDAVYAAVKAGYRHIDCAQVYGNEKEIGFALKKVFDEGITARKDLFITSKLWCTNHAPEDVPVALDGTLQDLQTDYVDLYLVHWPIRMKKAAGFSPENVIPADIPATWAAMEGLYDSGKARAIGVSNFSCKKLEELLAVARVPPAANQVECHPVWQQAKLRDLCASKGIHFSAYSPLGSPGTFKAFNVLEHPVVVSAAEKLGKTPAQVALRWGIQSGHSVLPKSTHEERIRANFDVFDWSIPGDLFAGFSEIEQAKLIRGKFWTHPEGVFKSEEEIWDGEI

SEQ ID NO: 2842 - protein, 309 aa, Leymus cinereus x Leymus triticoides
MASHFVLNTGAKIPSVGLGTWQSEPGVVGDAVYAAVKAGYRHIDCAQVYGNEKEIGFALKKVFDEGITSRKDLFITSKLWCTNHAPEDVPVALDGTLQDLQTDYVDLYLVHWPIRMKKAASFSPENVIPADIPATWAAMEGLYDSGKARAIGVSNFSCKKLEELLAVARVPPAANQVECHPVWQQAKLRELCASKGIHFSAYSPLGSPGTFKAFNVLEHPVVVSTAEKLGKTPAQVALRWGIQAGHSVLPKSTNEERIRANFDVFDWSIPGDLFAGFSEIEQAKLIRGKFWTHPEGVFKSEEEIWDGEI

SEQ ID NO: 2843 - protein, 309 aa, Hordeum vulgare
MALHFVLNTGAKIPSVGLGTWQSEPGVVGDAVYAAVKAGYRHIDCAQVYGNEKEIGFALKKVFDEGVTTRKDLFITSKLWCTNHAPEDVPVALDGTLQDLQTDYVDLYLVHWPIRMKKGAGFNPENVIPADIPATWAAMESLYDSGKARAIGVSNFSCKKVEELLAVARVTPAANQVECHPVWQQAKLRDLCASKGIHFSAYSPLGSPGTFKAFSVLEHPVVVSTAEKLGKTPAQVALRWGVQAGHSVLPKSTNEERIRANIDVYDWSIPGDLFAGFSEIEQAKLIRGKFWTHPEGVFKSEEEIWDGEI

SEQ ID NO: 2844 - protein, 312 aa, Oryza sativa
MARCFVLNTGAKIPSVGLGTWQAEPGVVGNAVYAAVKAGYRHIDCAQAYFNEKEIGVALKKVFDEGIVKREDIFITSKLWCTNHAPEDVPVALDSTLQDLQTDYVDLYLIHWPVRMKKGAGFGGQNVLPTDIPATWAAMEKLHDSGKARAIGVSNFSSKKLEDLLAVARVPPAVDQVECHPVWQQTKLRKFCTSKGIHLSAYSPLGSPGTASVKAVGNVLAHPVVVSTAEKLGKTPAQVALRWGIQMGHSVLPKSTHEERIKENIDVYDWSIPEDLFIKLSEIEQMKLIRGEFWTHPEGVYKSIEELWDGEI

SEQ ID NO: 2845 - protein, 327 aa, Cynodon dactylon
AGEPCSRRTGEAASRRDGSPLRPQTGATIPSVGLGTWQADPGVVGDAVYTAVKAGYRHIDCAQAYRNEKEVGFALKKVFDEGIAKREDIFITSKLWCTNHAPEDVPVALEGTLKDLQTDYVDLYLIHWPLRMKKGAGFSAENVIPSDIPATWAAMEKLFDAGKARAIGVSNFSSKKLADLLAVARVPPAVDQVECHPVWQQGKLRAFCESNGIHLSAYSPLGSPGTAMVKSGAVLEHPVVVAAAEKLGKTPAQVALRWGIQKGHSVLPKSTSEERIKANIDVFDWSIPDDLFAKFSEIKEEKLIRADFFVHPDGVFKSVEELWDGEI

SEQ ID NO: 2846 - protein, 210 aa, Sorghum bicolor
MATHFVLNTGAKIPSVGLGTWQSDNGLVGDAVYAAVKAGYRHIDCAQAYNNEKEVGFGLKKVLDEGIVKREDLFITSKLWNTNHAPEDVPVALDGTLKNLQTDYVDLYLIHWPVRMKKDAGFGPQSVVPSDIPATWAAMEKLYDAGKARAIGVSNFSSKKLADLLAVARVPPAVDQVECHPVWQQGKLRAFCVANGIHSPPTRRWGRRER

SEQ ID NO: 2847 - protein, 471 aa, Solanum phureja
MANLISKSTKFNHFLLNTRVRFFSPFTTSSGNGGGGFIKPTGSFSGESATIFRPERYQSGKAGEQLDTIDYEEVENQVMDFPGGKVPITSQMKFISELSEKRLPCYRVLDDDGYPLPGTIFEEVSKELAIKMYSSMVTLQTMDTIFYEAQRQGRLSFYLTTAGEEAINIASAAALSLDDFVLPQYREVGVILWRGYPLEQVANQLFGNKFDYGKGRQMPCHHGSNELNYLTVSSPIATQIPQAVGVAYSLKMEKKEACAVTYFGDGSTSEGDFHAALNFAAVLDAPVVFICRNNGWAISTPINQQFRSDGIASKGQAYGIRSIRVDGNDALATYSAIRAARKMAIKEQRPILVEAMTYRVAHHSTSDDSTKYRPVEEIEHWKTAKSPIAKFRKYIQRNGWWSDENESKLRGDIRKQVLEAIQAAEKVEKPSLTNLFTDVYDKMPLNLQDQEKSVKDAVRRFPKEYPSDVPI

SEQ ID NO: 2848 - protein, 486 aa, Capsicum annuum
MTNLISRSRKFNHFFLSKKVCFLTHLNQRNSKTSSYTSAAAGGIIKPAATFSGEFPAIFRLERYQSNKAGEAQFDTIYYEEDGHHQINNENQVMDFPGGKVPITTQMKFIAESSEKRLPCYRVLDDDGYPIPGAIFEEASKELAVKMYSSMVTLQTMDTIFYEAQRQGRLSFYLTTAGEEAINIASAAALTLDDFVLPQYREVGVILWRGYPLQQVANQLFGNKFDFGKGRQMPCHHGSNELNYLTVSSPIATQIPQAAGIAYSLKMDGKEACAITYFGDGSTSEGDFHAALNFAAVLDAPVVFICRNNGWAISTPINQQFRSDGIASKGQSYGIRSIRVDGNDALATYSAIRAAREMAIKEQKPILVEAMTYRVAHHSTSDDSTKYRPVEEIEHWKTAKSPISRFRKYLQINGWWSDENESELRGDIRKQVLQAIQAAEKVQKPSLTDLFTDVYDKMPSNLQEQVKFVKDAVKRSPKEYPSDVPI

SEQ ID NO: 2849 - protein, 289 aa, Solanum phureja
MGDQIARGEEFMKKAEKKLSGWGLFGSKYDDAADLFDKAANCFKLAKSWDRAGAVYVKLASCHLKLDSKHEAAGAYANAAHCYKKTNIREAISCLEQAVHMFLDIGRLNMSARYYKEIAELYEQEQNLGQAITYYEKAADLFQSEDVTTTANQCKQKIAEFSAKLEKYQRAIEIFEEIAQHSIKNNLLKYGVRGHLLNAGICQLCRGDVVAINNALERYQELDPTFSGTRECKLLVDLEAAIDEEDVAKFTGCLKEYDSMTKLDEWRTTLLLRVKEALKAKELEEDDLT

SEQ ID NO: 2850 - protein, 289 aa, Solanum tuberosum
MGDQIARGEEFMKKAEKKLSGWGLFGSKYDDAADLFDKAANCFKLAKSWDRAGAVYVKLASCHLKLDSKHEAAGAYANAAHCYKKTNIREAISCLEQAVHMFLDIGRLNMSARYYKEIAELYEQEQNLEQAITYYEKAADLFQSEDVTTTANQCKQKIAEFSAKLEKYQRAIEIFEEIAQHSIKNNLLKYGVRGHLLNAGICQLCRGDVVAINNALERYQELDPTFSGTRECKLLVDLEAAIDEEDVAKFTGCLKEYDSMTKLDEWRTTLLLRVKEALKAKELKEDDLN

SEQ ID NO: 2851 - protein, 289 aa, Capsicum annuum
MGDQTARGEEFLKKAEKKLSGWGLFGSKYDDAAELFDKAANCFKLSKTWDRAGAVYVKLASCHLKMDSKHEAASAYANAAHCYKKTNTREAVSCLEQAVHMFLDNGKLSMSARYYKEIAELYEQEQNLEQALSYYEKAADLFQSEDITSSANQCKQKIAEFSAKVEKYQRAIEIFEEIARYSISNNLLKYGVRGHLLNAGICQLCKGDVVAINNALERYQDLDPTFSGTRECKLLVDLAAAIDEEDVAKFTGCLKEYDSMTKLDEWKTTLLLRVKEALKAKELEEDDLT

SEQ ID NO: 2852 - protein, 289 aa, Solanum melongena
MGDQTARGQEFMKKAEKKLNGWGIFGSKYDDAADLFDKAANCFKLAKSWDQAGAVYVKLASCHLKLDSKHEAGSAYANAAHCYKKTNIREAISCLEQAVQMFLDIGRLNMSARYYKEIAELYEQEQNLKQAIIYYEKAADLFQSEDVTSSANQCKLKIAQFSAQVEQYQRAIEIFEEIARHSLSNNLLKYGVRGHLLNAGICQLCKGDVVAINNALEQYQELDPTFSGTRECKLLVDLVAAIDEEDVATFTGCLKEYDSMTKLDEWRTTLLLRVKEALKAKELEEDDLT

SEQ ID NO: 2853 - protein, 289 aa, Nicotiana tabacum
MGDQIARGEDFEKKAEKKLSGWGLFGSKHEDAADLFDKAGNCFKLAKSWDQAGAVYVKLANCHLKLDSKHEAANAYADAAHCYKKSNTKEAISCLEQAVNMFLDIGRLSMSARYYKEIAELYEQEQNLEQAISYYEKAADLYQSEDVTTTANQCKQKVAQFSAQIEKYPRAIEIFEEIARHSVNNNLLKYGVRGHLLNAGICQLCKGDVVAINNALERYQELDPTFSGTRECKLLVDLAAAIDEEDVAKFTDAVKEYDSMTQLDAWRTTLLLRVKETLKAKELEEDDLT

SEQ ID NO: 2854 - protein, 289 aa, Unknown
  Sequence found in Organisms: Solanum tuberosum, Solanum phureja
MGDHIARGEDFENKAEKKLGGWALFGSKYEDAADLFDKAGNCFKLAKSWDKAGAVYVKLANCHLKLDSKHEAANAYADAAHCYKKSNIKEAVSCLEQAVNFFLDIGRLNMSARYYKEIAELYEQEQNLDQAINYYEKAADLFQSEDVTTTANQCKQKVAQFSAQIEKYPRAIEIFEEIARHSVNNNLLKYGVRGHLLNAGICQLCKGDVVAINNALERYQELDPTFSGTRECKLLVDLAAAIDEEDVAKFTDAVKEYDSMTQLDAWRTTLLLRVKETLKAKELEEDDLT

SEQ ID NO: 2855 - protein, 289 aa, Solanum lycopersicum
MGDQIARGEDFESKAEKKLGGWAIFGSKYEDAADLFDKAGNCFKLAKSWDKAGAVYVKLANCHLKLDSKHEAANAYADAAHCYKKSNIKEAVSCLEQAVNLFLDIGRLNMSARYYKEIAELYEQEQNLDQAINYYEKAADLFQSEDVTTTANQCKQKVAQFSAQIEKYPRAIEIFEEIARHSVNNNLLKYGVRGHLLNAGICQLCKGDVVAINNALERYQELDPTFSGTRECKLLVDLAAAIDEEDVAKFTDAVKEYDSMTQLDAWRTTLLLRVKETLKAKELEEDDLT

SEQ ID NO: 2856 - protein, 289 aa, Petunia hybrida
MGDHIGRAEDFEKKAEKKLTGWGLFGSKYEDAADLFDKAGNSYKLAKSWDQAGAVYVKLANCHLKLDSKHEAANAYADAAHCYKKSNTKEAISCLEQAVNLFLDIGRLNMSARYYKEIAELYEQDANLELAISYYEKAADLFQSEDVTTTANQCKQKVAQFSAQIEKYQRAIEIFEEIARHSISNNLLKYGVRGHLLNAGICQLCKGDVVAINNALERYQDLDPTFSGTRECKLLVDLAAAIDEEDVAKFTDAVKEYDSMTQLDAWRTTLLLRVKETLKAKELEEDDLT

SEQ ID NO: 2857 - protein, 263 aa, Nicotiana tabacum
  misc_feature (13)..(13): Xaa can be any naturally occurring amino acid
  misc_feature (37)..(37): Xaa can be any naturally occurring amino acid
  misc_feature (39)..(39): Xaa can be any naturally occurring amino acid
  misc_feature (87)..(87): Xaa can be any naturally occurring amino acid
SKHDDAADLFDKXANCFKLAKSWDQAGAVYVKVANCXLXLDSKHEAAGAYANAAHCYKKTNTREAISCLEQAVHMFLDIGRLNMSAXYYKEIAELYEQEQNLEQAIIYYEKAADLFQSEDVTTSANQCKQKIAQFSAELEKYQRAIEIFEEIARHSVNNNLLKYGVRGHLLNAGICQLCKGDVVAINNALERYQELDPTFSGTRECKLLVDLAAAIDEEDVAKFTGSVKEYDSMTKLDALRTTLLLRVKEALKAKELEEDDLT

SEQ ID NO: 2858 - protein, 289 aa, Triphysaria pusilla
MGDQVARGEEFVKKAEKKLSGWGLFGSKYEDAAELFDKAANSFKLAKSWDQAGAVYVKLANCHLKLDSKHEAANAYADAAHCYKKTNIKESISCLEQAVTMFLDIGRHSMSARYYKEIAELYEQEQNLEQAIVYYERAADLFSSEDVTTSANQCKQKIAQFAAQIEQYQKSIEIYEEIARHSLSNNLLKYGVKGHLLNAGICQLCKGDVVAITNALEKYQELDPTFSGTREYKMLSDLAAAIDEEDIGQFTAAVKEYDSMTQLDAWKTTLLLRVKEALKAKELEDDDLT

SEQ ID NO: 2859 - protein, 289 aa, Triphysaria pusilla
MGDQIARGEEFEKKAEKKLSGWGLFGSKYEDAAELFDKAANAFKLAKSWDQAGAVYVKLANCHLKLDSKHEAANAYADAAHCYKKTNIKESISCLEQSVNMFLDIGRHNMSARYYKEIAELYEQEHNLEQAIAYYERAADLFSSEDVTTSANQCKQKIAQFAAQIEQYQKSVEIYEEIARHSLSNNLLKYGVKGHLLNAGICQLCKGDVVAITNALEKYQELDPTFSGTREYKLLADLAAAVDEEDIGKFTAAVKEYDSMTQLDAWKTTLLLRVKEALKAKELEDDDLT

SEQ ID NO: 2860 - protein, 289 aa, Ipomoea nil
MGDQVARGEEFEKKAEKKLSGWALFSSKYEDAADFFEKAANCFKLAKSWDQAGATYVKLANCHLKLDSKHEAAGAFADAGHNYKKINTREAVSCLEHAVNLFLEIGRLNMSARYYKEIAEIYEQEQNLEQAIAYYEKAADLFQAEDVSTTANQCKQKIAQFSAQLEKYPRAIEIFEDIARQSVSNNLLKYGVRGHLLNAGICQLCKGDVVAINNALEKYQDLDPSFSGTREFKLLSDLAAALDEEDVAKFTDAVKEFDSMSQLDAWRTTLLLRVKESIKAKELEEDDLT

SEQ ID NO: 2861 - protein, 289 aa, Orobanche aegyptiaca
MGDQVARAEDFERKAEKKLSSWVHFGSKYEDAADLFDKAANAFKLAKSWDQAGAVYVKLANCHLKLDSKHEAANAYADAAHCYKKTNIRESVSCLEQSVNLFLDIGRLNMSARYYKEIAELYEQEQNLEQAIVYYERAADLFQSEEVTTSANQCKQKIAQFAAQLEQYQKAVEIYEEIARHSLNNNLLKYGVKGHLLNAGICQLCKGDVVAITNALEKYQELDPTFSGTREYKLLADLAAAVDEEDVPKFTAAVKEFDSMTQLDAWKTTLLLRVKEALKAKELEEDDLT

SEQ ID NO: 2862 - protein, 289 aa, Mimulus guttatus
MGDHVARGEDFEKKAEKKLSGWGIFGSKHEDAADLFDKAANAFKLAKSWDQAGAVYVKLANCHLKLDSKHEAANSYADAAHCYKKGNAKEAIPCLEQSVNLFLDIGRLNMSARYYKEIAELYEQEQNLEQAIVYYERAADLFQSEDVTTSANQCKQKIAQYAAQLEQYQKSIDIYEDIARQSLNNNLLKYGVKGHLLNAGICQLCKGDVVAITNALERYQDLDPTFSGTREYKLLSELAAAVDEEDIAKFTDAVKEFDSMTQLDAWKTTLLLRVKEAVKAKELEEDDLT

SEQ ID NO: 2863 - protein, 928 aa, Sorghum bicolor
MLSFSRSAILSYLLWCLLFLTLASSNGVVATAKPKVGYGYKLVSLVQLPNGGGLVGYLQVKQCTSTYGPDIPRLRLFVKHETRDRVRVQITAADKQRWEVPYNLLPREPAPPVTGSKVTGAPFTGAEYPGEELVFTYGRDPFWFAVHRRSTRQPLFNTSAGVLVFKDQYLEVSTALPKDAALYGLGENTQPGGIRLRPNDPYTIYTTDISAINLNTDLYGSHPVYMDLRSLGGRGVAHAVLLLNSNGMDVFYRGTSLTYKVIGGLLDFYFFAGPTPLAIVDQYTSMIGRPAPMPYWAFGFHQCRWGYKNLSVVEGVVEGYRNAQIPLDVIWNDDDHMDAAKDFTLDPVNYPRPKLLAFLDKIHAQGMKYIVLIDPGIAVNSSYGVYQRGMERDIFIKLDGEPYLAQVWPGPVYFPDFLNPNGASWWIDEVRRFHDLVPVDGLWIDMNEASNFCTGKCTIPKTHQCPIPDSKTPWVCCLDCKNLTNTRWDEPPYKINASGQTARLGFNTIATSATHYNGILEYNAHSLYGFSQAIATHKALQGLQGKRPFILTRSTFVGSGAYAAHWTGDNKGTWENLRYSISTMLNFGIFGMPMVGSDICGFYPAPTEELCNRWIELGAFYPFSRDHANFASPRQELYVWESVAKSARNALGMRYKLLPYLYTLSYQAHLTGAPVARPVFFSFPDFTPCYGLSTQFLLGASVMVSPVLEQGATSVSAMFPPGTWYNLFDMRKVVVSKSSAPVTLEAPLNEINVHVFQNTILPMQRGGFVSKDARATPFTLVVAFPFGATQADAEGAVYVDDDERPEMVLAEGQATYARFHASVRGKAVTVRSEVLMGSYSLHKGLVIEKLSVLGLEGTGKDLAIQVDGTDATTAVATSSPYFAAGGNAKLHGEEGVEDSNKSVMVEVGGLALPLGKSFTMTWNMRIEA

SEQ ID NO: 2864 - protein, 702 aa, Pennisetum glaucum
MDLRNLGGRGVAHAVLLLNSNGMDVFYRGTSLTYKVIGGLLDFYFFAGPTPLAIVDQYTSMIGRPAPMPYWAFGFHQCRWGYKNLSVVEGVVEGYRNAQIPLDVIWNDDDHMDAAKDFTLDPVNYPRPKLLAFLDKIHAQGMKYIVLIDPGIAVNNSYGVYQRGMARDIFIKLDGQPYLAQVWPGPVYFPDFLNPNGVSWWIDEVRRFHDLVPVDGLWIDMNEASNFCTGKCTIPKTHQCPIPDSKTPWVCCLDCKNLTNTRWDEPPYKINASGQTARLGFNTIATSATHYNGILEYNAHSLYGFSQAIATHKALQGLQGKRPFILTRSTFVGSGAYAAHWTGDNKGTWENLRYSISTMLNFGIFGMPMVGADICGFYPSPTEELCNRWIELGAFYPFSRDHANFASPRQELYVWESVAKSARNALGMRYKLLPYLYTLNYQAHLTGAPVARPVFFSFPDFTPCYGLSTQFLLGSSVMVSPVLEEGATSVSAMFPPGTWYNLFDTSKVVVSKSGAPVRLEAPLNEVNVHMYQGTVLPMQRGGVISKEARLTPFTLVVAFPYGATQADAEGAVYVDDDERPEMVLAEGQATYVRFHASVRGKAVTVRSEVQMGSFSLHEGLVIEKVSVLGLEGTGRDLAIQVDGADATAVATSSPYFAAGGNMKLQGEDGFEDNKKSVSVEVGGLALPLGKSFTMTWNMRIEA

SEQ ID NO: 2865 - protein, 929 aa, Oryza sativa
MLASLSSSSRAAISCIPLCLLFLTLASSNGVFAAAPPKVGSGYKLVSLVEHPEGGALVGYLQVKQRTSTYGPDIPLLRLYVKHETKDRIRVQITDADKPRWEVPYNLLQREPAPPVTGGRITGVPFAAGEYPGEELVFTYGRDPFWFAVHRKSSREALFNTSCGALVFKDQYIEASTSLPRDAALYGLGENTQPGGIRLRPNDPYTIYTTDISAINLNTDLYGSHPVYVDLRSRGGHGVAHAVLLLNSNGMDVFYRGTSLTYKVIGGLLDFYLFSGPTPLAVVDQYTSMIGRPAPMPYWAFGFHQCRWGYKNLSVVEGVVEGYRNAQIPLDVIWNDDDHMDAAKDFTLDPVNYPRPKLLEFLDKIHAQGMKYIVLIDPGIAVNNTYGVYQRGMQGDVFIKLDGKPYLAQVWPGPVYFPDFLNPNGVSWWIDEVRRFHDLVPVDGLWIDMNEASNFCTGKCEIPTTHLCPLPNTTTPWVCCLDCKNLTNTRWDEPPYKINASGQTARLGFNTIATSATHYNGILEYNAHSLYGFSQAIATHQALQGLQGKRPFILTRSTFVGSGAYAAHWTGDNKGTWENLRYSISTMLNFGIFGMPMVGADICGFYPQPTEELCNRWIELGAFYPFSRDHANFASPRQELYVWESVAKSARNALGMRYRLLPYLYTLNYQAHLTGAPVARPVFFSFPDFTPCYGLSTQYLLGASVMVSPVLEQGATSVSAMFPPGSWYNLFDTTKVVVSRGEGAVKLDAPLNEINVHVFQNTILPMQRGGTISKEARATPFTLVVAFPFGATEAEAEGAVYVDDDERPEMVLAEGQATYVRFYATVRGKAVTVRSEVELGSYSLQKGLLIEKLSVLGLEGTGRDLAVHVDGANATAIATSRPYFAGAEAELHGHRDVEGHKKSVMVEVGGLALPLGKSFTMTWNMQIEA

SEQ ID NO: 2866 - protein, 948 aa, Triticum aestivum
MLPRSPPHLLPWRSLVLLFLALAVSSNGVSATAKAKAKAPAAPPKPAGFGYKLVSLVQRPNGGGLVGCLQVKRRSSTYGPDIPRLRLFVKHETKDRVRVQITDAEKQRWEVPYDLLPREPSPPLGPATAGGAPFTAGEYPGQDLVFTYGRDPFWFAVHRKSTRQTLFNTSRAPLVFKDQYLEVSTRLPGDAALYGLGENTQPGGIKLRPNDPYTLYTTDASAINLNTDLYGSHPVYVDLRNIGGRGVAHAVLLLNSNGMDVFYTGTSLTYKVIGGLLDFYFFAGPTPLAVVDQYTAMIGRPAPMPYWAFGFHQCRWGYHNLSVVEDVVENYRSAQIPLDVIWNDDDHMDARKDFTLSPVNYPRPKLLAFLDKIHARGMKYIVLIDPGINVNSTYGVYQRGMDRDIFIKLDGQPYLAQVWPGPVYFPDFINPNGASWWIDEVRRFHELVPVDGLWIDMNEASNFCTGKCTIPTTHRCPDPTSKEPWLCCLDCKNITNTRWDEPPYKINASGKSARLGYNTIATSAVHYNGILEYNAHSLYGFSQAIATHKGLQSIQGKRPFILTRSTFVGSGAYAAHWTGDNKGTWEDLRYSISTMLNFGIFGMPMVGSDICGFYPASPPPLEELCSRWIELGAFYPFSRDHANFASPRQELYQWQSVARSARNALGMRYRMLPYLYTLNYQAHLTGAPVARPLFFSFPDFAPCYGVSRQFLLGAGVMVSPVLEQGASSVDAVFPPGTWYNLFDTSKAVVSTGSGAAVRLPAPLNEVNVHVHQGTVLPLQRGGTISRDARATPFTLVVAFPLGAADADAEGAVYVDDDERPAMVLAEGQATYARFHAAVRGGKEVTVRSDVAMGSYSMHKGLVIEKITVLGLHGAGTDLAIQVDGADDATAVATSSPYFAAADAAQVLRQGEEEDAVEGEKRGVTMEVGGLALPLGKSFTMTWNMHIEA

SEQ ID NO: 2867 - protein, 939 aa, Brachypodium distachyon
MLVTRFSPHLFPWRLLLLFLTLVGSSNGAVAAPAKAHPPRPKAAAGFGYKLVSLVELPNGGGLVGSLQLKQPSSTYGPDIARLRLFVKHETQDRVRVQITDAEKQRWEVPYDLLPREPAPPLTKLPGGAPFTTGEYSGQSLSFTYGRDPFHFAVHRKSTGQTLFNTSHGGPLVFKDQYLELTTRLPKDAALYGLGENTQPGGIKLRPNDPYTIFTTDASAINLNTDLYGSHPVYVDLRNIGGHGVAHAVLLLNSNAMDVFYRGDSLTYKVIGGLLDFYFFAGPTPLAVVDQYTAMIGRPAPMPYWAFGFHQCRWGYQNLSVVEAVVEGYRNAQIPLDVIWNDDDHMDAAKDFTLDPVNYPRPKLLAFLDKIHAQGMKYIVLIDPGIAVNSSYGVYQRGMERDIFIKLDGQPYLAQVWPGPVYFPDFLNPNGASWWIDEVRRFHELVPVDGLWIDMNEVSNFCTGKCTIPTTHKCPVPNSKEPWLCCLDCKNLTNTRWDDPPYKINASGKSAPLGYNTIATSATHYNGILEYNAHSLYGFSQAIATHKGLQGLQGKRPFILTRSTFVGSGAYAAHWTGDNKGTWENLRYSISTILNFGIFGMPMVGADICGFYPADPNLLEELCSRWIELGAFYPFSRDHANFASPRQELYIWGSVAKSARNALGMRYRMLPYLYTLNYHAHQSGAPVARPLFFAFPDFVPGYGVSTQFLLGDSVMVSPVLEQGATSVSAVFPPGTWYNLFDTRKVIVSGNNGDAVKLDAPLNEINVHVHEGTVLPLQRGGSISRDARATPFTLVIAFPFGAADADAEGAVYVDDDERPAMVLAEGEATYVRFHASVRGGKEVTVRSEVSMGSYSLKKGLVVEKLSVLGLEGSGRDLAVRVDGTEEADATAIAVASAHFVGADEKLQEVGKKRSVMVEVGGLALPLGKSFTMTWNMHIQA

SEQ ID NO: 2868 - protein, 952 aa, Hordeum vulgare
MLPRPPSHLLPWRCLLLLLLTLTMACTSNGVSATAKANHKAKAPAAAPKPAGFGYRLVSLVQRPNGGGLVGLLQVKRRSSTFGPDIPRLRLFVKHETKDRVRVQVTDAEKQRWEVPYDLLPREPSPPLGVATDGHGAPFTVGEYPGQDLVFTYGRDPFWFAVHRRSTRQPLFNTSGAPLVFKDQYLEVSTRLPGDAALYGLGENTQPGGIKLRPNDPYTLYTTDASAINLNTDLYGSHPVYVDLRNLAGRGVAHAVLLLNSNGMDVFYTGTSLTYKVIGGLLDFYFFAGPTPLAVVDQYTAMIGRPAPMPYWAFGFHQCRWGYHNLSVVEDVVENYRSAQIPLDVIWNDDDHMDARKDFTLSPVNYPRPKLLAFLDKIHKRGMKYIVLIDPGINVNDTYGVYQRGMQRDIFIKLDGQPYLAQVWPGPVYFPDFINPNGASWWIDEVRRFHELVPVDGLWIDMNEASNFCTGKCTIPTTHRCPDPTSKEPWLCCLDCKNITNTRWDEPPYKINASGKTARLGFNTIATSAVHYNGILEYNAHSLYGFSQAIATHKGLQSIQGKRPFILTRSTFVGSGAYAAHWTGDNKGTWEDLRYSISTMLNFGIFGMPMVGADICGFYPAKPPPLEELCSRWIELGAFYPFSRDHANFASARQELYQWESVARSARNALGMRYRMLPYLYTLNYQAHLTGAPVARPLFFSFPDFAPCYGVSNQFLLGAGVMVSPVLEQGASSVDAVFPPGTWYNLFDTSKAVVSTGSGAAVRLPAPLNEVNVHVHQGTVLPLQRGGTISRDARATPFTLVVAFPLGAADADAEGAVYVDDDERPAMVLAEGQATYARFHAAVRGGKEVTVRSDVAMGSYVMHKGLVIERITVLGLHGTGRDLAIRVDGADDDATAVATSSPYFLAADAQVMHQGEEDAVEGEKRGVTMEVGGLELPLGKSFTMTWNMHIEA

SEQ ID NO: 2869 - protein, 689 aa, Hordeum vulgare
MDVFYTGTSLTYKVIGGLLDFYFFAGPTPLAVVDQYTAMIGRPAPMPYWAFGFHQCRWGYHNLSVVEDVVENYRSAQIPLDVIWNDDDHMDARKDFTLSPVNYPRPKLLAFLDKIHKRGMKYIVLIDPGINVNDTYGVYQRGMQRDIFIKLDGQPYLAQVWPGPVYFPDFINPNGASWWIDEVRRFHELVPVDGLWIDMNEASNFCTGKCTIPTTHRCPDPTSKEPWLCCLDCKNITNTRWDEPPYKINASGKTARLGFNTIATSAVHYNGILEYNAHSLYGFSQAIATHKGLQSIQGKRPFILTRSTFVGSGAYAAHWTGDNKGTWEDLRYSISTMLNFGIFGMPMVGADICGFYPAKPPPLEELCSRWIELGAFYPFSRDHANFASARQELYQWESVARSARNALGMRYRMLPYLYTLNYQAHLTGAPVARPLFFSFPDFAPCYGVSNQFLLGAGVMVSPVLEQGASSVDAVFPPGTWYNLFDTSKAVVSTGSGAAVRLPAPLNEVNVHVHQGTVLPLQRGGTISRDARATPFTLVVAFPLGAADADAEGAVYVDDDERPAMVLAEGQATYARFHAAVRGGKEVTVRSDVAMGSYVMHKGLVIERITVLGLHGTGRDLAIRVDGADDDATAVATSSPYFLAADAQVMHQGEEDAVEGEKRGVTMEVGGLELPLGKSFTMTWNMHIEA

SEQ ID NO: 2870 - protein, 219 aa, Saccharum officinarum
MAFTPATACCKPSLVLAPRASSRGSAARAQAALLCTPSTSAFRGLRAPASAAPAPPRWRRSAASTGIVCGKVSKGNVPPNFTLKDQNGKPVSLNKFKGKPVVVYFYPADETPGCTKQACAFRDSYEKFKKAGAEVIGISGDDAASHKAFAQKYRLPFTLLSDEGNRVRKEWGVPADLFGTLPGRQTYVLDKQGVVQYIYNNQFQPEKHIGETLKILQSL

SEQ ID NO: 2871 - protein, 212 aa, Sorghum bicolor
MAFTPATACCKPSLALAPRAASSRAQAAALLCTPSTSAFRGLRAAPAPPRWRRSAASTGIVCGKVSKGSVPPNFTLKDQNGKPVSLNKFKGKPVVVYFYPADETPGCTKQACAFRDSYEKFKKAGAEVIGISGDDAASHKAFAQKYRLPFTLLSDEGNRVRKEWGVPADLFGTLPGRQTYVLDKQGVVQYIYNNQFQPEKHIGETLKILQSL

SEQ ID NO: 2872 - protein, 219 aa, Setaria italica
MAFTPATACCNPSLLLAPRRASSSRGSPARAQALLCTPSTSAFRGLRGATSAAPAPRWRRAASSTAIVCGKVTKGSVPPNFTLKDQNGKPVSLNKFKGKPVVVYFYPADETPGCTKQACAFRDSYEKYKKAGAEVIGISGDDPASHKAFAQKYRLPFTLLADEGNRVRKEWGVPGDLFGTLPGRQTYVLDKNGVVQYIYNNQFQPEKHIGETLKILQSL

SEQ ID NO: 2873 - protein, 216 aa, Cynodon dactylon
MAFAPSTACCKPSALLAHQASSRGSPARAQALLCAPSTSAFHGLRAPLAAAPAPRRRAAFSTGIVCGKVSKGSAPPNFTLKDQNGKPVSLSKFKGKPVVVYFYPADETPGCTKQACAFRDSYEKFKKAGAEVIGISGDDTASHKAFAQKYRLPYTLLADEGNKVRKDWGVPSDLFGTLPGRQTYVLDKNGVVQYIYNNQFQPEKHIAETLKILQGL

SEQ ID NO: 2874 - protein, 218 aa, Leymus cinereus x Leymus triticoides
MAFAASTACCKPSALLTPRASSSSAPRAQALLCRPSTSAAFHGLRAPASAFALAPAPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 2875 - protein, 217 aa, Avena sativa
MAFAASTACCKPSALLAPRASSSPLRAQALLCSPSTSAKFHGLRAPASAFAVAPVPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIENL

SEQ ID NO: 2876 - protein, 216 aa, Festuca arundinacea
  misc_feature (181)..(181): Xaa can be any naturally occurring amino acid
MAFAASTACCKPSALLTPRASSSLRAQALLCRPSTSTTFRGVRAPASAIAVAPVPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGXQTYVLDKKGVVQYIYNNQFQPEKHIGETLKIIQNL

SEQ ID NO: 2877 - protein, 218 aa, Brachypodium distachyon
MAFAASTACCKPSPLLAPRASSLRAQAVLCRPSSTATTPRGLRAAAPASAFAQTPAPRRRAASTGIVCGKVTKGSVPPNFTLKDQDGKTVSLSKYKGKPVVLYFYPADETPGCTKQACAFRDSYEKYKKAGAEVIGISGDDAASHKAFAKKYKLPFTLLSDEGNKVRKEWGVPSDLFGTLPGRQTYVLDKKGVVQYVYNNQFQPEKHIGETLKIIQNL

SEQ ID NO: 2878 - protein, 709 aa, Sorghum bicolor
MEQTCCYFPLRWESTGDQWWYASPIDWAAADGHYDIVRQLLHLDPNLLIKLTSLRRIRRLEALWDDDARFADAARNRASVARSLLLECECRNPNHHRAGGENTLLRAGYGGWVLYTAASAGDAAFVRELLERDPLLVFGEGEYGVTDMFYAAARGRSADVFRLLLDHAMSPRCSTDCRNGQGGAGRGSMFRLEMMSRAVHAAARGGSVEMLRELLEEGPSSVSTYLDIRGSTVLHAAAGRGQLQVVKYLLASFDIINLTDNHGNTALHVAAYRGHQPVVEVLVAASPSTLSAVNNAGDTFLHSAVTGFRTPGFRRLDRQLELMRYLIRERTADIQKIINLRNDAGLTALHLAVVGCAHPDLVELLMTAPSIDLNAEDANGMTALALLKQQLRSATSDRLIRQIVSAGGVLNSSILRTRSAIASQIKMQGGIASSPGTTFKVSDAEIFLFSGMGAVESLRPSSCSSNGKDDPTHADADCAENHGSSEKRLSSASRAKDRLKMMLRWPRHKTPKKSEDSSPLDSIKKLSQHEAETPAPLRQKFTKTTALNGKRTLAVKSSTPSSSSTKKKLNTKLIHGIMEAMPQLAPATVRSGSPTDMLRRSSISSTPQPLAKLKDICLDDEISMVTPSVGKLKDIVLDSDDTTEDPSCSNSSMDDGCGTGTAESAARKHGCGNGRLINICFGAQGLTVEDSASGQQTSKMFKQQCLRVS

SEQ ID NO: 2879 - protein, 351 aa, Triticum aestivum
  misc_feature (5)..(5): Xaa can be any naturally occurring amino acid
DPRVXSTSLPLKQLPLKQRRKKKKKLEDMGAQRALLASFLLAALATQAFVSVSARTGPTDKAGQDDVKKPDCVPSLDPHNFPGHGGTTVPLPSHGGSSGTPPYHGGSGTTPSHGGSGSTPSHSGSGSLPDPSHGWYGTPPSHGGSGSLPDPSHSGGYGSTPDAPSHGEGAYGSSPTPSTGGAYGSSPTPSHDGGAYGSSPTPAHDGGSYSGTPAAPSHSSHGSVTPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAAAGGVDSAAAAQAASFKKANEGRKA

SEQ ID NO: 2880 - protein, 408 aa, Brachypodium distachyon
MNGASAGAGTGAGGEGPLVYQAWKGNNVFFFQGRFIFGPDARSLFVTMLLIIAPVSIFCVFVARELMSNFSYSLGLPVMVAAVVFTAYDLSLLLLTSGRDPGIIPRNAHPPEPEGFEGNAEVGANQTPPLRLPRIKDVVVNGITVKTKYCDTCMLYRPPRCSHCSICNNCVERFDHHCPWVGQCIGLRNYRFFYMFVFSTTLLCLYVFGFCWVYIVKIRNAEQITIWKAMAKTPASIALVVYTFIAVWFVGGLSVFHLYLMSTNQTTYENFRYRYDQRANPYNRGVVENIKEIFFTPIPQSRNNFGGRVPQDQGLRPRPTTGFMSPNMGRAVGDIEMGRKPVAWDEPRMAAEIGDLGGLGNLLEDKDGRFCNASPDLSRDALAVGGLDEQGSSAMNPPRSSWGVEAGR

SEQ ID NO: 2881 - protein, 374 aa, Leymus cinereus x Leymus triticoides
  misc_feature (137)..(137): Xaa can be any naturally occurring amino acid
  misc_feature (253)..(253): Xaa can be any naturally occurring amino acid
MNGASTGAGGEGPLVYKAWKGNNVFFLRGRFIFGPDARSLFVTMFLIIAPVTVFCVFVAKELMNRFSYGLGLPVMVVAVVFTAYDLSLLFLTSGRDPGIIPRNAHPPEPEGFEGNAEVGANQTPPLRLPRVKDVVVXGITVKTKYCDTCMLYRPPRCSHCSICNNCVERFDHHCPWVGQCIGLIRDAEQITIWKAMAKTPASIALVVYTFIAVWFVGGLSVFHLYLMSTNQTTYENFRYRYDQRANPYNRGVXENIKEIFFTPIPVSRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 2882 - protein, 413 aa, Oryza sativa
MNGASSGGGGGAGAGGDGPLVYQRWKGNNVFVLQGRFIFGPDARSLYVTMFLIIAPASIFCLFVAKELMNNFSYGLGLPVMISAVVFTAYDLSLLLLTSGRDPGIIPRNAHPPEPEGLDGNAEVGSNQTPPMRLPRVKDVVVNGITVKTKYCDTCMLYRPPRCSHCSICNNCVERFDHHCPWVGQCIGLRNYRFFYMFVFSTTLLCLYVFGFCWVYIVKIRNSEQITIWKAMAKTPASIALLVYTFIAVWFVGGLSVFHLYLMSTNQTTYENFRYRYDQRANPYNRGVMENIKDIFFSAIPASKNNFRARVPVPQEQGLRPRPTNGFMSPNMGRAVGDIEMGRKPVAWDEPRMAADIGDLGAGLGNLLEDKDGRFRSASPDLSRDALAIGGLDDQGSSVMNPGRTSWGVEAGR

SEQ ID NO: 2883 - protein, 414 aa, Pennisetum glaucum
MNGASASAGAGAGAGAGGEGPLVYEAWKGSNVFFLQGRFIFGPDARSLFVTMFLIVAPVSIFCAFVARELMDNFSYGMGLSVMIAAVLFTAYDLSLLLLTSGRDPGIIPRNAHPPEPEGFDGNAEVGANQTPPLRLPRVKDVVVNGITVKTKYCDTCMLYRPPRCSHCSICNNCVERFDHHCPWVGQCIGLRNYRFFYMFVFSTTLLCLYVFGFCWVYIIKIRNAEQITIWKAMAKTPASIALIIYTFIAVWFVGGLSVFHLYLMSTNQTTYENFRYRYDQRANPYNRGVVENIKEIFFTPIPPSKNNFRGRVPQEHGLRPRATNGFMSPNMGRAVGDIEMGRKPVAWDEPRMAAEIGDLGAGLSNLLEDKDGRFRSASPDLSRDALAVGGGLEEQGSSAMNPGRTSWGVEAGR

SEQ ID NO: 2884 - protein, 412 aa, Panicum virgatum
MNGASASAGPGAGAGAEGPLVYKAWKGSNVFFLQGRFIFGPDARSLFVTMFLIVAPVSIFCAFVARELMDNFSYGMGLSVMIAVVLFTAYDLSLLLLTSGRDPGIIPRNAHPPEPEGFDGNAEVGANQTPPLRLPRVKDVVVNGITVKTKYCDTCMLYRPPRCSHCSICNNCVERFDHHCPWVGQCIGLRNYRFFYMFVFSTTLLCLYVFRFCWVYIVKIRNAEQITIWKAMSKTPASIALIIYTFIAVWFVGGLSVFHLYLMSTNQTTYENFRYRYDQRANPYNRGVVENIKEIFFTPIPPSKNNFRGRVPQEHGLRPRATNGFMSPNMGRAVGDIEMGRKPVAWDEPRMAAEIGDLGAGLSNLLEDKDGRFRSASPDLSRDALAVGGGFEEQGSSAMNPGRTSWGVEAGR

SEQ ID NO: 2885 - protein, 373 aa, Brachypodium distachyon
  misc_feature (136)..(136): Xaa can be any naturally occurring amino acid
  misc_feature (252)..(252): Xaa can be any naturally occurring amino acid
MNGASTGAGGEGPLVYKAWKGNNVFFLRGRFIFGPDARSLFVTMFLIIAPVTVFCVFVAKELMNRFSYGLGLPVMVVAVVFTAYDLSLLLLTSGRDPGTIPWNAHPEPEGFEGNAEVGAYQTPLLRLPRVKDVVVXGITVKTKYCDTCMLYRPPRCSHCSICNNCVERFDHHCPWVGQCIGLIRDAEQITIWKAMAKTPASIALVVYTFIAVWFVGGLSVFHLYLMSTNQTTYENFRYRYDQRANPYNRGVXENIKEIFFTPIPVSRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 2886 - protein, 406 aa, Zea mays
MNGASAGAGGEAPLVYKAWKGNNVFLLKGRFIFGPDARSLFITMFLIVAPVSIFCAFVAKELMDKFSYGLGLPVMIAAVLFTAYDLSLLLLTSGRDPGIIPRNAHPPEPEGFDGNAEVGANQTPPVRLPRVKDVVVNGITVKTKYCDTCMLYRPPRCSHCSICNNCVERFDHHCPWVGQCIGLRNYRFFYMFVFSTTLLCLYVFGFCWVFIIKIRNAEQITIWKAMTKTPASIALIIYTFIAVWFVGGLSVFHLYLMSTNQTTYENFRYRYDQRDNPYNKGVMENIKEIFFTTIPPSKNNFCGRVEQEHGLRPRPTNGFMSPNMGRAVGDIEMGRKPVAWDEPRMAAEIGDLGAGLSNLLEDKDGRFRTTSPDLSRDALAVGGGLEEHGSSAMNPGRSSWGVEAGR

SEQ ID NO: 2887 - protein, 412 aa, Zea mays
MNEASASAGVGTGSGGEVPLVYKAWKGNNVFLLKGRFIFGPDARSLFVTMFLIVAPVSIFCPLVAKELMDKFSYGLGLPVMIAAVLFTAYDLSLLLLTSGRDPGIIPRNAHPPEPEGFDDNAEVGANQTPPVRLPRVKDVVVNGITVKIKYCDTCMLYRPPRCSHCSICNNCVERFDHHCPWVGQCIGLRNYRFFYMFVFSTTLLCLYVFGFCWVFVVKIRNAEQITIWKAMTKTPASVALIIYTFIAVWFVGGLSVFHLYLMSTNQTTYENFRYRYDQRANPYNRGIMVNIKQILFTTIPPSKNNFCGRVQQEHGLRPRPTNGFMSPNMGRAVGDIEMGRKPVAWDEPRMAAEIGDLGAGLSNLLEDKDGRFRSASPDLSRDALAVGGGLEEEGSSAMNAGRSSWGVEAGR

SEQ ID NO: 2888 - protein, 197 aa, Solanum tuberosum
MAITNLLSTTITLKHSPFLLLKPSTKLRNPKRPTIRAQSKNDDSVDGPDRLISAITYFYPFFDGVQYGKYVITQFAPIQTLIQPLVPAIRVFKSFPLNGLLVFFTLYFIVVRNPNFSRYVRFNTMQAIVLDVLLIFPDLLERSFNPTDGFGLDLMMSFDSTVFLFLLVSLVYGSSSCLLGQLPRLPIVAEAADRQVL

SEQ ID NO: 2889 - protein, 197 aa, Solanum phureja
MAITNLLSTTITLKHSPFLLLKPSAKLRNPKRPTIRAQSKNDDSVDGPDRLISAITYFYPFFDGVQYGKYVITQFAPIQTLIQPLVPAIRVFKSFPLNGLLVFFTLYFIVVRNPNFSRYVRFNTMQAIVLDVLLIFPDLLERSFNPTDGFGLDLMMSFDSTVFLFLLVSLVYGTSSCLLGQLPRLPIVAEAADRQVL

SEQ ID NO: 2890 - protein, 202 aa, Solanum melongena
MAITNLLSTTITPIHFSHKHSPFLLLKPARKLRNPKRPTIRAQSKNEDSVDGPDRLISAITYFYPFFDGIQYGKYVITQFAPIQTLIQPLVPAIRVFKIFPLNGLLVFFTLYFIVVRNSNFSRYVRFNTMQAIVLDVLLTFPDLLERSFNPRDGFGLDLMMSLDSTVFLFLLVCLVYGSSSCLLGQLPRLPIVAEAADRQVL

SEQ ID NO: 2891 - protein, 212 aa, Petunia hybrida
MAIINLLSTTITPIPFSYNKQLLYTTTSHFTSQLKHSPFLPLKTPKRPTIRAQSKNDDTADGPDRLISAIAYFYPFFDGVQYGKYVITQFAPIQTIIQPLVPAIRVFKSFPLNGLLVFFTLYFVVVRNQNFSKYVRFNTMQAIVLDVLLIFPDLLERSFNPKDGLGLDLMMSFDSTVFLFLLVSLAYGTSSCLLGQLPRLPIVAEAADRQVL

SEQ ID NO: 2892 - protein, 223 aa, Sorghum bicolor
PQTAEKKQNPRSTAPHFYPRPWPPPMPTPGPARGTPSRRTSRSASSPSSPSPSYFPSPRCPARSAASCGPRRSTPSYPRTASTPSSSFPHGSPSTRCPAASSLCLRSPRSLPLPTRSSPPRPHRSSSPAPHSSSSRRSPTEPTSSPLSSRRAAPPPPAPSSLSPPAQPCVLTPWTPAIPPRVGRLEAISRCLSRSWETPQSPVTAASSSSSAVVPTRSWLLIS

SEQ ID NO: 2893 - protein, 801 aa, Sorghum bicolor
MEEEQSPRLGREPATEPSPSLEWPEPECKNDDGVKDPEDPESTGGGGDGNGISSLEQPLLKRSTTLTASHLAIVGAKVSHIESLDYEIIENDLFKHDWRSRSNVEVLQYIFLKWAMAFLVGLLTGVIASLINLAIENISGLKMQHMVNLVREKRYWAGFLYFAGVNFALTFVAAVLCVVFAPTAAGPGIPEIKAYLNGVDTPNMFGAPQLIVKIIGSIGAVSSGMDLGKEGPLVHIGACLANLLSQGGEGRWRLRWRWLRYFNNDRDRRDLITCGASSGVCAAFRAPVGGVLFALEEVATWWRSALLWRTFFSTATVVVVLRGFIEVCRDGRCGMFGEGGLILFDVSDVTVRYHVGDLLPVTLVGVLGGVLGALYNHVLHQVLRLYNLINAKGRMAKLALALAVSVFTSAGLYLLPFAVPCSPCDPAFGDACPTVGKSGNFKQFNCPDGYYNDLASLLHATNTDATRNIFSTGTAGEFRLDSLLIFFAIYCVLGLFTFGIAVPSGLFLPIILMGSAYGRMVALVLARFVRIDHGLYAVLGAAALMSGSMRMTVSLCVIFLELTNNLLLLPITMFVLLIAKTVGDAFNPSIYEIILDLKGLPFLEPKPETWMKDLAVGELAAAKPRVVTLQVIEKVSTVVEVLRSTPHNGFPVLDRPRPGVSELHGLVLRSHLMAVLKKRWFLTEKRRTEEWEARERFSSTELAEKSGSIDEVAVQLTPEELDMYIDLHPFTNTTPYTVVETMSVAKAVVLFRTCALRHMLIIPKFQGPEIAPIVGILTRQDLRAHNILGAFPHLANKRKVH

SEQ ID NO: 2894 - protein, 801 aa, Zea mays
MEEEQSPRLGRDPATEPSPAPEWPDSDSKNDDSANDPEDPAGGSGSGSGNGISSLEQPLLKRSTTLTASHLAIVGAKVSHIESLDYEIIENDLFKHDWRSRSNVEVLQYIFLKWAMAFLVGLLTGVIASLINLAIENISGLKMLQMVNLVRGKRYWAGFLYFAGVNFALTFVAAVLCVVFAPTAAGPGIPEIKAYLNGVDTPNMFGAPQLIVKIIGSIGAVSSGMDLGKEGPLVHIGACLANLLSQGGEGRWRLRWRWLRYFNNDRDRRDLITCGASSGVCAAFRAPVGGVLFALEEVATWWRSALLWRTFFSTATVVVVLRGFIEVCRDGRCGMFGEGGLILFDVSDVTVRYHVGDLLPVTLVGVLGGVLGALYNHVLHQVLRLYNLINAKGRLAKLALALAVSVFTSAGLYLLPFAVPCTPCDPAFGDACPTVGKSGNFKQFNCPTGYYNDLASLLHATNVDATRNIFSTGTAGEFRLDSLLIFFGIYCVLGLFTFGIAVPSGLFLPIILMGSAYGRILALVLARFVRIDHGLYAVLGAAALMSGSMRMTVSLCVIFLELTNNLLLLPITMFVLLIAKTVGDAFNPSIYEIILDLKGLPFLEPKPETWMKDLAVGELAAAKPRVVTLQVIEKVSTVVEVLRSTPHNGFPVLDWPRPGVSELHGLVLRSHLMAVLKKRWFLTDKRRTEEWEARERFSSTELAEKSGSIDEVAVQLTPEELDMYIDLHPFTNTTPYTVVETMSVAKAVVLFRTCALRHMLIIPKFQGPEIAPIVGILTRQDLRAHNILGAFPHLANKRKVH

SEQ ID NO: 2895 - protein, 840 aa, Zea mays
MEEEQSPRLGRDPATEPSPAPEWPDSDSKNDDSANDPEDPAGGSGSGSGNGISSLEQPLLKRSTTLTASHLAIVGAKVSHIESLDYEIIENDLFKHDWRSRSNVEVLQYIFLKWAMAFLVGLLTGVIASLINLAIENISGLKMLQMVNLVRGKRYWAGFLYFAGVNFALTFVAAVLCVVFAPTAAGPGIPEIKAYLNGVDTPNMFGAPQLIVKIIGSIGAVSSGMDLGKEGPLVHIGACLANLLSQGGEGRWRLRWRWLRYFNNDRDRRDLITCGASSGVCAAFRAPVGGVLFALEEVATWWRSALLWRTFFSTATVVVVLRGFIEVCRDGRCGMFGEGGLILFDVSDVTVRYHVGDLLPVTLVGVLGGVLGALYNHVLHQVLRLYNLINAKGRLAKLALALAVSVFTSAGLYLLPFAVPCTPCDPAFGDACPTVGKSGNFKQFNCPTGYYNDLASLLHATNVDATRNIFSTGTAGEFRLDSLLIFFGIYCVLGLFTFGIAVPSGLFLPIILMGSAYGRILALVLARFVRIDHGLYAVLGAAALMSGSMRMTVSLCVIFLELTNNLLLLPITMFVLLIAKTVGDAFNPSIYEIILDLKGLPFLEPKPETWMKDLAVGELAAAKPRVVTLQVIEKVSTIVEVLRSTPHNGFPVLDWPRPGVSELHGLVLRSHLMAVLKKRWFLTEKRRTEEWEARERFSSTELAEKSGSIDEVAVQLTPEELDMYIDLHPFTNTTPYTVVETMSVAKAVVLFRTCALRHMLIIPKFQGPEVHSSNRGDPNEAGPEGTQHPWCIPSFGKQKESTLSSVAPFLVNLMFSASKEKGPAVLFPHVLFFSVSRLRI

SEQ ID NO: 2896 - protein, 790 aa, Brachypodium distachyon
MEGEQSQLGLAGEPPTTASPGAQQGKHDDGVNNDNEDPENQESGNGGIRSLEQPLLKRSNTLTASHLAMVGAKVSHIESLDYEIIENDLFKHDWRRRSNGEVLQYIFLKWALAFLVGLLTGVIASLINLAIENISGLKMLHMVQLVRDKRYWAGFLYFSGINFALTFVAAVLCVVFAPTAAGPGIPEIKAYLNGVDTPNMFGMPQLIVKIIGSICAVSSGLDLGKEGPLVHIGACLANLLSQGGGIRWLRYFNNDRDRRDLITCGASSGVCAAFRSPVGGVLFALEEVATWWRSALLWRTFFSTATVVVVLRGFIEVCRDGRCGLFGEGGLIIFDVSDVTVRYHVGDLLLVTLVGVIGGILGSLYNYLLHMVLRLYNLINDKGKSAKLCLALAVCVFTSAGLYLLPFAVPCTPCDPAFGAACPSTGKSGNFKQFNCAAGEYNDLATLLHATNVDATRNIFSTGTPHEFRLDSLLIFFAIYCVLGLFTFGIAVPSGLFLPIILMGAAYGRIVALVLQRFAQIDHGLYAVLGAAALMSGSMRMTVSLCVIFLELTNNLLLLPLTMFVLLIAKTVGDAFNPSIYEIILDLKGLPFLEPKPEPWMKDLTVGELAAAKPRTVSLQVVERVSTIVEVLRGTGHNGFPVVGRPRPGLSELHGLVLRSHLVAVLRKRWFLTEQRRTEDWEARERFSSVELADKSAKLEDLQEITPEEMEMFVDLHPFTNTTPYTVVETMSVAKAVVLFRAVALRHMLIMPKFQGPEISPIVGILTRQDLRAHNILGAFPHLANKRKAH

SEQ ID NO: 2897 - protein, 660 aa, Setaria italica
MAFLVGLLTGVIASLINLAIENITGLKMLHMVGLVREGRYWAGFLYFAGVNLALTFVAAVLCVVFAPTAAGPGIPEIKAYLNGVDTPNMFGAPQLIIIGSIGAVSSGMDLGKEGPLVHIGACLANLLSQGGEGRWRLRWRWLRYFNNDRDRRDLITCGASSGVCAAFRSPVGGVLFALEEVATWWRSALLWRTFFSTATVVVVLRGFIEVCRDGRCGMFGEGGLILFDVSSVTVRYHLGDLLPVTIVGVLGGVLGALYNHVLHQVLRLYNLINAKGRLAKLALALAVSVITSAGLYVLPFAVPCTPCSAAGAAADFCPTVGKSGNFKKFNCPDGFYNDLASLLHATNTDATRNIFSTGTAGEFRLDSLLIFFAVYCVLGLITFGIAVPSGLFLPIILMGSAYGRILALLLARFVHIDHGLYAVLGAAALMSGSMRMTVSLCVIFLELTNNLLLLPITMFVLLIAKTVGDAFNPSIYEIILDLKGLPFLEPKPETWMKDITVGELAAAKPRAVTLQVVEKVSTIVAVLRATPHNGFPVLDRPRPGVSELHGLVLRQHLMAVLRKRWFLQEKRRTEEWEARERFSSTELAEKAGSIDDVQLSPEELDMYIDLHPFTNTTPYTVVETMSVAKAVVLFRTCALRHMLIIPKFQGLEISPIMGRI

SEQ ID NO: 2898 - protein, 715 aa, Pennisetum glaucum
EIIENDLFKHDWRSRSNVEVLQYIFLKWAMAFLVGLLTGVIASLINLAIENITGLKMLHMVGLVREGRYWSGFLYFAGVNLALTFVAAVLCVVFAPTAAGPGIPEIKAYLNGVDTPNMFGAPQLIVKIIGSIGAVSSGMDLGKEGPLVHIGACLANLLSQGGEGRWRLRWRWLRYFNNDRDRRDLITCGASSGVCAAFRAPVGGVLFALEEVATWWRSALLWRTFFSTATVVVVLRGFIEVCRDGRCGMFGEGGLILFDVSGVTVRYHLGDLLPVTLVGVLGGVLGALYNHVLHQVLRLYNLINAKGRMAKLALALAVSVITSAGLYMLPFAVPCTPCSAAGAAADTCPTVGKSGNFKQFNCPDGFYNDLASLLHATNTDATRNIFSTGTAGEFRLDSLLIFFAVYCVLGLITFGIAVPSGLFLPIILMGSAYGRILALLLARFVHIDHGLYAVLGAAALMSGSMRMTVSLCVIFLELTNNLLLLPITMFVLLIAKTVGDAFNPSIYEIILDLKGLPFLEPKPETWMKDLTVGELAAAKPRAVTLQVVEKVSTVVAVLRATPHNGFPVLDRPRPGVSELHGLVLRQHLMAVLRKRWFLAEKRRTEEWEAREKFSSTELAEKAGSIDDLQLSPEEMDMYIDLHPFTNTTPYTVVETMSVAKAVVLFRTCALRHMLIIPKFQGLEISPIMGILTRQDLRAHNILGAFPHLANKRKVH

SEQ ID NO: 2899 - protein, 357 aa, Solanum phureja
MADLNPFDLLGDDDNDDPSKLIAIHQQKVDPAKRASAPAAKKQPAKLPTKPPPPTQAVREAKTEFGRGGGRGGGRGYSRGRGGGGFNREASNNENFSRNREFSGGIAAPEYMEGGRPSERRGGYGGPHAFRGGRPGGFGNEEMPEGDRPRRTFERRSGTGRGNEIKREGAGRGNWGTEADEVTQMTGEVADEGEKNLNVEKPSTEEEAGDDKKENPAAEAEDKEPEDKEMTLEEYEKLLEEKRKALQALKTEERKVDTKVFESMQQISKKPSDEIFVKLGSKDKRKESAEKEEKAKKAVSINEFLKPAEGERYYAPGGRGRGRGRGSRGYSGANTMSNVEAAPPIEDPGHFPTLGGK

SEQ ID NO: 2900 - protein, 355 aa, Solanum tuberosum
MADLNPFDLLGDDDNDDPSKLIAIHQQKVDPAKRASAPAAKKQPAKLPTKPPPPTQAVREAKTEFGRGGGRGGGRGYSRGRGGGGFNREASNNENFSRNREFSGGIAAPEYRGRPSERRGGYGGPHAFRGGRPGGFGNEEMPEGDRPRRTFERRSGTGRGNEIKREGAGRGNWGTEADEVTQMTGEVADEGEKNLNVEKPSTEEEAGDDKKENPAAEAEDKEPEDKEMTLEEYEKLLEEKRKALQALKTEERKVDTKVFESMQQISKKPSDEIFVKLGSKDKRKESAEKEEKAKKAVSINEFLKPAEGERYYAPGGRGRGRGRGSRGYSGANTMSNVEAAPPIEDPGHFPTLGGK

SEQ ID NO: 2901 - protein, 360 aa, Capsicum annuum
MADLNPFDLLGDDDTDDPSKLIAIHQQKAAPTKKPSGPAAAAKKQPAKLPTKPPPPTQAVREAKTEFGRGGGSGGGRGYSRGRGGGGFNRESSNNENFPRNREFSGGIVAPEYVEGGRPSERRGGYGGPRAFRGGRQGGFSNGEMPEGDRPRRTFERRSGTGRGSEIKREGAGRGNWGTEADEVTQMTGEVANEGEKNLNVEKPSTEEEAGDDKKENLVAEAEDKEPEDKEMTLEEYEKLLEEKRKALQALKTAEERKVDTKVFESMQQLSKKSGDEIFVKLGSKDKKRESAEKEEKAKKAVSINEFLKPAEGERYYAPGGRGRGRGRGSRGYSGASTTSNVEAAPPIEDPGHFPTLGGK

SEQ ID NO: 2902 - protein, 356 aa, Solanum melongena
MADLNPFDLLCDDDNDDPSKLIAIHQQKVDPAKKASAPAAKKQPAKLPTKPPPPTQAVREAKTEFGRGGGRGGGRGYNRGRGGGGFNREASNNENFSRSREFSSGIAAPEYVEGGRPSERRGGYGGPRPFRGGRQGDSSNGEMPEGDRPRRIFERRSGTGRGSEIKREGSGRGNWGTEVDEVTQMTGEVSNEGEKNLNVEKPSTEEEAGDDKKENEAAKAEDKEPEAKEMTLEEYEKLLEEKRKALQALKTEERRVDTKVFESMQQLSKKSSDEIFVKLGSKDKRRESSEKEEKAKKAVSINEFLKPAEGERYHAPGGRGRGRGRGRGYTGANTTSNVEAAPPIEDRGHFPTLGGK

SEQ ID NO: 2903 - protein, 360 aa, Nicotiana benthamiana
MADLNPFDLLGDDDNDDPSKLIAIQQQKVDTAKKPSAPAAAAAKKQPAKLPTKPPPPAQAVREAKTEVGRGGGRGGGRGYSRGRGGGGFNREASNTENFSRNREFSGGIAAPEDVEGGRLYERRGGYGGPHAFGGGRRAGFSNGEFPEGDRPRRIFERRSGTGRGGEIKREGAGRGNWGTQADEVTQISDEVANEGEKNLNAEKPSADGEAGDDKKENPAAEAEDKEPENKEMTLEEYEKVLEEKRQALQALKTEERKVDTKEFESMQQLSKKSSDDIFIKLGPKDKRKESAEKEEKAKKAVSINEFLKPAEGERYYAPGGRGRGGRGRGSRGYGGADTTSNVEAPPIEDPGHFPTLGGK

SEQ ID NO: 2904 - protein, 464 aa, Sorghum bicolor
MAPAATARHVVAVPYPGRGHINPMLVVCRLLAAADAAVSITVVVTEEWHALLAAAGVPDALPDRVRLATIPNVIPSERDRGADFAGFVEAVQVKMVGPVERLLDRLTLERKPDAIVADTFLTWGVTAGAARGIPVCSLWTQPATFFLALWHLDRWPPVDEEGLSCKSLDQYFPFPALSSVKCSDIKIFRSMVLPMKRLAEVFSNVRKAQCVLFTSFYELETGAINGTRQVVPCPIYTVGPSIPYLSLKGDSAKLHHENYFDWLDCQPRNSVLYVSFGSYVSMPSSQLEEVALGLHESTVRFVWVARDRATTTTLQQISGDKGLVVPWCDQLKVLCHPSIGGFLSHCGWNSTLEAVFAGVPMLAFPVFWDQLVIGHLVADEWKIGINLREQRREDGVVSRAAISDAVTKLMDLSDDDSLEMRRRAAELREASLGAIQEGGSSRCSLNNFFTDIIEGRLNVAETSL

SEQ ID NO: 2905 - protein, 355 aa, Brachypodium distachyon
MSSLAMNSLLATLAVAVLALFPIAAVGAGLKVGFYSKTCPSAETLVQQAVAASFKNNGGVAAGLIRLHFHDCFVKGCDGSVLIDSTANNTAEKDAIPNNPSLRGFEVIDAAKKAIEAKCPKIVSCADILAFAARDSIALAGNVTYKVPAGRRDGRISSDQNALNNLPSPLSTASELVGNFTLKNLTAEDMVVLSGAHTIGVSRCSSFTNRLYGFSNTSQVDPTMSSAYAFLLKNICPANSSQFFPNTTMDMDIITPAVLDNKYYVSLINNLGLFTSDQALLTNSTLKASVDEFVKNENRWKSKFVKSMVKMGNIEVLTGTQGEIRLNCRVINKGSTGLEFNSGINSGEFTEIATS

SEQ ID NO: 2906 - protein, 289 aa, Saccharum officinarum
MGDHEGRGDDFEKKADQKLSGWGLFGNKYEEAADLLDRAGNFFKLAKNWSRAAAVYKKIADCHLRGDSKHEAASAYVEAANCYKKFSPQDAAQALNNAVNLFLEIGRLNMAARYSKDIGEIYQQEQDLENAAVYLNRAADLFDSEGQSSQANSMTQKIAEIYAQLEKYQKATELFEEIARKSINNNLLKYGVRGILLNAGLCQLCRGDTVAINNSLERYQDIDPTFSGTREYKLLADLAASMDEGDVDKFTDAVKEFDSMTRLDPWKTSLLLKAKNELKKKDEDEDDLT

SEQ ID NO: 2907 - protein, 289 aa, Zea mays
MGDHEGHGVDFEKKADQKLSGWGLFGNKYEEAADLLDRAGSFFKLAKNWSRAAAVYKKIADCHLQGDNKHDAASAYVEAANCYKKFSLQDAAQALNSAVNLFQEISRLNMAARYSKDIGEIYLQEQDLENAAVYLNRAADLFDSEGQSSQANSMTQKIAEIYAQLEKYQKATELFEEIARKSINNNLLKYGVRGTLLNAGICQLCRGDVVAINNSLERYQDIDPTFSGTREYKLLADLAASTDEGDVGKFTDAVKEFDSMTRLDPWKTTLLLKAKNELKKKEEDEDDLT

SEQ ID NO: 2908 - protein, 289 aa, Pennisetum glaucum
MGDHELRGDDFVKKADQKLSGWGFFGNKYEDAAELLDKAGNFFKLAKNWSRAAEVYKKIAHCHLQGDSKHEAASAYVEAANCYKKFSPQDAAQALDSAVNLFLEIGRLNMAARYSKDIGEIYLQEQDLENAAVYLNRAVDLFDSEGQSSQANSVTQKIAEIYAQLEKYQKATELFEEIARKSINNNLLKYSVRGILLNAGICQLCRGDPVAINNSLERYQDIDPTFSGTREYKLLADLAASMDEGDVAKFTDAVKEFDSLTRLDPWKTTLLLKAKNELKKKEDDEDDLT

SEQ ID NO: 2909 - protein, 289 aa, Setaria italica
MGDHELRGDDFVKKADQKLSGWGFFRNKYEDAADLLDKAGNFFKLAKNWSRAAAVYKKIADCHLQGDGKHEAASAYVEAANCYKKFSPQDAAQALDSAVNLFLEIGRLNMAARYSKDIGEIYQQEQDLENAAVYLNRAADLFDSEGQSSQANSMTQKIAEIYAQLEKYQKATELFEEIARKLISNNLLKYSVRGILLNAGICQLCRGDPVAINNSLERYQDIDPTFSGTREYKLLADLAASMDEGDVAKFTDAVKEFDSFTRLDPWKTTLLLKAKNELKKKEDDDEDLT

SEQ ID NO: 2910 - protein, 289 aa, Cenchrus ciliaris
MGDHELRGDEFVKKADQKLSGWGFFGNKYEDAADLLDKAGNFFKLAKNWSRAAAVYKRIADCHLQGDNKHEAASAYVEAANCYKKFSPQDAAQALDSAVNLFLEIGRLNMAARYSKDIGEIYQQEQDLENAAVYLNRAVDLFDSEGQSSQANSISQKIAEIYAQLEKYQKATELFEEIARKSINNNLLKYSVRGILLNAGICQLCRGDPVAINNSLERYQDIDPTFSGTREYKLLADLAASMDEGDVVKFTDAVKEFDSLTRLDPWKTTLLLKAKNELKKKEVDEDDLT

SEQ ID NO: 2911 - protein, 289 aa, Saccharum officinarum
MGDHEARGDDFEKKAEKKLSGWGLFSSKYEDAADLFDKAANSFKLAKNWSRAASVYIKIANCHLKGDSKHEAASAYVEAANCYKKFSPQEAAQALNQSVNLFLEIGRLNMAARYSKDIGEIYQQEQDLEKATDYLERAADLFDSEGQSSQSNIIKQKVAEIAAQLEQYPKATEIFEAIARQSINNNLLKYSVRGILLNAGICQLCRGDPVAIINSLERYQEIDPTFSGTREYKLLADLAASMDEGDVAKFTDAIKEFDSMTRLDPWKTTLLLRAKNELKKKDDDEDDLT

SEQ ID NO: 2912 - protein, 289 aa, Panicum virgatum
MGDHEARGDDFEKKAEKKLTGWGIFGSKYEDAADLFDKAANSFKLAKNWSRAASVYIKIANCHLKGDSKHEAASAYVEAANCYKKFSPQEAAQALNQAVNLFLEIGRLNMAARYSKDIGEIYQQEQDLEKATDYLERAADLFDSEGQSSQANTIKQKVAEIAAQLEQYPKATEIFEGIARQSINNNLLKYGVRGILLNAGICQLCRGDPVAITNSLERYQEIDPTFSGTREYKLLADLAASMDEGDIAKFTDAIKEFDSMTRLDPWKTTLLLRAKNELKKKEDDEDDLT

SEQ ID NO: 2913 - protein, 289 aa, Setaria italica
MGDHEARGDDFEKKAEKKLSGWAIFGSKYEDAADLFDKAANSFKLAKNWSRAASVYIKIANCHLKGDSKHEAASAYVEAANCYKKFSPQEAAQALNQAVNLFLEIGRLNMAARYSKDIGEIYQQEQDLEKATDYLERAADLFDSEGQSSQANTIKQKVAEIAAQLEQYPKATEIFEGIARQSINNNLLKYSVRGILLNAGICQLCRGDPVAITNSLERYQEIDPTFSGTREYKLLADLAASMDEGDIAKFTDAIKEFDSMTRLDPWKTTLLLRAKNELKKKEDDEDDLT

SEQ ID NO: 2914 - protein, 289 aa, Zea mays
MGDHEARGDDFEKKAEKKLSGWGLFGSKYEDAADLFDKAANSFKLAKNWSRAASVYIKIANCHLKGDSKHEAASAYVEAANCYKKFSPQEAAQALNQSVNLFLEIGRLNMAARYSKDIGEIYQQEQDLEKATDYLERAADLFDSEGQSSQSNTIKQKVAEIAAQLEQYPKATEIFEAIARQSINNNLLKYSVRGILLNAGICQLCRGDPIAITNSLERYQEIDPTFSGTREYKLLADLAASMDEGDVAKFTDAIKEFDSMTRLDPWKTTLLLRAKNELKKKEDDEDDLT

SEQ ID NO: 2915 - protein, 289 aa, Pennisetum glaucum
MGDHEARGHDFEKKAEKKLSGWAIFGSKYEDAADLFDKAANSFKLAKNWSRAASVYIKIANCHLKGDSKHEAASAYVEAANCYKKFSPQDAAQALNQAVNLFLEIGRLNMAARYSKDIGEIYQQEQDLEKATDYLERAADLFDSEGQSSQSNSIKQKVAEIAAQLEQYPKATEIFEAIARQSINNNLLKYSVRGILLNAGICQLCRGDPVAITNSFERYQEIDPTFSGTREYKLLADLAASMDEGDIAKFTDAIKEFDSMTRLDPWKTTLLLRAKNELKKKEDDEDDLT

SEQ ID NO: 2916 - protein, 285 aa, Pennisetum glaucum
EARGHDFEKKAEKKLSGWAIFGSKYEDAADLFDKAANSFKLAKNWSRAASVYIKIANCHLKGDSKHEAASAYVEAANCYKKFSPQDAAQALNQAVNLFLEIGRLNMAARYSKDIGEIYQQEQDLEKATDYLERAADLFDSEGQSSQSNSIKQKVAEIAAQLEQYPKATEIFEAIARQSINNNLLKYSVRGILLNAGICQLCRGDPVAITNSFERYQEIDPTFSGTREYKLLADLAASMDEGDIAKFTDAIKEFDSMTRLDPWKTTLLLRAKNELKKKEDDEDDLT

SEQ ID NO: 2917 - protein, 289 aa, Leymus cinereus x Leymus triticoides
  misc_feature (57)..(57): Xaa can be any naturally occurring amino acid
MGDHEARGDDTERKADKKLSGWGLFGSKYEDAADLYDKAANFFKLAKNWNRAASVYXKIANCHLKGDSKHEAASAYVEAANCYKKFSPQEAAQALDQAVNLFLEIGRLSMAARYCKDIGEIYQQEQDLEKASDYLERAADLFDSEGQTSQSNTIKQKVAEIAAQLEQYPKATEIFEEIARQSINNNLLKYSVRGILLNAGICQLCRADAVAIQNSLERYQEIDPTFSGTREYKLLADLAASMDDGDVAKFTDAIKEFDGMTRLDPWKTTLLLRAKNELKKQEDDEDDLT

SEQ ID NO: 2918 - protein, 289 aa, Triticum aestivum
MGDHEARGDDTERKADKKLSGWGLFGSKYEDAADLYDKAANFFKLSKNWNRAASVYIKIANCHLKGDSKHEAASAYVEAANCYKKFSPQEAAQALDQAVNLFLEIGRLSMAARYCKDIGEIYQQEQDLEKASDYLERAADLFDSEGQTSQSNTIKQKVAEIAAQLEQYPKATEIFEEIARQSINNNLLKYSVRGILLNAGICQLCRADAVAIQNSLERYQEIDPTFSGTREYKLLADLAASMDDGDVAKFTDAIKEFDGMTRLDPWKTTLLLRAKNELKKQEDDEDDLT

SEQ ID NO: 2919 - protein, 289 aa, Hordeum vulgare
MGDHEARGDDTERKADKKLSGWGLFGSKYEDAADLYDKAANFFKLSKNWNRAASVYIKIANCHLKGDSKHEAASAYVEAANCYKKFSPQEAAQALDEAVNLFLEIGRLSMAARYCKDIGEIYQHEQDLEKASDYLERAADLFDSEGQTSQSNTIKQKVAEIAAQLEHYPKATEIFEDIARQSINNNLLKYSVRGILLNAGICQLCRADTVAIQNSLERYQEIDPTFSGTREYKLLADLAASMDDGDVAKFTDAIKEFDGMTRLDPWKTTLLLRAKNELKKQEDDEDDLT

SEQ ID NO: 2920 - protein, 289 aa, Brachypodium distachyon
MGDHEARGDDMEKKAEKKLSGWGLFSSKYEDAADLYDKAANFFKLSKNWNRAASVYTKIANCHMKGDSKHEAASAYVEAANCYKKFSPQEAAQALDQAVNLFLEIGRLNMAARYCKDIGEIYQQEQDLEKASDYMERAADLFDSEGQTSQSNTIKQKVAEIAAQLEQYPKATEIFEAIARQSINNNLLKYSVRGILLNAGICQLCRADPVAIQNSLERYQEIDPTFSGTREYKLLADLAASMDEGDVTKFTDAIKDFDGMTRLDPWKTTLLLRAKNELKKQEEDEDDLT

SEQ ID NO: 2921 - protein, 289 aa, Oryza sativa
MGDHEARGDDFEKKAEKKLSGWGIFGSKYEDAADLFDKGANSFKLAKNWSRAAQVYIKIANCHLKGDSKHEAASAYVEAANCYKKFSPQEAAQALNQAVDLFLEIGRLNMAARYCKDIGEIYHQEQDLEKASDYLEKSADLFDSEGQSSQSNSIKQKVAEIAAQLEQYQKANEIFEAIARQQINNNLLKYSVRGILLNAGICQLCRGDVVAITNSMERYQDIDPTFSGTREYKLLSDLAAAMEEGDVAKFTDAIKEFDSMTRLDPWKTTLLLRAKNELKKKEDDEDDLT

SEQ ID NO: 2922 - protein, 289 aa, Avena sativa
MGDHEARGDDMEKKAEKKISGWGIFGSKYEDAADLYDKAANFFKLSKNWNRAASVYIKIANCHLKGDSKHEAASAYVEAANCYKKFSPQEAAQALDQAVNLFMEIGRLSMAARYCKDIGEIYQQEQDLEKASDYLERAADLFDSEGQTSQSNTIKQKVAEIAAQLEQYPKATEIFEAIARQSINNNLLKYSVRGILLNAGICQLCRAEPVAIQNSLERYQEIDPTFSGTREYKLLTDLAASMDDGDVAKFTDAIKDFDGMTRLDPWKTTLLLRAKNELKKQEEDEDDLT

SEQ ID NO: 2923 - protein, 117 aa, Saccharum officinarum
MDGSAFLSLSPELRDALAKVAVFVLVQRLVYLILRSSSDVFSKDGGRLRSLSFRPMRSMSVRRVLAPLSDVPVGTDEPSPSPSSSMSPAGGLPARIEMAATSGSGHLGGSLCGPSGL

SEQ ID NO: 2924 - protein, 96 aa, Zea mays
MDGSAFPSLSPELRDALAKVAVFVLVQGLVYLILRSSSDVFSKDGRLRSLSFRPMRSMSVRRVLAPLSDVPVGTDDASPSLSPAATSSHRKAARED

SEQ ID NO: 2925 - protein, 100 aa, Pennisetum glaucum
MDAAAAAFLSLSPELRDALVKVAVFVLVQGLVYLILRSSSDVFSKDGRLRSLSFRPMRSMSVRRVLAPLSDVPVGTDEPSASTSPSLSSAVSRRRASRED

SEQ ID NO: 2926 - protein, 96 aa, Cenchrus ciliaris
  misc_feature (73)..(73): Xaa can be any naturally occurring amino acid
MDAATFLSLSPELRDALVKVAVFVLVQGLVYLILRSSSDVFSKDGRLRSLSFRPMRSMSVRRVLAPLSDVPVXTDEPSPSPSPSSAASRRRASRED

SEQ ID NO: 2927 - protein, 126 aa, Triticum aestivum
IASASPHASPSPPCQHPRARASLHAMDGSAFLSLSPELRDALAKVAVFVLVQGLVYLILRSSSDVFSKDGGGLRSLSFRPMRSMSVRRVLAPLSDVPVGTDEPSPSPSWSMSPAASSSRRRAARED

SEQ ID NO: 2928 - protein, 891 aa, Arabidopsis lyrata
MNAFSLHLLIPTPVHLKSSRAASPFFSRASSLSSLRFASPLILRAASSDDSQSVENQTLEVLEWRALCNQLAPFASTSMGLSATKNAEIPVGNSPEESRNLLDETAAALAAMEMMESQRLGLSEIQDLSDIVERAVAGQLLTVRELCSVRSTLMAATSVFQKLRKAAISDKRVSPLVGLVQGCDFKDTLQQKIGFCIDCNMSMILDRASEDLEIIRSERRRNMEKLDSLLKKISTQIFQAGGIDRPLITQRRSRMCVAIRATHKSLLPGGVVLSVSSSRATCYIEPKEAVELNNMEVRHANSEKAEEMAILSILTSEVSMAQKDILHLLDRILELDIAFARASHAKWMNGVYPNVTSEHTKTPGLGGDHKSLSVDIDSAQHPLLLGSVLGSPNDGMVFPVPIDIKVESRAKVVVISGPNTGGKTALLKTLGLISLMSKSGMYLPAKNCPRLPWFDFILADIGDPQSLEQSLSTFSGHISRIRQILDIASENSLVLLDEICSGTDPSEGVALATSILQYIKNRVNVAVVSTHYGDLSRLKDNEPQFQNAAMEFSMETLQPTFRVLWGSTGLSNALTVAKSIGFNTGILENAHKWTEKLNPEQDVERKGSLFQSLVEERNKLKLQASKTEAFHRDLMNLYHELEHESHDLEKRERALLKKETQKVQEDLNSAKSKMQKLVAEFKSQLEIAQADQYNSLILKTEEAVAEIIEACCPIDLDSIEEPYSDYSPQAGEKVLVTGLGDKLGTVVEEPGDDETVLVQHGKIRVRIKKKDIKPLPRSTSSQTSNRSLRSKRQVNMKDLGSVLQMQQSEPVRIQTSKNTLDLRGMRAEEAVHQLDMAISGRDSGSILFIIHGMGTGVIKELVLERLRKHTRVSRYEQANPMNYGCTVAYIK

SEQ ID NO: 2929 - protein, 616 aa, Solanum phureja
MASATTSSTHKFQEYDDDEVTSYKNKNCEVVVNRQEIKGAIAKAIELRALHATLLQQQQQQGNSPIKKFPSSASPTVSLHSHHFSSQDYPIFTPSYEDEPLPGYKQLHLDHNPNYAELWDEYGFGGVGNGNNESVLSDYRKANSTLKNGFTNSLINLEPHICPADDQRSVTSSCTDQVTTRKASPIARYIKSRRNSLGDLNSISSCNKCKPATISTEVDGGGSSTSKSGKNSNVIVPLTDSHVSVQSQPKSKGGMNLSWLFPKLKKKNKVENSPNRTDQSDEVSQVLKDHIGMVSIETLKKELMEANESRDAALIEVLGMKSSLGELKQKLEYLETYCEELKKALRQAIQATESPVSSKLRNFPKNGKSIDGDGENVIPVSDEVMLEGFLQMVSESRLSVKQFCKTLIGQIEETDNLLTDNLNLLLQPYKLSLNSKYSKAVLYHIESIINQSLFQDFENCVFQKNGSSKHLDPQHDRHAQFSSFVALRNLSWNEVLRKGTKYYSEEFSKFCDQKMSCIIATLNWTRPWPEQLLQAFFVAAKCIWLLHLLAFSFNPSLGILRVEENRTFDMHYMEDVFADRQRSQGPSKVKVMVMPGFYVHDRVLRCKVICRYKNVS

SEQ ID NO: 2930 - protein, 450 aa, Sorghum bicolor
MAAVAAAPRPQLSPLSGGGGATISSLTLQTLAFISPLPTRRRRRCVLRSNASSSPSPPPSQEKEAAAEVVPTAESCVNLGLQLFSKGRVKDALEQFENALELNPTPVEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDGAPDLLETAGNAAINIGGIVVLVALYFWENKKEEKQITQISRNETLSRLPVRLSTNRIIELVQLRDITRPVILAGSKASVTRALQRAERYRTELLKRGVLLIPVIFGASQKDQTKPRGFGTRRAAASVPSVGGDFEKRTESIAAKSRLKSEVRFKADIVSPEQWESWIRDQQESEGVTPGEDVYIILRLDGRVRRSGIGMPNWNDILQELPRLEDLMSKLER

SEQ ID NO: 2931 - protein, 454 aa, Brachypodium distachyon
MSAAPAAAVLRPHLSLLSGGGGGGIPSGTFQTLSYVSPLLHHRRRRRGGVVLRSNASSSLPSPRPSPEKEAEKAPTAESCVNLGLELFSKGRVRDALEQFENALELEPNPIEAQAALYNKACCHAYREESKKAAECLRTALRDYNLKFGTVLNDPDMAPFRASPEFKELQEEALRGGEDIGSGFRRDLKLISEVQAPFRGVRRFFYVAFIAAAGISTFFTIPRLILAVQGGDGAPDLLQTAGNAAINIGGIVVLVALFIWENRKEEQQITVISRNETLSRLPVRLSTNRITELVQLRDITRPVILAGSKASVTKATQRAERYRTELLKRGVLLIPVIFGASEKAQTKPKGFGTTRSAASVPSVGGDFEKRTESIAAKSRLKAEVRFKADIVSPDQWESWIRDQQESEGVTPGEDVYIILRLDGRVRRSGRGMPNWNDILQELPRLEDLLSKLER

SEQ ID NO: 2932 - protein, 448 aa, Hordeum vulgare
MAAAALRTHLSLLSAGGGIPNPALQTLSFVAPLLLRRRCRRRSSVVLSNASSSPPSPPPSPEKAVEAAPTAESCVNLGLEFFSKGRVKDALEQFDKALELNPNPTEAQAAFYNKACCHAYREESKKAADCLRIALRDYNLKFGTVLNDPDMAPFRASPEFKELQEEALRGGEDIGSGFRRDLKLISEVQAPFRGVRRFFYVAFIAAAGISTFFTIPRLILALQGGDGAPDFLETAGNAAINIGGIVVLVALFVWENKKEEEQITNISRNETLSRLPVRLSTNRITELVQLRDITRPVILAGSKASVTQAMQRAERYRTELLKRGVLLIPVIFGASQKVQGKPKGFGTTRSAASAPSIGGDFEKRTESIAAKSRLRAEVRFKADIVSPEQWESWIRDQQESEGVTPGEDVYIILRLDGRVRRSGRGMPNWNDILKELPRLEDLLSKLER

SEQ ID NO: 2933 - protein, 455 aa, Triticum aestivum
MAAAPAAAALRPHLSLLSAGGGIPNPTLQTLSFVAPLLLRRRCRRCRRRSSVVLSNASSSPPSPPPSPEKEAEAAPTAESCVNLGLEFFSKGRVRDALEQFDNALELNPNPTEAQAAFYNKACCHAYREESKKAAECLRIALRDYNLKFGTVLNDPDMAPFRASPEFKELQEEALRGGEDIGSGFRRDLKLISEVQAPFRGVRRFFYVAFIAAAGISTFFTIPRLIFALQGGDGAPDFLETAGNAAINIGGIVVLVALFFWENKKEEEQITNISRNETLSRLPVRLSTNRITELVQLRDISRPVILAGSKASVTQAMQRAERYRTDLLKRGVLLIPVIFGASLKVQGKPKGFGTTRSAASAPSIGGDFEKRTESIAAKSRLRAEVRFKADIVSPEQWESWIRDQQESEGVTPGEDVYIILRLDGRVRRSGRGMPNWNDILKELPRLEDLLSKLER

SEQ ID NO: 2934 - protein, 460 aa, Triticum aestivum
  misc_feature (141)..(141): Xaa can be any naturally occurring amino acid
PHHSSVLAMAAAPAAAALRPHLSLLSAGAGIPNPTLQTLSFVAPLLCRRRCRRRSSVVLSNASSSPPSPPPSPEKEAEAAPTAESCVNLGLEFFSKGRVRDALEQFDNALELNPNPTEAQAAFYNKACCHAYREESKKAAXCLRIALRDYNLKFGTVLNDPDMAPFRASPEFKELQEEALRGGEDIGSGFRRDLKLISEVQAPFRGVRRFFYVAFIAAAGISTFFTIPRLIFALQGGDGAPDFLETAGNAAINIGGIVVLVALFFWENKKEEEQITNISRNETLSRLPVRLSTNRITELVQLRDISRPVILAGSKASVTQAMQRAERYRTDLLKRGVLLIPVIFGASLKVQGKPKGFGTTRSAASAPSIGGDFEKRTESIAAKSRLRAEVRFKADIVSPEQWESWIRDQQESEGVTPGEDVYIILRLDGRVRRSGRGMPNWNDILKELPRLEDLLSKLER

SEQ ID NO: 2935 - protein, 142 aa, Hordeum vulgare
MAAAALRTHLSLLSAGGGIPNPALQTLSFVAPLLLRRRCRRRSSVVLSNASSSPPSPPPSPEKAVEAAPTAESCVNLGLEFFSKGRVKDALEQFDKALELNPNPTEAQAAFYNKACCHAYREESKKAADCLRIALRDYNLKF

SEQ ID NO: 2936 - protein, 573 aa, Zea mays
MAAAAAAARRAAGLLPLLLSSRSGARIPLHRAVSQIPPPCSYRLLSQQAKPFSASASASASASASNGATAERTRELHLYNTKSRKKEQFRPRDPGGEVGMYVCGITPYDDSHIGHARAYVAFDVVYRYLRYLDYEVRYVRNFTDIDDKIIARANQLGEDPFNLSKRFSDDFLLDMANLQCLPPSVEPRVSDHIDEIINMIKQILDNSCAYVVGGDVYFSVDSFPDYGELSGRKLDDNRAGERVSVDERKRNPADFALWKAAKDGEPWWDSPWGPGRPGWHIECSAMSAHYLGHSFDIHGGGEDLIFPHHENEIAQSRAACCDSTINYWIHNGFVNVNSQKMSKSLGNFVTIRKVIEMYHPLALRMFLLGTHYRSPINYTIEQLNVTSDRLYYTYQTLLDCEEICQQQQSNTGNSLPANTLNYIQKLHEEFETSMSDDLHTSVALAAISEPLKVMNDLLHTRKGKKQDKRLESLSALEEKIRVVLSVLGLLPSSYHEALQQLRDKALRRASITEELVVQKIEERTAARKAKQYEKSDEIRKELAAIGIALMDGPDGTTWRPSLPILEEAVVAKT

SEQ ID NO: 2937 - protein, 564 aa, Zea mays
MAAAVVVRRAAGLIPLLSSRFGARMPLHRALSQIPPPRFCRLLSQQTKPFSASASNGAATDRTRELRLYNTKSRKKEQFRPRIPGREVGMYVCGVTPYDDSHIGHARAYVAFDVLYRYLRYLDYEVRYVRNFTDIDDKIIARANQLGEDPFSLSKRFSDDFLSDMANLQCLPPSVEPRVSDHVDEIINMIKQILDNRCAYVVGGDVYFSVDNFPEYGELSGRKLDDNRAGERVAVDERKRNPADFALWKAAKDGEPWWDSPWGPGRPGWHIECSAMSAHYLGHSFDIHGGGEDLIFPHHENEIAQSRAACCDSTINYWIHNGFVNVNSQKMSKSLGNFVTIRKVIEMYHPLALRMFLLGTHYRSPINYTIEQLNVASDRLYYTYQTLRDCEEICQHQQSNTGNPLPANTLNYIQKLHDEFETSMSDDLHTSVALAAMSEPLKVMNDLLHTRKGKKQDKRLESLSALEEKIRVVLSVLGLLPSSYHEALQQLRDKALRRASITEELVVQKIEERTAARKAKQYEKSDEIRKELAAVGIALMDGPDGTTWRPSLPLPEEEAVLAKT

SEQ ID NO: 2938 - protein, 569 aa, Oryza sativa
MAAARRAAGLLPLLLSSPSRARLPHRQALALTPPLLRPHRLYSHSPKPSSSAAFSAFASASNGAPAGRARELHLYNTKSRRKELFQPRVPGGEVGMYVCGVTPYDDSHIGHARAYVAFDVLYRYLRYLDHKVRYVRNFTDIDDKIIARANQLGEDPFSLSKRYSDDFLSDMANLHCLPPSVEPRVSDHIDQIINMIKQIIDNDCAYAIGGDVYFSVENFPEYGDLSGRKLDDNRAGERVAVDERKKNPADFALWKAAKDGEPSWDSPWGPGRPGWHIECSAMSAHYLGHSFDIHGGGEDLIFPHHENEIAQSRAACCDSSINYWIHNGFVNVNSQKMSKSLGNFVTIRKVTELYHPLALRMFLLGTHYRSPINYTIEQLNVASDRLYYTYQTLQDCEESCQQHQSKAGDPLPVNTTNCIQKLHDEFETSMSDDLHTSVALAAISEPLKVMNDLLHTRKGKKQEKRLESLSAMEEKIRMVLSVLGLLPSSYYEALQQLREKALRRASMTEEQVLQKIEERTSARKAKQYEKSDEIRKELAAVGIALMDGPDGTTWRPSVPLSEQGVVAST

SEQ ID NO: 2939 - protein, 567 aa, Brachypodium distachyon
MMAAAAAVRRAASGLSPLLLSSLPRTSLRHSESLPRLLRPHRIPPHPAKPFCSAALSSNGAAAERARDLHLYNTKSRRRELFRPRAPGGEVGMYVCGVTPYDDSHIGHARAYVAFDVLFRYLRYLDYEVRYVRNFTDIDDKIIARANQLGEDPFSLSKRYSDAFLSDMAHLQCLPPSVEPRVSDHIDQIVNMIKQILDNGCAYVVSGDVYFSVDNFPEYGMLSGRKLDDNRAGERIAVDERKKNPADFALWKAAKDGEPWWDSPWGPGRPGWHIECSAMSAQYLGNSFDIHGGGEDLIFPHHENEIAQSRAACCDSSINYWIHNGFVNVNSQKMSKSLGNFVTIRKVIEQYHPLALRMFLLGTHYRSPINYTVEQLNVASDRLYYTYQTLRDSEESTQKDQINSEDALPATTTHCIEKLQNEFETSMSDDLHTSVALAAISEPLKVMNDLLHTRKGKKQEKRLESLFALEEKIRTVLSVLGLMPSSYYEALQQLREKALQRASITEDQVLQKIEERTSARKAKQYEKSDEIRKELAALGIALMDGPDGTTWRPSVPFSEQGVVANKT

SEQ ID NO: 2940 - protein, 927 aa, Brachypodium distachyon
MATVATITSRSSNLTLLFFTSTPPFRVALPSRRLPRSHRHAPQLLRLRTAASASSRTLMPPVSPEAREAAEELRLEAESALEWGGVCARLADFAATAAGRAACGDGRVPVGRSREESERLLEQTAAAAALLSSSSSAPLDFGGVGDVSAVVAAAARGRLLAVREICGVGRSLRAARGVFDQVKGLTDEMPDERYSPLLDILQDCDFLTELVQMIEFCLDSNLSMVLDRASEKLGTIRKERRSNIEILESLLRDASMKIFQAGGVDSPLVTKRRSRMCVGVKASHKHLLPGGIVLSSSGSGATYFMEPRDAVKLNNMEVKLSSDERTEELAVLGLLTSRIADSRMKIRHLMGKIMELDLACARGSYALWINGVRPAFSDRDNSGQLDPSSDFSVFIDGIQHPLLLEQSFGIAKGSTEVGKGQLSEEHPVSSMPVPLDMHVKSDTRIVVISGPNTGGKTATMKTLGLATLMSKAGMFFPAKGSPKLPWFDQVLADIGDHQSLENSLSTFSGNISRLRKIVQVVSRDSLVLIDEIGSGTDPSEGVSLSTSILKYLAGRLNLAIVTTHYADLSRLKAVDGRFENAAMEFCLETLKPTYRILWGSTGNSNALSIAKSIGFDQKVLDRAQEWVEKLLPDKQKERQGLLYGSLLDERNLLESQANEVASVLSEVEVLYNEICLEADDLDNRVAALRARESQKVQHELKLVKSQMDLIIRNFEVQLKNSKLEQYNSVMKKAEASTASLAAAHQPTEFAFSDDENKSSYVPQIGDKVYVEGLGGGSLATVVEILSEDGSCMVQYGKIKVRAKNNKMKLAQRDTKETSASSSVQGKGRPVKRSSPETKQDGSISFGPVVQTSKNTVDLRGMRVSEASHELQMAIDGCRSYQVLFVVHGMGTGAVKECALDILRSHPRVAKLEDESPLNYGCTVAYIE

SEQ ID NO: 2941 - protein, 496 aa, Solanum phureja
MDQSTLVFGSIFALSFLYIIANICNKGNNKVPPGPSPWPIIGNLHLLGAKPHASLANLAKIYGPIMSLKLGQITTIVISSSSMAKQVLKIQDQAFSTRFIPNALQAHNHYKFSVAWLPVCPQWRTLRRILNTNLLSSNRLDANQHLRSQKVKQLIAYCDICSLQGEALDIGQVAFKTNLNLLSNTLFSKDLADPFSDSKVELKEVIWGVMAEVGKPNLVDFFPILKKIDLQGIRRRTIIHFSKLFKLFDGLINERLEEKRRSGFTEKSDVLEMFLNITEKNPEDIDHNHIKSMFLDLFGAGTDTTTSTLEWAMTELLKQPEIIKKAQVELAETIGKGKPIEETDVSRLPYLQCIIKETLRLHPPIPLLLPRKVEQDVELCDYIIPKGSQVLVNVWTIGRDFTFWKDPLVFKPERFLSLNLDTRGQDFELIPFGAGRRICPGLPLALRMIPVMLGSLLNSFNWKLEAGIEPQALDMEEKFGITLAKARPLRAIPSPL

SEQ ID NO: 2942 - protein, 498 aa, Solanum phureja
LKNNGLLYSFILVLASIFALIFVYSLAKLSSKKLPPGPSPWPIIGNIHLLGAKPHVSLANLAKKYGPIMSLKLGQITTIVISSSSIAKQVLKNQDQAFSSRFIPNAIQGHNYCEFSVGWLPVCPQWRTLRRILNINIFSPNRLDANQHLRSQKVKELIAYCEKCSQQGEALDISQVVFKTSLNLLSNTLFSKDLADPFSNSKVELKEVIAGILTEFGRPNLVDFFPILGMIDLQGIRRRTTIHIGKLFELFDDLINERLEEKRKGFSEKSDVLEMFLNICEENPEEINHNHIKSMFMDLFLAATDTTTSTLEWAMAEILKQPEIMKKVQAELAKIIGKGKSIEEVDVTRLPYLQCIIKETLRMHPPAPFLVPRKVEQDVELFDYIIPKGSQVLVNVWSIGRDFTFWDEPLVFKPERFWGSDLDMQGQDFDLIPFGAGRRMCPGFPLALRIVPVILGSLLNSFNWKLEADIGPEDLDMEEKFGITLAKAHPLRVIPFLL

SEQ ID NO: 2943 - protein, 366 aa, Triticum aestivum
MSDVTAESTPRQRLPTPSPSLSQQQSRGRQPPPPGSDPLALGVVIFIAVCFLLVSISAPSSILHQVPEGHVGVYWRGGALLKTITTPGYHLKLPFITQFEPIQVTLQTDQVKGIPCGTKGGVMISFDKIEVVNRLNKDFVYETLLNYGVHYDKTWIYDKIHHEINQFCSAHSLQQVYIDMFDQIDETMKEAIQRDCTRYAPGIEIISVRVTKPNIPVSIRRNFELMEEERTKALIAIERQKVAEKEAETQKKIALSEAEKNALVSKILMQQMLTEKDSSKRQQQIDNEMFLARERALADANYYRITKEAEANKLKLTPEYLELRFIESIANNTKIFFGEKIPNMIMDQRLIRNHLDSAPSKDQLEI

SEQ ID NO: 2944 - protein, 366 aa, Triticum aestivum
  misc_feature (344)..(344): Xaa can be any naturally occurring amino acid
  misc_feature (358)..(358): Xaa can be any naturally occurring amino acid
MSDVTAESTPRQRLPTPSPSLSQQQFRGRQPPPPGSDPLALGVVIFIAVCFLLVSISAPSSILHQVPEGHVGVYWRGGALLKTITTPGYHLKLPFITQFEPIQVTLQTDQVKGIPCGTKGGVMISFDKIEVVNRLNKDFVYETLLNYGVHYDKTWIYDKIHHEINQFCSAHSLQQVYIDMFDQIDETMKEAIQRDCTRYAPGIEIISVRVTKPNIPVSIRRNFELMEEERTKALIAIERQKVAEKEAETQKKIALSEAEKNALVSKILMQQMLTEKDSSKRQQQIDNEMFLARERALADANYYRITKEAEANKLKLTPEYLELRFIESIANNTKIFFGEKIPNXIMDQRLIRNHLDSXPSKDQLEI

SEQ ID NO: 2945 - protein, 367 aa, Brachypodium distachyon
MSDVTADSPPRQRPPPPPSPSLSQQQTRGRQPPPPGSDPLALGVIVFIAVCFLLVSISAPSSILHQVPEGHVGVYWRGGALLKAITSPGYHLKLPLITQFEPIQVTLQTDQVKGIPCGTKGGVMISFDKIEVVNRLSKDFVYDTLLNYGVHYDKTWIYDKIHHEINQFCSAHSLQQVYIDMFDQIDETMKEAIQRDCTRYAPGIEIISVRVTKPNIPSSIRRNFELMEEERTKALIAMERQKVAEKEAETQKKIALSEAEKNALVSKILMQQMLTEKDSSKRQQQIDNEMFLARERALTDANYYRITKEAEANKLKLTPAYLELRFIESIANNSKIFFGEKIPNMIMDQRMIRNYLDPASGKDRLEI

SEQ ID NO: 2946 - protein, 367 aa, Festuca arundinacea
  misc_feature (3)..(3): Xaa can be any naturally occurring amino acid
  misc_feature (250)..(250): Xaa can be any naturally occurring amino acid
MSXVTAESTPRQRPPPPSPSLSQQQSRVRQQPPPGSDPLALGLIIFLGLCFLLVSFSAPSSIVHQVPEGHVGVYWRGGALLKTITPPGYHLKLPLITQFEPIQVTLQTDQVKGIPCGTKGGVMISFDKIEVVNRLNKDFVYDTLLNYGVHYDKTWIYDKIHHEINQFCSAHSLQQVYIDMFDQIDETMKDAIQRDCTRYAPGIEIISVRVTKPNIPVNIRRNFELMEEERTKALIAIERQKVAEKEAETXKKIALSEAEKNALVSKILMQQMLTEKDSSKRQQQIDNEMYLAQQRALADANYYRITKEAEANKLKLTPEYLEMRFIESIANNTKIFFGEKIPNMIMDQRLIRNHLDSTPSKDRLEVE

SEQ ID NO: 2947 - protein, 372 aa, Sorghum bicolor
MSDVTSADSAPNRRSPPPPSPSPSMPRFQQQPSGRQPPPPGADPFAFGVVAFIGICFVLISLSAPSSVLHQVPEGHVGVYWRGGALLKTITPPGFHLKLPLITQYEPIQVTLQTDQVRDIPCGTKGGVMISFDKIEVVNRLRKEFVHETLLNYGVHYDKTWIYDKIHHEINQFCSAHSLQQVYIDMFDQIDETMKEAIQRDCTRYAPGIEIISVRVTKPNIPGSIRRNFELMEEERTKALIAIEKQKVAEKEAETQKKIALSEAEKNAQVSKILMEQKLMEKDSSKRQEQIDNEMYLAREKALADANYYRILKEAEANRLKLTPEYLELRFIESIANNSKIFFGEKIPSMIMDQRLLKNYLDAVPRKDHYEM

SEQ ID NO: 2948 - protein, 130 aa, Oryza sativa
MSDGSVESPSLHRTPPPPSPSPSLSLSRSQQQTPRGRQPPPPGADPVAFAVVAFVAICFVLISFSAPSSILHQVPEGHVGVYWRGGALLETITPPGFHVKLPWITQFEPIQVTLQTDQAKIFLVEQKVES

SEQ ID NO: 2949 - protein, 371 aa, Zea mays
MSDVTSDSAQRRRSPPPPSPSPSMPRFQQQPSGRQPPPPGADPFAFGIVAFIGICFVLVSLSVPSSVLHQVPEGHVGVYWRGGALLKTITPPGFHLKLPLITQYEPIQVTLQTDQVRDIPCGTKGGVMISFDKIEVVNRLRKEFVHETLLNYGVHYDKTWIYDKIHHEINQFCSAHSLQQVYIDMFDQIDETMKEAIQRDCTRYAPGIEIISVRVTKPNIPGSIRRNFELMEEERTKALIAMEKQKVAEKEAETQKKIALSEAEKNAQVSKILMEQKLMEKDSSKRQEQIDNDMYLAREKAVADANYYRILKEAEANRLKLTPEYLELRFIESIANNSKIFFGEKIPNMIMDQRLLKNYLDAAPRKDHYEM

SEQ ID NO: 2950 - protein, 371 aa, Saccharum officinarum
MSDVTSDSAQSRRSPPPPSPSPSMPRFQQQPSGRQPPPPGADPFAFGVVAFIGICFVLISLSVPSSVLHQVPEGHVGVYWRGGALLKTTTPPGFHLKLPLITQYEPIQVTLQTDQVRDIPCGTKGGVMISFDKIEVVNRLRKEFVHETLLNYGVHYDKTWIYDKIHHEINQFCSAHSLQQVYIDMFDQIDETMKEAIQRDCTRYAPGIEIIGVRVTKPNIPGSIRRNFELMEEERTKALIAIEKQKVAEKEAETQKKIALSEAEKNAQVSKILMEQKLMEKDSSKRQEQIDNEMYLAREKALADANHYRILKEAEANRLKLTPEYLELRFIESIANNSKIFFGEKIPNMIMDQRLLKNYLDAVPRKDHYEM

SEQ ID NO: 2951 - protein, 371 aa, Panicum virgatum
MSDVTADSAQSRRSPPPPSPAPSMARFQQQPSGRQPPPPGADPFAFGVVAFIGICFVLISLSVPSSVLHQVPEGHVGVYWRGGALLKTITPPGFHLKLPWITQYEAIQVTLQTDQVRDIPCGTKGGVMISFDKIEVVNRLRKDYVHETLLNYGVHYDKTWIYDKIHHEINQFCSAHSLQQVYIDMFDRIDETMKEAIQRDCTRYAPGIEIINVRVTKPNIPPSIRRNFELMEEERTKALIAIEKQKVAEKEAETQKKIALSEAEKNAQVSKILMEQKLMEKDSSKRQEQIDNEMYLAREKALADANYYRILKEAEANRLKLTPEYLELRFIESIANNSKIFFGEKIPNMIMDQRLLKNYLDDVSRKDHSEL

SEQ ID NO: 2952 - protein, 371 aa, Zea mays
MSDVTSDSAQSRRSPPPPSPSPSMPRFQQQPSGRQPPQPGADSFVFGVFAFIAICFVLISLSVPSSVLHQVPEGHVGVYWRGGALLKTITPPGFHLKLPLITQYEPIQVTLQTDQVRDIPCGTKGGVMISFDKIEVVNRLRKEFVHETLLNYGVHYDKTWIYDKIHHEINQFCSAHSLQQVYIDMFDQIDETMKEAIQRDCTRYAPGIEIISVRVTKPNIPGSIRRNFELMEEERTKALIAIEKQKVAEKEAETQKKIALSEAEKNAQVSKILMEQKLMEKDSSKRQEKIDNEMYLAREKALADANYYRILKEAEANRLKLTPEYLELRFIESIANNSKIFFGEKIPNMIMDQRLLKNYLDAVPRKDHYEM

SEQ ID NO: 2953 - protein, 371 aa, Pennisetum glaucum
MSEVTGDSAQSRRSPPPPSPAPSMPRFQQQPSGRQPPPPGTDPVAFGVVAFIGICFVLISLSVPSSVLHQVPEGHVGVYWRGGALLKTITPPGFHLKLPWITQYESIQVTLQTDQVRDIPCGTKGGVMISFDKIEVVNRLRKEYVHDTLLNYGVHYDKTWIYDKIHHEINQFCSAHTLQQVYIDMFDQIDETMKEAIQRDCTRYAPGIEIIGVRVTKPNIPGSIRRNFELMEEERTKALIAIEKQKVAEKEAETQKKIALSEAEKNAQVSKILMEQKLMEKDSSKRQQHIDNEMYLAREKALADANYYRILKEAEANRLKLTPAYLELRFIESIANNSKIFFGEKIPNMIMDQRLLKNYLEDVPRKDYSQL

SEQ ID NO: 2954 - protein, 519 aa, Brachypodium distachyon
MGIKRPGRCNCATAAELLALLLIILGASSLTGCIAASGGAGLTRGSFPKGFVFGTASAAYQYEGAVKADGRGQTIWDTFAHTFGKITDFSNADVAVDQYHRFEEDIQLMADMGMDAYRFSIAWARILPNGVGQVNQAGIDHYNKLINALLAKGIQPYVTLYHWDLPQALEDKYNGWLNRQIVDDFAGYAETCFAAFGDRVKHWITVNEPHTVSVQGYDAGLQAPGRCSVLLHLYCKSGNSGTEPYIVAHNFILAHATVSRIYRNKYRATQKGQLGMAFDVMWYEPMTSRAVDVEAAKRAQEFQLGWFADPFFFGDYPETMRKRVGERLPRFTPEEAELVKGALDFVGINHYTTYYTRQNDTNIIGKLFNDTLADTGTISLPFRNGKAIGDRANSIWLYIVPRGMRSLMNYVKDRYNSPPVYITENGMDDGNSPFISLKDALKDSKRIKYHNDYLTNLAASIKEDGCDVRGYFAWSLLDNWEWAAGYSSRFGLYFVDYNDNLKRYPKNSVQWFKSLLSSS

SEQ ID NO: 2955 - protein, 523 aa, Zea mays
MGRRIMKSGRRTTMQPRPALLLLVLVLGVSLRGCIAQGGGGGGGLTRGSFPKGFVFGTAAAAYQYEGAVKTDGRGQTIWDTFAHTFGKISDFSNADVAVDQYHRFEEDVQLMADMGMDAYRFSIAWSRILPNGTGQVNQAGIDHYNKVINALLSKGIQPYVTLYHWDLPQALEDRYNGWLDRQIVNDFAAYAETCFKAFGDRVKHWITLNEPHTVAVQGYDAGLHAPGRCSVLLHLYCRTGNSGTEPYIVAHNFILAHATVSDMYRRKYKAAQNGELGIAFDVIWYEPMTNSTIDIEATKRAQEFQLGWFADPFFFGDYPATMRARVGERLPKFTADEAALVKGALDFMGINHYTTFYTRHNDTNIIGRLLNDTLADTGTISLPFDKNGKPIGDRANSIWLYIVPSGIRKLMNYVKERYNSPTVYITENGMDDGNSPFTSLQNALKDSKRIKYHNGYLNNVAASIKEDGCDVRGYFAWSLLDNWEWAAGYTSRFGLYFVDYKDNLKRHPKNSVQWFKTLLSSS

SEQ ID NO: 2956 - protein, 507 aa, Sorghum bicolor
MPPVVVLLLLLVVLGVSLQGRCTAQGGGGLTRGSFPKGFVFGTAAAAYQYEGAVTTDGRGRTIWDTFAHTFGKISDFSNADVAVDQYHRFEEDVQLMADMGMDAYRFSIAWSRILPNGTGQVNQAGIDHYNKVINALLSKGIQPYVTLYHWDLPQALEDRYNGWLDRQIVNDFAAYAETCFKAFGDRVKHWITLNEPHTVAIQGYDAGLHAPGRCSVLLHLYCKSGNSGTEPYIVAHNFILAHATVSDIYRRKYKAAQNGELGIAFDVIWYEPMTNSTIDIEATKRAQEFQLGWFAEPFFFGDYPATMRTRVGERLPKFTADEATLVKGALDFMGINHYTTFYTRHNETNIIGRLLNDTLADTGTISLPFRNGKAIGDRANSIWLYIVPNGMRSLMNYVKERYNSPPVYITENGMDDGNSPFTSIKDALKDSKRIKYHNDYLTNLAASIKEDGCDVRGYFAWSLLDNWEWTAGYSSRFGLYFVDYKDSLKRYPKSSVQWFKNLLSSS

SEQ ID NO: 2957 - protein, 507 aa, Pennisetum glaucum
LEGTGDDEVGVSLQGRRCIIAQAAGGGGLTRGSFPKGFVFGTAAAAYQYEGAVKVDGRGQTIWDTFAHTFGKISDFSNADVAVDQYHRFQEDVQLMADMGMDAYRFSIAWSRILPDGTGQVNQAGIDHYNKVIDALLSKGIQPYVTLYHWDLPQALEDRYKGWLDRQIVNDFAAYAETCFKAFGDRVKHWITINEPHTVAVQGYDAGLHAPGRCSVLMHLYCRSGNSATEPYIVAHNFILAHATVSDIYRRKYKANQNGQVGIAFDVIWYEPMTNSTIDIEATKRAQEFQLGWFADPFFFGDYPATMRTRVAERLPKFTAEESALVKGALDFVGINHYTTFYTRHNDTNIIGLLLNNTLADTGTISLPFDKNGKPIGDRANSIWLYIVPSGMRKLMNYVKERYNTPTVYITENGMDDGNSPFTSIKDALKDSKRIKYHNDYLTNLAASIKEDGCDVRGYFAWSLLDNWEWAAGYTSRFGLHFVDYKDNLKRYPKNSVQWFKSLLSSS

SEQ ID NO: 2958 - protein, 549 aa, Zea mays
MGRRIMKSGRRTTMQPRPALLLLVLVLGVSLRGCIAQGGGGGGGLTRGSFPKGFVFGTAAAAYQVGGFCRLLSLSPSSVPRPAQGMWGLLYEGAVKTDGRGQTIWDTFAHTFGKISDFSNADVAVDQYHRFEEDVQLMADMGMDAYRFSIAWSRILPNGTGQVNQAGIDHYNKVINALLSKGIQPYVTLYHWDLPQALEDRYNGWLDRQIVNDFAAYAETCFKAFGDRVKHWITLNEPHTVAVQGYDAGLHAPGRCSVLLHLYCRTGNSGTEPYIVAHNFILAHATVSDMYRRKYKAAQNGELGIAFDVIWYEPMTNSTIDIEATKRAQEFQLGWFADPFFFGDYPATMRARVGERLPKFTADEAALVKGALDFMGINHYTTFYTRHNDTNIIGRLLNDTLADTGTISLPFDKNGKPIGDRANSIWLYIVPSGIRKLMNYVKERYNSPTVYITENGMDDGNSPFTSIQDALKDSKRIKYHNGYLNNVAASIKEDGCDVRGYFAWSLLDNWEWAAGYTSRFGLYFVDYKDNLKRHPKNSVQWFKTLLSSS

SEQ ID NO: 2959 - protein, 256 aa, Zea mays
MPLLLLPPPACTTAATSLAFSRPRPSRARWANLSYAFPRLRKYGRRHREPVAGPSLDDDGGEEDETEAEDWESDDGDEEMEIDEEEFLTMRPKPAGFGEGKTYSTDIEEQLLREMGFGGGAARRGEAAPANRRAGDSSTKVAAADVSDDGVQVRVWNLPKKKNIHKDLKQAFKGFHGLLSIDPAVSANKKTRDPICKGFAYLKLESAEAATRFVEIYSHQTVSFGKIQKPISCCIIDKRSSVEHSNKHPLVRQSLN

SEQ ID NO: 2960 - protein, 123 aa, Zea mays
MWAPGSPGRLPAMEECGEDEETDVDAYHGAMASSCWGRLGAAALWHRLRQHLSLVRRRRRQRGRSLLGAGGLNYDPLSYAQNFDDGCLCLEEREPDFSARFAPARHAAGSPRPTAAARDVATA

SEQ ID NO: 2961 - protein, 124 aa, Zea mays
MWAPGSPGRLPAMEECGEDEETDVDAYHGAMASSCWGRLGAASLWRRLRQHLSLVRRRRRRQRGRSLLGAGGLNYDPLSYAQNFDDGCLCLEEREPDFSARFAPARHAAGSPRPTAAARDVAAA

SEQ ID NO: 2962 - protein, 108 aa, Zea mays
MEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLA

SEQ ID NO: 2963 - protein, 108 aa, Setaria italica
MEAAAAAAGVQLGSSKPQIATQAEMAEARVPLAYRDQCAHLLIPLNKCRVAEFYLPWKCEPERHAYEKCQYELVMERMLQMQKIREAQEAKVKGGASIGLIPATAKLA

SEQ ID NO: 2964 - protein, 108 aa, Saccharum officinarum
MEAAAAAAGVELGSSKPQIATQAEMAEARVPLAYRDQCAHLLIPLNKCRVAEFYLPWKCEPERHAYEKCEYELVMERMLKMQKIREAQEAKVKGGASIGLIPATAKLA

SEQ ID NO: 2965 - protein, 108 aa, Panicum virgatum
MEAAAAAAGVQLGSSKPQIATQAEMAEARVPLPYRDQCAHLLIPLNKCRVAEFYLPWKCEPERHAYEKCQYELVMERMLQMQKIREAQEAKVKGGASIGLIPATAKLA

SEQ ID NO: 2966 - protein, 108 aa, Pennisetum glaucum
MEAAAAAAGVQLGSSKPQIATQEEMVEARVPLAYRDQCAHLLIPLNKCRVAEFYLPWKCEPERHAYEKCQYELVMERMLQMQKIREAQEAKVKGGASIGLIPATAKLA

SEQ ID NO: 2967 - protein, 110 aa, Panicum virgatum
MEAAAAAAAAGVQLGSSKPQIATQEEMAEARVPLAYRDQCAHLLIPLNKCRVSEFYLPWKCEPERHAYEKCQYELVMERMLQMQRIREAQEAKVKGGASIGLIPATAKLA

SEQ ID NO: 2968 - protein, 108 aa, Cenchrus ciliaris
MEAAPAAAGVQLGSSKPQIATHPPMREARVPLAYRDQCAHLLIPLNKCRVAEFYLPWKCEPERHAYEKCQYELVMERMLQMQKIREAQEAKVKGGASIGLIPATAKLA

SEQ ID NO: 2969 - protein, 111 aa, Festuca arundinacea
MEAAAAAAGVQLGTSKPQIATQAEMAEARVPIAYRDQCAHLLIPLNKCRVSEFYLPWKCEPERHAYEKCEYELVMERMLKMQKIREAQAAGKVKGGATIGVPLIPSTAKLG

SEQ ID NO: 2970 - protein, 107 aa, Avena sativa
MEAAAAAAGVELGSSKPQIATQSEMAEERVPIAYRDQCAHLLIPLNKCRVSEFYLPWKCEPERHAYEKCEYELVMERMLKMKKIREAQAAGKVKGGATIGLIPAKLA

SEQ ID NO: 2971 - protein, 111 aa, Brachypodium distachyon
MEEAAAAAGVQLGTSKPQIATQAEMAEARIPIPYRDQCAHLLIPLNKCRVAEFYLPWKCEPERHSYEKCQYELVMERMLQMQKIREAQGGAKVKGGATIGVPLIPSTAKLA

SEQ ID NO: 2972 - protein, 109 aa, Oryza sativa
MEAAAAAGVQLGTSKPQIATQAEMSEARLPLPYRDQCAHLLIPLNKCRVAEYYLPWKCEPERHAYEKCQYELVMERMIQMQKIREAQEAKSKGAATIGVPLIPSTAKLS

SEQ ID NO: 2973 - protein, 111 aa, Triticum aestivum
MEAAAAAAGVQLGTSKPQIATQAEMAEARLPIPYRDQCAHLLIPLNKCRVAEFYLPWKCEPERHSYEKCQYELVMERMLQMQKIREAQAGAKVKGSVTIGVPLAPSTAKLA

SEQ ID NO: 2974 - protein, 111 aa, Hordeum vulgare
MEAAAAAAGVQLGSSKPQIATQAEMAEARLPIPYRDQCAHLLIPLNKCRVSEFYLPWKCEPERHSYEKCQYELVMERMLQMQKIREAQGGAKVKGSVTIGVPLAPSTAKLA

SEQ ID NO: 2975 - protein, 111 aa, Pseudoroegneria spicata
MEEAAAAAGVQLGSSKPQIATQAEMAEARLPIPYRDQCAHLLIPLNKCRVAEFYLPWKCEPERHSYEKCQYELVMERMLQMQKIREAQGGAKVKGSVTIGVPLAPSTAKLA

SEQ ID NO: 2976 - protein, 111 aa, Triticum aestivum
MEEAAAAAGVQLGTSKPQIATQAEMAEARLPIPYRDQCAHLLIPLNKCRVAEFYLPWKCEPERHSYEKCQYELVMERMLQMQKIREAQAGAKVKGSVTIGVPLAPSTAKLA

SEQ ID NO: 2977 - protein, 366 aa, Panicum virgatum
MGRASAVALLVALAVLAPAATAQTCGDELPPELVGNYSGLACAPVWNNFVLRYAQGKDNVLRVVLSTMYSTGWVGMGFSKDGLMVGSSAMVGWMGKTGVAHIKQFSLQGKVPSQVVVDKGSLVSNDHDHTVLVQQAKIYLAFQLRFPAPLKRQNVLLAIGSAIPVNDRLSEHQSKTSITFDFTTGSSSSASSFPEGLKRTHGALNLFAWGVLLPIGAIVARYCRRWDPLWFYLHAGIQFVGFILGLAGIVAGVSLYNKIQANVPSHRGLGIFVLVLGILQILAIFLRPNKDSKYRKFWNWYHHWVGRLALFFAAINIVIGIKVGTAGNSWKIGYGFNLAILLITIIALEVLLWTRWRNNSGSTGAY

SEQ ID NO: 2978 - protein, 369 aa, Setaria italica
MGTGRASVVGALLVALAVLAPAVTAQTCNDELPSQLVRNYSGLACAPVWNSFVLRYAQDKDNVLRVVLSTMYSTGWVGMGFSKNGLMVGSSAMVGWMGKTGVAHIKQFSLQGKTPSQVVVDKGLLVSNDHDHTVLVQQAKIYLAFQLRFNEPLKRQNVLLAFGSAIPVNDRLSEHQDKTSITFDFTTGSSSSASSFPEGLKRTHGALNLFAWGVLLPIGAIVARYCRRWDPLWFYLHAGIQFVGFILGLAGIVAGVSLYSKIQANVPAHRGLGIFVLVLGILQILAIFLRPNKDSKYRKFWNWYHHWVGRLALFFAAINIVLGIKVGGAGNSWKIGYGFNLAVLLITIITMEVLLWTRWRNNSSSTAAY

SEQ ID NO: 2979 - protein, 253 aa, Saccharum officinarum
MAMATSTFSPRPATLNKPLRAGAKPAGLHLMPFPRLRAGRLVCATAAGEAPPVEVEQRDEAEPAPAAASNGAAVKDEAPAPKAVQAEAPPAPVPAFRDARWVNGTWDLTKFDKGGVVDWDAVMDAEARRRKWLEDYPEATSTDEAVVFDTSIIPWWAWMKRFHLPEAEKLNGRAAMVGFFMAYFVDSLTGVGLVDQMGNFFCKTLLFVAVAGVLLIRKNEDIESLKKLIDETTFYDKQWQGTWQDDSTRGPKN

SEQ ID NO: 2980 - protein, 562 aa, Zea mays
MVQCTQPPPQLKLPESKITEPTDDENQDLPPKPEKRTRMHHIERHRSCVVTLSDIELNGLQPRHLHQPIEISPGGSQCSLHEETPTDTNASHRHAIADAAWEALKRSMVYFRGQPIGTVAAIDKSQGAALNYDQVFMRDFIPSALAFLMKGEHLIVKNFLVETARLQSREKMVDLFKLGQGVMPASFKVHHRNPTQKTESLLADFGETAIGRVAPVDSGLWWIILLRAYTKWTGDNSLAESTNCQRAMHLILRLCLSEGCDTSPALLCADGCSMIDRRMGIYGYPIEIQALFFMAMRCALSLLKQESDADFVNHITKRIQALSYHLHSYYWLDFQRLNDIYRYKTEEYSQTALNKFNVMPESIPDWIFDFMPSRGGYFIGNVSPARMDFRWFCLGNFIAILSSLATGEQAEAILDLVEERWQELIGEMPLKICYPAMENQEWQIVTGCDPKNTRWSYHNGGSWPVLLWLLVAVSVKLGRPHLARRAVELMEQRLAKDDFPEYYDGKAGRYVGKQARKFQTWSVAGYLVAKMLLDDPSHLRIVALEGDSHSRAPFLKRSNSCP

SEQ ID NO: 2981 - protein, 239 aa, Zea mays
MAMATSTFSPRPASLRPLRAGGKPVGLLPFPRRLACATASGEAPPVEQRDEAEPALAAASNGAAVKSEAPPPPPAPAPVPAFRDARWVNGTWDLAKFDKGSGVDWDAVIDAEARRRRWLEDYPEATNTDEAVVFATSIIPWWAWMKRFHLPEAEKLNGRAAMVGFFMAYFVDSLTGAGLVDQMGNFFCKTLLFAAVAGVLLVRKNEDVESLKKLVDETTFYDRQWQATWQDDSAGGPNN

SEQ ID NO: 2982 - protein, 231 aa, Pseudoroegneria spicata
MEDFVLSYVVTGLAFWSTAFLVMRALMPKRSYEFCNRAVSTMHAVAAVCMACLSVQDWSCPVCPLNAPSSPRQMKSLAVTLSYMIYDAACCHLNGDVRLDNTVHHLVSIVGIGAGLAYQRCGTEMMACMFITEISSPLLHLREMLKELGVKDTDLNLLVDILFAATFSVGRMVGGPYLTYVTLTTDYPILIKAMAAGLQLVSAYWFLRILRMVRYKLGKKRPAAAAKLNAK

SEQ ID NO: 2983 - protein, 236 aa, Brachypodium distachyon
MEEFVVRWVASGFAVWSTAFVAARALMPHRSYEFCNRAVSTAHAVTAVCMACLCVEDWSCPVCPLNAPSTPRQMRALAVTLSYMIYDAACCQLNGDVRLDNTLHHLVSIVGIGAGLAYQRCGTEMVACMVVTEISSPLLHLREMLKELGVKDTDLNLLVDILFAVTFSVARMVGGPYLTYVTLTADYPFLIKAMAAGLQLVSAYWFLRILRMVRYKLAKKRPAPPATSKLVDGKSS

SEQ ID NO: 2984 - protein, 265 aa, Zea mays
MDTFFLSHGSPTLSIDDSIPARHFFKSWVPAKVAGDQPPRAILVVSGHWETATPAVNVIRGSNDTIYDFYGFPKPMYQLKYPAPGAPDLALRTVELLEQAGFGPVKQDHSRGLDHGAWVPLMLMYPDASIPVCQLSVQTDRDGTYHYNLGKALAPLREEGTLIIGSGSATHNLRKISPSDAPVPQWAAEFDTWLKDSLLNGRYEDVKRYEEKAPHARVAHPWPDHFYPLHVALGAAGDGAKAEQIHQCWSNGTLSYASYRFTTNT

SEQ ID NO: 2985 - protein, 265 aa, Zea mays
MDTFFLSHGSPTLSIDDNIPARHFFKSWVPAKVAGDQPPRAILVVSGHWDTATPEVNVIRGSNDTIYDFYGFPKPMYKLKYPAPGAPDLALRTKGLLEQAGFGPVKEDHSRGLDHGAWVPLMLMYPDADIPVCQLSVQSDRDGAYHYSLGRALAPLREEGVLVLGSGSATHNLRKMGPFDAPVPQWAAEFDAWLKDSLLDGRYEDVNRFEEKAPHGRVAHPWPDHFYPLHVALGAAGDGAKAEQIHQCWTNATLSYASYRFTTKS

SEQ ID NO: 2986 - protein, 265 aa, Panicum virgatum
MDTFFLSHGSPTLSIDEAIPARHFFKSWLPARVAGDRPPRAILVVSGHWETATPAVNVIRGTNDTIHDFYGFPKHMYQLKYPAPGAPDLALRTKELLEQAGFGPVKEDHSRGLDHGAWVPLMLMYPDADIPVCQLSVQTDRDGAYHYNLGRALAPLREEGVLVLGSGSATHNLRKMGPMDAPVPQWAAEFDTWLKDALLSGRYDDVNRYEEKAPHAKVAHPWPDHFYPLHVALGAAGDSVKAEQIHQSWTNATVSYACYRFSTNN

SEQ ID NO: 2987 - protein, 276 aa, Saccharum officinarum
MDTFFLSHGSPTLSIDDKIPARHFFKSWVPAKVAGDQPPRAILVVSGHWETATPAVNVIRGSNDTIYDFYGFPKPMYQLKYPAPGAPDLALRTKELLEQAGFGPVKEDHSRGLDHGAWVPLMLMYPDANIPVCQLSVQTDRDGTYHYNLGKALAPLREEGILILGSGSATHNLRKMGPFDAPVPQWVAEFDTWLKDSLLGGRYDDVNRYKEKAPYGRVDHPWPDHFYPLDGSARAPTGTPLNGRAHRTYGGAQRHPVYIRLSAGYKRPSCLTLLLV

SEQ ID NO: 2988 - protein, 202 aa, Zea mays
MDTFFLSHGSPTLSIDDNIPARHFFKSWVPAKVAGDQPPRAILVVSGHWDTATPEVNVIRGSNDTIYDFYGFPKPMYKVRSMPTNHHALALRTKGLLEQAGFGPVKEDHSRGLDHGAWVPLMLMYPDADIPVCQLSVQSDRDGAYHYSLGRALAPLREEGVLVLGSGSATHNLRKMGPFDAPVPQWAAEFDAWLKDSLLDGR

SEQ ID NO: 2989 - protein, 265 aa, Panicum virgatum
MDTFFLSHGSPTLSIDEAIPARHFFKSWLPARVAGDRPPRAILVVSGHWETATPAVNVIRGTNDTIHDFYGFPKPMYQLKYPAPGAPDVALRTKELLERAGFGPVKEDHSRGLDHGAWVPLMLMYPAADIPVFQLSVQTDRDGAYHYNLGRALAPLREEGVLVLGSGSATHNLRKMGPMDAPVAQWAVEFDAWLKDALLSGRHDDVNRYEEKAPHGRVAHPWPDHFYPLHVALGAAGEGARAEQIHQSWTNVSLSYASYRFSANN

SEQ ID NO: 2990 - protein, 115 aa, Solanum tuberosum
MGLQAFILLSLVLAIFAIVTSDVAARELAESSTTTMENTKKSEKKNEVNDAKYLEEIMEEEDTLVVVAEVMEGILVVGLWRVSWWWWWSWRLWRVPWWWWWSWTWWRWILLLWLL

SEQ ID NO: 2991 - protein, 134 aa, Festuca arundinacea
  misc_feature (18)..(18): Xaa can be any naturally occurring amino acid
HEAIIKLGFKQPRRLQIXKPSSPLQNPEKESRAELARSQHVPRRAPEKAQQGGGVQGAAHAPLHHGRLYRSHPRGPLHPPLPQPRARDDGAQARALGQSRCPRPPEVRLGCPNHCLSSLITLKLLSGSGFLRTL

SEQ ID NO: 2992 - protein, 56 aa, Triticum aestivum
MFLGAMPRKPSKEAAYKELRLHLSIMAGCIAVIRAAPYILHYLTREPGMTELKLEL

SEQ ID NO: 2993 - protein, 83 aa, Triticum aestivum
AAAAAPPHPDPQPKPSNPENSPPTTAKMFLGAMPRKPSKEAAYKELRLHLSIMAGCIAVIRAAPYILHYLTREPGMTELKLEL

SEQ ID NO: 2994 - protein, 84 aa, Triticum aestivum
SSVAAFRSPTQTLESGEAERNSPPTTAKMFLGAMPRKPSKEAAYKELRLHLSIMAGCIAVIRAAPYILHYLTREPGMTELKLEL

SEQ ID NO: 2995 - protein, 87 aa, Triticum aestivum
SSSSSLAASRSPTQTLEPSNPERNSPPTTAKMFLGAMPRKPSKEAAYKELRLHLSIMAGCIAVIRAAPYILHYLTREPGMTELKLEL

SEQ ID NO: 2996 - protein, 107 aa, Triticum aestivum
PRADSALGFKQQQQQPRRLQIPNPNPRTLESGEELAADDSQDVSRRDAPEAEQGGGVQGAALAPQHHGGLHRRHPRRPLHPPLPHPRARHDGAQARALGRPRCPPAP

SEQ ID NO: 2997 - protein, 54 aa, Avena sativa
MFLGALPRKPSKEAAYKELRAHLYIMAGCIAAIRAAPYVLHFLNREPEMTELKF

SEQ ID NO: 2998 - protein, 97 aa, Avena sativa
EVCRAIASIKLGFKQPRRLQISKPSSPRQNPEKESKAELARSQHVPRRAPAEAEQGGGVQGAARAPLHHGRLHRGHPRRPYVLHFLNREPEMTELKF

SEQ ID NO: 2999 - protein, 56 aa, Brachypodium distachyon
MFLGAIPRKPSKEAAYKELRSHLIVMASCIVAIRAAPYILHFLTRDADIKELKLEL

SEQ ID NO: 3000 - protein, 81 aa, Secale cereale
PTQTLEPGGELADDSQDVSRRDVPEAQQGGGVQGAAPAPRHHGDLHRPHPRRPLHPPLLHPRARHDGAQARALGRPPAPPR

SEQ ID NO: 3001 - protein, 41 aa, Triticum aestivum
MLLGAMPRKPSKEAGYKELRLHLSIMEGCIAFIRGGPYILH

SEQ ID NO: 3002 - protein, 284 aa, Brachypodium distachyon
TLFLQLRLASLSLVIPSQVRRILVGIPASTMTGVAVAVTLLRLPLARLSSHLRPLPSPPVPPPRLRLSVAHRLISSLLGPGHGLAVAVVSEAVAEVDEEEFEATEEPQLEAAPPSFVLPRLPRPKLDVKERKELASYAHGLGKKLKSQQVGKGGVTPSLVSAFSDNLESNELLKLKIHGNCPGELPDVILQLEESTGSIAVDQIGRSVILYRPSSSKMKKREEVARKREEFARNSTRFLKSEGGFEEHPRNSTSRRFVKSGSTFRTQQKRRSIASKGSSYSRGN

SEQ ID NO: 3003 - protein, 66 aa, Avena sativa
MKKREEVARNREEFARNSARFGKSENAFGERPRSSTSKRFGKSGSTFRTQQKRGSGASKGSSYGRG

SEQ ID NO: 3004 - protein, 253 aa, Solanum phureja
MRTIMAKNQHESFSFSRRYFNFKKKVEDEEYDDEVYLNDFHSSSLRGEEEYFGMHSTANASTVSKKLSRSTVSKLRSALTFGKSRTQIGLGSKVVGTLFGYRRGHVHFAFQEDPKLGPAFFVEMATPTSHLVREMASGLVRIALESDKRTGKKGVKLLEEPIWRTYCNGRKCGYAMKRECGPDEWKILNSIGPVSMGAGVLPSDGDGIGLEGELMYMRAKFERVVGSKDSEAFYMMNPDGHGGPELSLYLLRV

SEQ ID NO: 3005 - protein, 210 aa, Theobroma cacao
MAGGSKSNPPKPRKRVDAASTAAPASSLVRAKDGSAFAKCEECNKTVPVALISMHSCSLDAKIKMNLEAQVIEKPAEVKKKPAERKKPASTESNPKKPKKLKKGKDPNAPKRPPTAFFLFMDDFRKSYKEANPDAKGVTGVAKEGGEKWKSMSEEEKKPYVDKAAELKAEYEKALEEVNDADNENEDGEGGPEKDTAAAEKEAEEVLDDY

SEQ ID NO: 3006 - protein, 261 aa, Solanum phureja
MSSVMLSSSSSSMALHRLLRPAPILSFSFLKQSLSLFPHQTTSLHPITNNSPSFFPSLRTHTSIFLRSRTFSNLPISCTSQALLESSEDVEDEEIVKENEEVTAPRPSESERKILRAKLPNLTVKEKKELASYAHSLGKKLKSQQVGKSGVTDTVVMALEETLEANELLKLKIHGTCPGGELDDVVKHLEEATGSVVVGQIGRTVILYRPSLTKMKAEEKKKQAQILFLKKQKQYAERRSFQDKGPVPRSYARSRRGSSRV

SEQ ID NO: 3007 - protein, 79 aa, Capsicum annuum
MVLALVLYPEMIVSQRIAFVFSYKDFEPVSSSLQLSFLSGSDGRESQSYLFDQQPLSQLLPLNALQYHPALLQDKYHVF

SEQ ID NO: 3008 - protein, 283 aa, Brachypodium distachyon
MSTGGEEALRLQYVVGDEIGRGRFGTVRRCHSAATGEAFAVKSTAKAPLLDPLDLALAEQEPKVHLLVSSPPCSRHVVALHAAFEDAHAVHLVLDLCAGGDLLSLLSARGGRLPEREAAGLAAQLAAALAACHRRGVAHRDVKPDNLLFDAAGALKLADFGSAEWFGDGRAMTGLVGTPYYVAPEVVAGREYGEKVDVWSAGVVLYVMLSGTVPFYGATAPEIFESVLRGNLRFPPRAFASVSPEAKDLMRRMLCKDVSRRFSADQVLRHPWIASRGGDAVAD

SEQ ID NO: 3009 - protein, 296 aa, Hordeum vulgare
MVYGGEEALMRQYSIGDEIGRSRFGTVRRCHSNATGEALALKTTPKAPLRDPLDLALAEQEPKLHLLASSPPCSPHLVALHAAFDDANAVHLVVDLCAGGDLLSLVSARGGRLPEREAVGLAAQLASALAACHRRGVAHRDVKPDNLLFDAATSVLKLADFGSAEWFGDGRPMSGLVGTPYYVAPEVVAWREYGEKVDVWSAGVVLYMMLSGAVPFYGATAPEIFEAVLRGNLRFPPRAFAGVSPEAKDLMRRMLCKDVSRRFSTEQVLKASRGIASLLPGNAVLRGLKQNRLEPN

SEQ ID NO: 3010 - protein, 289 aa, Oryza sativa
MSSGGELALRQEYVIGDEIGRGRFGTVRRCYAVATGEAFAVKSTPKAPLREAEAADALDLALAEQEPKVHLVASAPGPGASPHVVALHAAFEDDAAVHLVVDLCAGGDLLSLVSSRGRLPEHEAADLVAQLASALASCHRRGVAHRDVKPDNLLFDGGGVLKLGDFGSAGWFGDGRPMTGLVGTPYYVAPEVVAGREYGEKVDVWSAGVVLYMMLSGTLPFYGATAAEVFQCVLRGNLRFPPRAFASVSPEAKDLMRRMLCKDVSRRFSADQVLRHPWIVSRGGAAVMG

SEQ ID NO: 3011 - protein, 257 aa, Zea mays
MAAEDQTPCTKLRPGKAKTRKKTKRDKWGQPISAAAADEEPSVEPEQEHPAGVVEAAVQVEKEEEEEATAAAEGYEPGKVVASGLPYTTTEADIRKLFEFYGPIQSMQLSRFPDSGNFRGLAFLCFESEEDAIKSLELDGFKIGSRYMRVERCRVTATSNKKRKAEFETDPKKSEGCLSAYVGNLSWNVDENDLRGFFGPSKIASVRFAVDKRTGGSRGFCHVEFQDDESLEKAIAMNQSKLQGRPVKVAYSVSNRG

SEQ ID NO: 3012 - protein, 261 aa, Setaria italica
MAAEEHAPCTKPRPDKAMKRKKPKKDKWGQPLSAAAAEEDPSVEPEQEPPAVGAEESAAAAAAAAGAEESEAAAAAEGYEPGKVVASGMPYTTTEVDIRKLFEFYGPLRSVQLSRFPDSGNFRGLAFVCFESDEDAVKSIELDGFKIGNRYMRVERCRVTASSNKKRKAEFQTDPEKSVGCLSAYVGNLSWNVTEKDLRAFFKSSKIASMRFAIDKRTGSSRGFCHVDFEDDESLEKAVAMNQSELQGRPVKVAYSVSNRG

SEQ ID NO: 3013 - protein, 376 aa, Theobroma cacao
MAHSAVSQVSVAVPIGSDISLRRSVSKRNSISFGDKSWVSTLSLDLKSRNIQKSNQYIVCMSVQQASKSKVAVSPLELENAKEPPLNLFKPKEPYTATIVSVERLVGPKAPGETCHIVIDHGGNVPYWEGQSYGVIPPGENPKKPGSPHNVRLYSIASTRYGDSFDGKTASLCVRRAVYYDPETGKEDHSKNGVCSNFLCNTKPGDKVQITGPSGKIMLLPEDNPNANHIMIATGTGVAPFRGYLRRMFMEDVTFKFRGLAWLFLGVANADSLLYDDEFTKYLQDFPDHFRYDGALSREQKNKSGGKMYVQDKIEEYSDEIFKLLDDGAHIYFCGLKGMMPGIQETLKRVAEKRGENWDEKLSQLKKKKQWHVEVY

SEQ ID NO: 3014 - protein, 377 aa, Castanea mollissima
MAQLAASQVAVTVPVGSDLSTRRSVFKTHSISFHDKSWAPSLSLDLKTKNARLRNRPIICQSVQQTSVPKVNVSPLYLENAKEPPLNIHKPKEPYTATIVSVERIVGPKAPGETCHIVIDHGGNVPYWEGQSYGIIPPGENPKKPGSPHNVRLYSIASTRYGDTFDGKTASFCVRRAVYYDPETGKEDPSKNGVCSNFLCNSKPGDRVRVTGPSGKIMLLPEDNPNATHIMIATGTGVAPYRGYLRRMFMESVPTFKFNGLAWLFLGVANSDSLLYDDEFKKYLKDYPNNFRYDLALSREQKSKSGGKMYVQDKIEEYSDEIFKLLDTGAHIYFCGLKGMMPGIQETLKRVADQRGENWEEKLSQLKKNKQWHVEVY

SEQ ID NO: 3015 - protein, 380 aa, Fragaria vesca
MSHLMALSQVSLGATVSVGSDASLRRSVFKAQNVNFSDKSWAPVLPLDLKTKSGRLRNKSVVCMSVQQASAPKVAVSPLELDNATEPPLNIYKPKEPYTATIVSVERIVGPKAPGETCHIVIDHGGNVPYWEGQSYGVIPPGENPKKPGAPNNVRLYSIASTRYGDYFDGKTTSLCVRRAVYYDPETGKEDPSKNGVCSNYLCNSKPGDKIKITGPAGKIMLLPEDNPNATHIMIATGTGVAPYRGYLRRMFMEAVPTFKFGGLAWLFLGVANTDSLLYDEEFSKYLKDYPDNFRYDIALSREHKNKRGGKMYVQDKIEEYSDEIFKLLDGGAHIYFCGLKGMMPGIQETLKRVAEERGESWEEKLSQLKKNKQWHVEVY

SEQ ID NO: 3016 - protein, 378 aa, Medicago truncatula
MSHLSASQMAVTVPVSNDFSARRSVFKASNINFRDKSWAPVFALDMKAKNCGWRRNQNVICMSVQQASVPKVAVSPLELENPAEPPLNLHKPKEPYTATIVSVERLVGPKAPGETCHVVINHDGNVPYWEGQSYGVIPPGENPKKPGAPHNVRLYSIASTRYGDFFDGKTASLCVRRAVYYDPETGKEDPSKNGVCSNFLCDSKPGDKIKITGPSGKIMLLPEDDPNATHIMIATGTGVAPYRGYLRRMFMESVPTFKFGGLAWLFLGVANSDSLLYDDEFTKYLKDYPENFRYDRALSREEKNRNGGKMYVQDKIEEYSDEIFKLLDNGAHIYFCGLKGMMPGIQETLKRVAENRGESWEEKLSQLKKNKQWHVEVY

SEQ ID NO: 3017 - protein, 377 aa, Pisum sativum
MSHLAVSQMAVTVPVSSDFSVRRSAFKSSNLNFRDKSWAPVFTLGMKAKNCGWRNHNVICMSVQQASVPKVTVSPLELENPSEPPLNLHKPKEPYTATIVSVERLVGPKAPGETCHIVINHDGNVPYWEGQSYGVIPPGENPKKPGSPHNVRLYSIASTRYGDNFDGKTASLCVRRAVYYDPVTGKEDPSKNGVCSNFLCDSKPGDKIKIAGPSGKIMLLPEDDPNATHIMIATGTGVAPYRGYLRRMFMESVPTFKFGGLAWLFLGVANVDSLLYDDEFTKYLKDYPDNFRYNRALSREEKNKNGGKMYVQDKIEEYSDEIFKLLDNGAHIYFCGLRGMMPGIQETLKRVAEKRGESWEEKLSQLKKNKQWHVEVY

SEQ ID NO: 3018 - protein, 164 aa, Saccharum officinarum
MSRPNRSDAHLSAEDEATLEAEVRGYYDEAAPKRHTKPSRSEHSAVYADALVPDAGGNTHPELDKFQELEAHTERLAYEGGNVGEEFVETEYYKDLGGVGKQHHTTGTGFIKIDKAKGASFKLSEDPSAEERHASCKGNPATNEWIPSADTVYPASDKPSRSDS

SEQ ID NO: 3019 - protein, 165 aa, Zea mays
MSRPPNRSDAHLSAEDEAALEAEVREYYDDAAPKRHTKPSRSEHSAVYVDALVPDVGGNSHPELDKFQELEAHTERLVYEGANVGDEFVETEYYKDLGGVGEQHHTTGTGFIKMDKAKGAPFKLSEDPNAEERHASCRGNPATNEWIPSANTVYPASDKPSRSDS

SEQ ID NO: 3020 - protein, 161 aa, Panicum virgatum
MSRPSRSDAHLSPADEAAREAEVREYFDDAAPKRHTKPSRSDHSAVYADALVPDSSHPELDKFQELEAHTERLVYEGGKVGEEFVETEYYKDLGGVGKQHHTTGTGFIRMDRDKGASFKLSEDPDAAERHASCKGNPATNEWIPSADTVYPASDKPSRSDS

SEQ ID NO: 3021 - protein, 162 aa, Pennisetum glaucum
MSSRPNRSDVHLSPEDEAAREAEVRGYFDDAAPKRHTKPSRSEHSAVYADAIVPDSTHPELDKFQDLEAHTERLVYEGGKVGEEFVETEYYKDLGGVGKQHHTTGTGFIRMDRDKGASFKLSENPDAAERHASCKGNPATNEWIPSADTVYPASDKPSRSDS

SEQ ID NO: 3022 - protein, 155 aa, Setaria italica
MSRPNRSDAHLSPEDEAAREAEVRGYFDDAAPKRHTKPSRSEHSPVYADAIVPDSSHPELDKFQDLEAHTERLVYEGGKVGEEFVETEYYKDLGGVGKQHHTTGTGFIGMDRDKGASFKLSEDPDAAERHASCKGNPATNEWIPSADTKPSRSDS

SEQ ID NO: 3023 - protein, 223 aa, Zea mays
MAASLPTTAARLAAPAFAYRSPNAPSATALPRAAAFPAIAVAAAPLRPRRAPRPVAARAGGEERETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYVNGEIIPCTYPTYQPKERRTSKYESRRYERRRDGPPAASRKPRQQAPAQTQTESASS

SEQ ID NO: 3024 - protein, 224 aa, Pennisetum glaucum
ASSLPPTAAAARLAAQAFAFPSPRPSSASAALPRASAFPAVAVAAAPLRARRAQQQQLRPPAAAGGEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIVPCTYPTYQPKERRTSKYESRRYERRRDGPPANRRPRQQAPQTESASS

SEQ ID NO: 3025 - protein, 228 aa, Panicum virgatum
  misc_feature (113)..(113): Xaa can be any naturally occurring amino acid
AASLPPTAAAARLVAQAFAFPSPRPSPATASAALPRASAAAVFPAIAVAAAPPRPRRARRPAPPAAGAGGEQRETILLPGCDYNHWLIVMEFPKDPAPTREQMIDTYLNTLAXVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPANRKPRQQAPQTESASS

SEQ ID NO: 3026 - protein, 228 aa, Hordeum vulgare
MAALPTAAAAGRVAASAFTFPAKPSASSFSAASLPRAAAAAAAFPAIALAPAGGLQRRRRPTAAGAAPGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRRPKQQAGQPESASS

SEQ ID NO: 3027 - protein, 227 aa, Triticum aestivum
MAALPTAAAAGRVAASAFTFPAKPSASSLAAFLPRAAAAAAAFPAIALAPAGALQRRRRPTAAGAAPGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRKPKQQATQPESASS

SEQ ID NO: 3028 - protein, 228 aa, Leymus cinereus x Leymus triticoides
  misc_feature (216)..(216): Xaa can be any naturally occurring amino acid
MAALPTAAAAGRVAASAFTFPAKPSLSSFSAASLPRAAAAAAAFPAIALAPAGGLQRRRRPTAAGAAPGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRRXKQQATQPESASS

SEQ ID NO: 3029 - protein, 228 aa, Triticum aestivum
MAALPTAAAAGRVAGSAFTFPAKPSLSSFSAASLPRAAAAAAVYSAIALAPAGSLQRRRRPTAAGAAPGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRKPKQQATQPESASS

SEQ ID NO: 3030 - protein, 228 aa, Triticum aestivum
MAALPTAAAAGRVAGSAFTFPAKPSLSSFSAASLPRAAAAAAVYSAIALAPAGSLQRRRRPTAAGAAPGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRKSKQQATQPESASS

SEQ ID NO: 3031 - protein, 229 aa, Brachypodium distachyon
MASLPTAAATARVAATRSFAFPARPSFSASTAALPRASSAGTVFPAIALAAAAAAAGRAMRLTAARAAPGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRRPKQQATQPESASS

SEQ ID NO: 3032 - protein, 229 aa, Oryza sativa
MASFPTTAAAAAAQAFAFALAPKPSSSAAAPSALFPRTAAAAAFPTLAVRGSGKARQPVVAAAAGAGTGSEQRETILLPGCDYNHWLIVMEFPKDPAPTREQMIDTYLNTLATVLGSMEEAKKNMYAFSTTTYTGFQCTVDEETSEKFKGLPGVLWVLPDSYIDVKNKDYGGDKYINGEIIPCTYPTYQPKERRTSKYESRRYERRRDGPPASRRPRPQTAQPESASSS

SEQ ID NO: 3033 - protein, 258 aa, Zea mays
MAEREQQEQVASDDAAEWKQVAELRAVTQAQDPSCKDEDDYTLRRFLRARDHNIGKASAMLLKYLKWKPAAKPHGAIAAAEVAREAAQGKLYLQGHDREGRPLIYGFGARHHPARRDLDEFKRYVVHVLDATVARLPPPPPGDVRQEKFAAVADLAGWGYANCDIRGYLAALDIMQSYYPERLARVFLVHVPYVFMAAWKIVYPFIDDNTKKKFVFVPDKDLDRTLREAIDDSQLPEIYGGKLKLKLVTPPANKLPSH

SEQ ID NO: 3034 - protein, 258 aa, Zea mays
MAEREQQEQVASDDAAEWKQVAELRAVTQAQDPSCKDEDDYTLRRFLRARDHNIGKASAMLLKYLKWKPAAKPHGAIAAAEVAREAAQGKLYLQGHDREGRPLIYGFGARHHPARRDLDEFKRYVVHVLDATVARLPPPPPGDGRQEKFAAVADLAGWGYANCDIRGYLAALDIMQSYYPERLARVFLVHVPYVFMAAWKIVYPFIDDNTKKKFVFVPDKDLDRTLREAIDDSQLPEIYGGKLKLKLVTPPANKLPSH

SEQ ID NO: 3035 - protein, 244 aa, Pennisetum glaucum
MAAASNGHHKDGDAAEWEQVAELRAVTEAQDPACKEEDDYTLRRFLRARDHHIGRASAMLLKYLKWKPAAKPGGSVPAAEVARELSQGKLCLQGHDRQGRPMIYGFGARHHPSNRDLDEFKRFVVHVLDATVDRLPPGQEKFAAVADLKGWGYSNCDIRAYLAALDIMQSYYPERLGRVFLIHVPYVFMAAWKIVYPFIDDNTRKKFVFVPDKDLDRTLREAIDDAQLPEMYGGKLKLAPPAHK

SEQ ID NO: 3036 - protein, 253 aa, Arabidopsis lyrata
MANLPTVLVTGASGRTGQIVYKKLKEGSDKFIAKGLVRTAEGKEKIGGEADVFIGDITDADSINPAFQGIDALVILTSAVPKMKPGFDPTKGGRPEFIFEDGQYPEQVDFIGQKNQIDAAKVAGVKHIVVVGSMGGTNPDHPLNKLGNGNILVWKRKAEQYLADSGTPYTIIRAGGLLDKEGGVRELIVGKDDELLQTDTKTVPRADVAEVCIQALLFEEAKNKAFDLGSKPEGTSSPTKDFKALFSQVTSRF

SEQ ID NO: 3037 - protein, 253 aa, Raphanus sativus
MANLPTVLVTGASGRTGQIVYKKLKERSDKFVAKGLVRTPEGKEKIGGEADVFIGDITDADIITPAVQGIDALVILTSAVPKMKPGFDPTKGGRPEFIFDDGQYPEQVDWIGQKNQIDAAKVAGVKHIVLVGSMGGTNPDHPLNKLGNGNILVWKRKAEQYLADSGTPYTIIRAGGLLDKEGGARELLVGKDDELLQTDTKTVPRADVAEVCIQALLFEEAKNKAFDLGSKPEGTSSPTKDFKALFSQVTARF

SEQ ID NO: 3038 - protein, 253 aa, Raphanus sativus
  misc_feature (240)..(240): Xaa can be any naturally occurring amino acid
MANLPTVLVTGASGRTGQIVYKKLKERSDKFVAKGLVRTPEGKEKIGGEADVFIGDIRDADSITPAVQGIDALVILTSAVPKMKPGFDPTKGGRPEFIFDDGQYPEQVDWIGQKNQIDAAKVAGVKHIVLVGSMGGTNPDHPLNKLGNGNILVWKRKAEQYLADSGTPYTIIRAGGLLDKEGGARELLVGKDDELLQTDTKTVPRADVAEVCIQALLFEEAKNKAFDLGSKPEGTSSPTXDFKALFSQVTARF

SEQ ID NO: 3039 - protein, 253 aa, Thellungiella halophila
MANLPTVLVTGASGRTGQIVYKKLKERSDKFVAKGLVRTPEGKEKIGGEADVFIGDITDADSIKPAVQGIDALVILTSAVPKMKPGFDPTKGGRPEFMFDEGQYPEQVDWFGQKNQIDAAKVAGVKHIVVVGSMGGTNPDHPLNKLGNGNILVWKRKAEQYLADSGTPYTIIRAGGLLDKEGGVRELLVGKDDELLQTDTKTVPRADVAEVCIQALLFEEAKLKAFDLGSKAEGTSAPTKDFKALFSQVTSRF

SEQ ID NO: 3040 - protein, 253 aa, Raphanus sativus
MANLPTVLVTGASGRTGQIVYKKLKERSDKFVAKGLVRTPEGKDKIGGEADVFIGDIRDADSITPAVQGIDALVILTSAVPKMKPGFDPTKGGRPEFMFDDGQYPEQVDWIGQKNQIDAAKVAGVKHIVLVGSMGGTNPDHPLNKLGNGNILVWKRKAEQYLADSGTPYTIIRAGGLLDKEGGARELLVGKDDELLQTDTKTVPRADVAEVCIQALLFEEAKNKAFDLGSKPEGTSSPTKDFKALFSQVTARF

SEQ ID NO: 3041 - protein, 253 aa, Brassica juncea
MANLPTVLVTGASGRTGQIVYKKLKESSDKFVAKGLVRTPEGKEKIGGEADVFIGDIRDADSITPAIQGIDALVILTSAVPKMKPGFDPTKGGRPEFIFDDGQYPEQVDWIGQKNQIDAAKVAGVKHIVLVGSMGGTNPDHPLNKLGNGNILVWKRKAEQYLADSGTPYTIIRAGGLLDKEGGARELLVGKDDELLQTDTKTVPRADVAEVCIQALLLEEAKNKAFDLGSKPEGTSSPTNDFKALFSQVTARF

SEQ ID NO: 3042 - protein, 253 aa, Raphanus sativus
MANLPTVLVTGASGRTGQIVYKKLKERSDKFVAKGLVRTPEGKDKIGGEADVFIGDITDADSITPAVQGIDALVILTSAVPKMKPGFDPTKGGRPEFMFDDGQYPEQVDWIGQKNQIDAAKVAGVKHIVLVGSMGGTNPDHPLNKLGNGNILVWKRKSEQYLADSGTPYTIIRAGGLLDKEGGARELLVGKDDELLQTDTKTVPRADVAEVCIQALLFEESKNKAFDLGSKPEGTSSPTKDFKALFSQVTARF

SEQ ID NO: 3043 - protein, 253 aa, Brassica oleracea
MANLPTVLVTGASGKTGQIVYKKLKERSDKFVAKGLVRTPQGKEKIGGEDDVFIGDIRDADSITPAIQGIDALVILTSAVPKMKPGFDPTKGGRPEFIFDDGQYPEQVDWIGQKNQIDAAKAAGVKHIVLVGSMGGTNPDHPLNKLGNGNILIWKRKAEQYLADSGTPYTIIRAGGLLDKEGGARELLVGKDDELLQTDTKTVPRADVAEVCIQALLFEEAKNKAFDLGSKPEGTSSPTNDFKALFSQVTARF

SEQ ID NO: 3044 - protein, 253 aa, Brassica rapa
MANLPTVLVTGASGRTGQIVYKKLKERSDKFVAKGLVRTPEGKEKIGGEDDVFIGDIRDAESITPAIQGIDALVILTSAVPKMKPGFDPTKGGRPEFIFDDGQYPEQVDWIGQKNQIDAAKAAGVKHIVLVGSMGGTNPDHPLNKLGNGNILIWKRKAEQYLADSGTPYTIIRAGGLLDKEGGARELLVGKDDELLQTDTKTVPRADVAEVCIQALLFEEAKNKAFDLGSKPEGTSSPTNDFKALFSQVTARF

SEQ ID NO: 3045 - protein, 253 aa, Brassica napus
MANLPTVLVTGASGKTGQIVYKKLKERSDKFVAKGLVRTPQGKEEIGGEDDVFIGDIRDADSITPAIQGIDALVILTSAVPKMKPGFDPTKGGRPEFIFDDGQYPEQVDWIGQKNQIDAAKAAGVKHIVLVGSMGGTNPDHPLNKLGNGNILIWKRKAEQYLADSGTPYTIIRAGGLLDKEGGARELLVGKDDELLQTDTKTVPRADVAEVCIQALLFEEAKNKAFDLGSKPEGTSSPTNDFKALFSQVIARF

SEQ ID NO: 3046 - protein, 245 aa, Brassica juncea
YAGASGRTGQIVYKKLKERSDKFVAKGLVRTPEGKEKIGGEDDVFIGDIRDAESITPAIQGIDALVILTSAVPKMKPGFDPTKGGRPEFIFDDGQYPEQVDWIGQKNQIDAAKAAGVKHIVLVGSMGGTNPDHPLNKLGNGNILIWKRKAEQYLADSGTPYTIIRAGGLLDKEGGARELLVGKDDELLQTDTKTVPRADVAEVCIQALLFEEAKNKAFDLGSKPEGTSSPTKDFKALFSQVTARF

SEQ ID NO: 3047 - protein, 253 aa, Cleome gynandra
MADHPTILVTGASGRTGHIVYNKLKERSNQFVARGLVRTPEGKEKIGGKDDVFVGDIRDANSINPAIQGIDSLIILTSAVPKMKPGFDPSKGGRPEFTFDDGQYPEQVDWIGQKNQIDAAKAAGVKHIVLVGSMGGTNPDHPLNKLGNGNILIWKRKAEQYLADSGIPYTIIRAGGLLDKEGGVRELIIGKDDELLQTDTKTIPRADVAEVCIQALMLEEAKYKAFDLASKPEGNGTPTKDFKALFSQAINRF

SEQ ID NO: 3048 - protein, 238 aa, Raphanus sativus
  misc_feature (182)..(182): Xaa can be any naturally occurring amino acid
MANLPTVLVTGASGRTGQIVYKKLKERSDKFVAKGLVRTPEGKDKIGGEADVFIGDIRDADSITPAVQGIDALVILTSAVPKMKPGFDPTKGGRPEFMFDDGQYPEQVDWIGQKNQIDAAKVAGVKHIVLVGSMGGTNPDHPLNKLGNGNILVWKRKAEQYLADSGTPYTIIRAGGLLDKEXGARELLVGKDDELLQTDTKTVPRADVAEVCIHALLFEEARIKLLIWAQARGNEFSY

SEQ ID NO: 3049 - protein, 221 aa, Brassica juncea
SKGLVRTPEGKEKIGGEADVFIGDIRDVDSITPAIQGIDAFVILTSAVPKMKPGFDPTKGGRPEFIFDDGQYPEQVDWIGQKNQIDAAKVAGVKHIVLVGSMGGTNPDHPLNKLGNGNILVWKRKAEQYLADSGTPYTIIRAGGLLDKEGGARELLVGKDDELLQTDTKTVPRADVAEVCIQALLLEEAKNKAFDLGSKPEGTSSPTNDFKALFSQVTARF

SEQ ID NO: 3050 - protein, 328 aa, Thellungiella halophila
MTTTTTTLFHPLLPTSSYKSGAVTSSIVSFPRSQFPSSSSSLQFHSLVSDSTSIFGRRKFTGNLRRVSVIVSAAGTTEPLTVLVTGAGGRTGQIVYKKLKERSDQFVAKGLVRTKESKEKIGGEDEVFIGDIRDPAAIASAVQGIDALVILTSAVPQMKPGFDPSKGGRPEFFFEEGAYPEQVDWIGQKNQIDAAKAAGVKQIVLVGSMGGTNINHPLNSIGNANILVWKRKAEQYLADSGIPYTIIRAGGLQDKEGGIRELLVGKDDELLETDTRTIARADVAEVCVQALQLEEAKFKALDLASKPEGTGTPTKDFKALFAQVTTKF

SEQ ID NO: 3051 - protein, 288 aa, Senecio madagascariensis
ASLTRVLSQSSTNNTISYNLTTTSITRRARRFSVLSMSGSTVLVTGASGRTGQIVYKKLKERSSEYIARGFVRSEESKEKIGGGDDVFIGDIRNIETLVPAIQGIDALVILTSAVPKMKPGFDPTKGGRPEFYYEEGSYPEQVDWEGQKNQIDTAKAAGVKQIVVVGSMGGTNPNHPLNSLGNGNILIWKRKAEQYLADSGIPYTIIRAGGLQDKDGGVRELLIGKDDELLQTETKTVARADVAEVCIQALQFEEAKFKAFDLASKPEGTGTPTKDFKTIFSQITTKF

SEQ ID NO: 3052 - protein, 234 aa, Triticum aestivum
MEDYGGVASLVASGVVFWSTAFLLLRALLPKRSYDFCNRAVSTMHAVTGVALGCLSVQDWASPVSPVASPSSPRQMRALAVTLSYMIYDGACCHLSGDARLDNALHHLISIVGLAAGLAYQRCGTELVACLLVTEISSPLLHLREMLKELGVKDTDLNLLVDILFAVTFSVARMVCGTYVTYRTVTADNPILIKTMATSLLLVSAYWFLRILRMVRHKIGKKRLASKAAGKGSM

SEQ ID NO: 3053 - protein, 232 aa, Brachypodium distachyon
MEEYYGVASWVVSGVALWSTAFLALRALLPKRSYDFCNRAVSTMHAVAGVGLGCLSVQDWASPVSPVASPSSPRQMRALAVTLSYMIYDAACCHLSGDARLDNALHHLISIVGLAAGLLYRRCGTELVACLLVTEISGPLLHLREMLKELGIKDTDLNLLVDILFAVTFSVARMVGGTYVTYRTVTADNPILIKTMATSLLLVSAYWFLRILRMVRHKLGKKRPAKLAAKAK

SEQ ID NO: 3054 - protein, 201 aa, Triticum aestivum
KRSYDFCNRAVSTMHAVTGVALGCLSVQDWASPVSPVASPSSPRQMRALAVTLSYMIYDGACCHLSGDARLDNALHHLISIVGLAAGLAYQRCGTELVACLIVTEISSPLLHLREMLKEIGVKDTDLNLLVDILFAVTFSVARMVCGTYVTYRTVTADNPILIKAMATSLLLVSAYWFLRILRMVRHKIGKKRLASKAASK

SEQ ID NO: 3055 - protein, 324 aa, Cenchrus ciliaris
  misc_feature (192)..(192): Xaa can be any naturally occurring amino acid
MCPTTPDRANKAAAGCGDRSWREEAVAAGSLRQVDLDRGANGWASPPGDLFHLRARGYFSGGGGKRGKAPSAPEWLLRPAGVDWLRSHARLDHVLARDDNRVAAAFRRARLRKDPTAHFLLAVNLQVPGRPDAYSAVFYFAAEAPIPPDSLLGRFVHGDDAYRNARFKIANRIVKGPWLVRATVGNYAACLXGRALTCRYHKGDDYLEIDVDIGSSAIASAILHLALGAVTSVTIDMGFLVESQSEEELPERLFGAVRIAQMEMSAAKYVELPPDEAMPETAGRAGAGFRVSSAKVVNHSRQQEHAGGKVGRSMSCQERDNGGK

SEQ ID NO: 3056 - protein, 327 aa, Saccharum officinarum
MCPTKPDRPGQAAAAAGSGGKSWREEAVAAGSLRLVDLDRGANGWASPPGDLFHLRARGYFNCGGGKRGKAPSAADWLLRPAGVDWLRSHARLDHVLARDDNRVAAAFRRARLRKDPTAHFLLAVNLQVPGRPDAYSAVFYFAAEAPIPPDSLLGRFIHGDDAYRNARFKIANRIVKGPWLVRATVGNYAACLLGRALTCRYHKGDDYLEIDVDIGSSAIASAILHLALGAVTSVTIDMGFLVESQSEEELPERLFGAVRIAQMEMGAAKYVELPPDEAMPETAGRAGAGFRVSSAKVVNHSRQQDHAGGKVGRSMSCLDRESGGGK

SEQ ID NO: 3057 - protein, 326 aa, Brachypodium distachyon
MPPTTPQRRNQDEAPPRDWREEAVSAGSLRQVDLDSGTNGWAPPPGDLFHLRARGYFSSSGGGGRRAKAPSSPEWLLRPAGVDWLRSHARLDHVLARDDNRVAAAFRRARLRKDPNAHFLLAVNLQVPGRPDAYSSVFYFAAEAPIAPDSLLGRFVYGDDAYRNSRFKIVNRIVKGPWLVRATVGNYGACLLGRALTCRYHKGDDYLEIDIDIGSSAIASAILHLALGAVTSVTIDMGFLVESQSEEELPEKLFGAVRIAQMEMSSAKYVETAADEAAPETAGKAGAGFRVGSAKVANDSRHQERASGKVSRSMSCQERLGGGKQK

SEQ ID NO: 3058 - protein, 324 aa, Panicum virgatum
MCPTEPDRANKAAAGSGDRSWREEAAAAGSLRQVDLDRGTNGWASPPGDLFHLRARGYFSGGGGKRGKAPSAAEWLLRPAGVDWLRSHARLDHVLARDDNPVAAAFRRARLRKDPTAHFLLAVNLQVPGRPDAYSAVFYFAAEAPIPPDSLLGRFVHGDDAYRNARFKIANRIVKGPWIVRATVGNYAACLLGRALTCRYHKGDDYLEIDVDIGSSAIASAILHLALGAVTAVTIDMGFLVESQSEEELPERLFGAVRIAQMEMSAAKYVELPPDEAMPETAGRAGAGFRVSSAKVVNHSRQQEHAGGKAGRSMSLPERERGGK

SEQ ID NO: 3059 - protein, 322 aa, Setaria italica
MCPTTPDRANKTAAAGSGDRSWREEAAAAGSLRQVDLDRGANGWASPPGHLRSRGYFSGGGGKRGKAPSAAEWLLRPAGVDWLRSHARLDHVLARDDNRVAAAFRRARLRKDPTAHFLLAVNLQVPGRPDAYSAVFYFAAEAPIPPDSLLGRFVHGDDAYRNARFKIANRIVKGPWLVRATVGNYAACLLGRALTCRYHKGDDYLEIDVDIGSSAIASAILHLALGAVTSVTIDMGFLVESQSEEELPERLFGAVRIAQMEMSAAKYVELPPDEAMPETAGRAGAGFRVSSAKVVNHSRQQEHAGGKVGRSMSCPGRDSGGK

SEQ ID NO: 3060 - protein, 324 aa, Zea mays
MCPTKPDRPGQAAAGSGEKSWREEAVAACSLRLVDLDRGTNGWASPPGDLFHLRARGYFSSGGGKRGKAPSAADWLLRPAGVDWLRSHARLDHVLARDDNRVAAAFRRARLRKDPSAHFLLAVNLQVPGRPDAYSAVFYFAAEAPIPPDSLLGRFIHGDDAYRNARFKIANRIVKGPWIVRATVGNYAACLLGRALTCRYHKGDDYLEIDVDIGSSAIASAILHLALGAVTSVTIDMGFLVESQSEEELPERLFGAVRIAQMEMSAAKYVELPPDEAMPETAGRAGAGFRVSSAKVVNHSRQQDHAGGKVGRSMSCPERESGEK

SEQ ID NO: 3061 - protein, 318 aa, Hordeum vulgare
PPTTPQRRKQDESGENWREEAVSAGSLRQVDLDRGTNGWAAPPGDLFQLRARGYFSGGGGKRGKAAASADWLLRPAGVDWLRSHARLDHLLARDDVPVAAAFRRARLRKDPDAHFLLAVNLQVPGRPDAYSSVFYFAAEAPIPPDSLLGRFVYGDDAYRNARFKIVNRIVKGPWLVRATVGNYGACLLGRALTCRYHKGDDYLEIDVDIGSSAIATAILHLALGAVTSVTIDMGFLVESQSEEELPEKLFGAVRIAQMEMGSAKYVETATEEPETAGKAAPGFRVGSARVANDSRHQERASGKASRSMSCQERLGGGK

SEQ ID NO: 3062 - protein, 260 aa, Solanum phureja
MGGDHKEKTTIMVLKVDLQCPCCYKKAKKILCKMPQVRDQMYDEKANTITILVVCCSPERIRDKLCCKGGKAIKSIEIKEPAKPKEPEKPKGGDKPKEPEKSKEPEKKPKVVTFETPKEKAKEPEKPKDKAKDSDKPKGQEKPTVIDKPKDKPKDPEKPKDGPTSAAMVATPWISEPMMMMPPVHGYPQAMPGCGWGECPYTGGPCYQYYGTPVPPQPAPYHGNYSYGYGPGPGPSSYGKGYYGNNDYYNEENGQGCTIM

SEQ ID NO: 3063 - protein, 256 aa, Solanum tuberosum
MGGDHKEKTTIMVLKVDLQCPCCYKKAKKILCKMPQVRDQMYDEKANTITILVVCCSPERIRDKLCCKGGKAIKSIEIKEPAKPGKSEGDDKPGKQEEPQKKTKVVTFATPNDKAKDSDKPKGQEKPTVIDKPKGQEKPTVIDKPKDKPKDPEKPKDGPTSAAMVATPWISEPMMMMPPVHGYPQAMPGCGCGQCHYTGGPCYQYYGTPVPPQPAPYHGNYSYGYGPGPGPSSYGKGYYGNNDYYNEENGQGCTIM

SEQ ID NO: 3064 - protein, 257 aa, Solanum tuberosum
MGGDHKEKTTIMVLKVDLQCPCCFKKAKKILCKMPQVRDQKYDEKANTITILVVCCSPERIRDKLCCKGGKAIKSIEIKEPAKPPEKSKGDDKPVKQEEPPKKTKVVTFETPNDKAKDSDKSKGQEKPTVIDKPKGQEKPTVIDKPKGKPKDPEKPKDGPTSAAMVATPWISEPMMMMPPVHGYPQAMPGCGCGQCHYTGGPCYQYYGTPVPPQPAPYYGNHSYGYGLGPGPSSYGKGFYGNNDYYNEENGQGCTIM

SEQ ID NO: 3065 - protein, 289 aa, Solanum tuberosum
MVDNFDDIINWDDVDHIFHNVLDNPHDDDQFTLHDSSPQTFQQIEQLLMNDDDVGLVSFEDADPQFAADFLSDVLVDSPLHSDHSHSPAEQAIGFTDSKVSSGSDADQDKHKSPSDGDDELNNHDPVDKKRKRQLRNRDAAVRSRERKKLYVRDLELKSRYFESECKRLGFVLQCCLAENQALRFSLQNSSANGVSMTKQESAVLLLESLLLGSLLWFLGITCLLILPSQTWSVPEENQGSRNHGLLLPIKEGKKTSRILLFLSFMMGKRCKASRSRMKFNPHSLGVVM

SEQ ID NO: 3066 - protein, 289 aa, Solanum phureja
MVDNFDDIINWDDVDHIFHNVLDNPHNDDQFTLHDSSPQTFQQIEQLLMNDDDVGLVSFEDADPQFAADFLSDVLVDSPLHSDHSHSPAEQAIGFTDSKVSSGSDADQDKHKSPSDGDDELNNHDPVDKKRKRQLRNRDAAVRSRERKKLYVRDLELKSRYFESECKRLGFVLQCCLAENQALRFSLQNSSANGVSMTKQESAVLLLESLLLGSLLWFLGITCLLILPSQTWSVPEENQGSRNHGLLLPIKEGKKISWILLFLSFMMGKRCKASRSRMKFNPHSLGVVM

SEQ ID NO: 3067 - protein, 370 aa, Zea mays
MRHASPPQELPAAGREIQAALAPANGNAAGARGGGGSFTALLGLPTPQAMELLLPRTTPPALALAPAAAPAPTPTFPSDPHLVDRAGRFSTFAPPSPPSPSPTQQPPPPPPAAVAGKRKADPVDRASKGKAAKKGKTAEEKPAAAGGEDEKPAYVHVRARRGQATDSHSLAERARREKINARMELLKELVPGCSKVSGTALVLDEIINHVQSLQRQVEYLSMRLATVNPRGDFGGLDSFLTTECGRIASFNCKNGIDLEQVTWPEMGVHGARQLMQLQQQFWHGDLAHPHQVASQWEKRGDGHPPVFSNSSPSLFGYDLTSSGKPCTQSYITFLNEFSCLSLTSHITAWLAPQLLSLSLSRQCSLENKVY

SEQ ID NO: 3068 - protein, 355 aa, Panicum virgatum
MKGFSFFTTSALAILALLPEVAIGAGLKVGFYNKSCPSAEALVQQAVAAAFKNNSGIAAGLIRLHFHDCFVRGCDGSVLIDTTANNTAEKDAAPNNPSLRGFEVIDAAKKAIEARCPRTVSCADIVAFAARDSVALAGNNLTYKVPAGRRDGRVSNATDALNNLPSPLSNAAELVGNFSRKGLTAEDMVVLSGAHTVGRSHCSSFTNRLYGFSNASDVDPAISSAYAFLLRSICPSNSTQFVPNTTTDMDLITPAVLDNKYYLGLANNLGLFTSDQALLTNATLKKSVDEFVKSESRWKSKFAKAMVKMGSIEVLTGTQGEIRLNCRVVNSGSSAGGIELQMTTSSSRRRRRRLC

SEQ ID NO: 3069 - protein, 361 aa, Zea mays
MPAFAGGAAEPPLADSYYALLRRGNDDEGAYTTSTAPWDDVSLPVAECELPMIDVGCLTTADDGSSPEAEAERAACAAAIARAAEEWGFFQVRNHGVPQELLEEMRREQARLFRLPFETKATAGLLNDSYRWGTPTATSPRQLSWSEAFHVPLAGVSGSGTTCDFGDLTTLRDVTREVAGAMSKLAGTLARVLAEALLGRRPAGERFPEGCDETTCFLRLNRYPACPISPGALGLVPHTDSDFLTVLCQDQQVGGLQLMKGDSWVAVKPIPGTLVVNIGDLFQAWSNNRYKSVEHKVMTNARTERYSVAYFLCPSYDSPIGTCEEPSLYRTFTFGEYRRKVQEDVKRTGKKVGLPNFLAQT

SEQ ID NO: 3070 - protein, 892 aa, Zea mays
MKSLFKSKIRWQHRSNDPASPAAPPPQTSGPPPASSPSGTAPAPALSVSTPVSPSPSSAAATPTGAAAAAAAAGAGGEDYISSEEEFQMQLAMALSASSNSDCAGGLDGEQIRKAKLMSLDRFAAHRDETHTAEFLSRRYWDYNFLDYHEKVIDGFYDIFGSSIESSRQGKMPSLADLQTGIGDLGFEVIVVNRAIDSTLQEMEQVAQCILLDFPVANIALLVQRIAELVTDNMGGPVKDANDMLTRWLEKSTELRTSLQTSLLPIGCIKIGLSRHRALLFKILADSVGIPCKLVKGSNYTGGDDDDAINIIKMDNEREFLVDLMAAPGALIPADILSWKGNSLNSNRKLGLNRTAGSSSTVDANVDPTVLPLEPKGGQLPLFSSGDWMSDIDSGYEAAEIAASTQTSSGVTPSVSAGSVFGSSWMLVNHDQSDGPSTSAGTSSQQKVVPQSEHQRNLNRLPDLQEIPESKYLFADLVPSGDNKSKKTSVPFKGPDHRNNELQKRRENIVPNAGRPQQRLVMKNWSPYNDVSNNKQYNYVEDSFARRNVGNNAASSSSQMPRPAVRSNLNSGLHNDASYHNYDSIMAGTSAMKITSTAETGKVPERVLRGDLDKGQTNYRLEDQHVIVQPPQGRLPWGNPAEGRVPMNRVQSQAKQHLENMDAKQDHKKLLPDPKKSPLDRFMDTSLPSRNMDMRSQRLDFDDVSECEIPWEDLVIGERIGLGSYGEVYRADWNGTEVAVKKFLDQDFYGDALDEFRSEVRIMRRLRHPNIVLFMGAVTRPPNLSIVSEYLPRGSLYKILHRPNCLIDEKRRIKMALDVAKGMNCLHTSMPTIVHRDLKSPNLLVDNNWNVKVCDFGLSRLKHSTFLSSKSTAGTPEWMAPEVLRNEQSNEK

SEQ ID NO: 3071 - protein, 318 aa, Triticum aestivum
MAGKEDSRIFVGGLSFHTDERKLEDAFRRFGKVVDTQIMLERHTNRHRGFGFVTFSDPRAVETAINDMHNKELDGRTISVNRAEPKMQTDDTRYSSGGGGGDRGDYRGGKGDGPPPGNCFECGRAGHWARDCPNPGGGRSGRFPSKFSGGGGRGDRFSGSDRFGDRYVDDRYDGGRYGGYREPIDSRDRYDGGRDRYASDRYPSGGDRFGADRYGAAPDRYAPSGGGGGYGRERERSYERDGIRGGGAYDRSGPRGGASYDRDGPRGGIGGGYDRDGPRGGGADYGSGGPARYEGGGYRERPAPYDRPRGGGRFDDRY

SEQ ID NO: 3072 - protein, 319 aa, Triticum aestivum
MAGKEDSRIFVGGLSFHTDERKLEDAFRRFGKVVDTQIMLERHTNRHRGFGFVTFSDPRAVETAINDMHNKELDGRTISVNRAEPKLQTDDTRYSSGGGGGDRGDYRGGKGDGPPPGNCFECGRAGHWARDCPNPGGGRSGRFPSKFSGGGGRGDRFSGSDRFGDRYVDDRYDGGRYGGYREPIDSRDRYDGGRDRYASDRYPSGGDRFGADRYGAAPDRYAPSGGGGGYGRERERSYERDGLRGGGGAYDRSGPRGGASYDRDGPRGGIGGGYDRDGPRGGGADYGSGGPARYEGGGYRERPAPYDRPRGGGRFDDRY

SEQ ID NO: 3073 - protein, 317 aa, Triticum aestivum
MAGKEDSRIFVGGLSFHTDERKLEDAFRRFGKVVDTQIMLERHTNRHRGFGFVTFSDPRAVETAINDMHNKELDGRTISVNRAEPKMQTDDTRYSSGGGGDRGDYRGGKGDGPPPGNCFECGRAGHWARDCPNPGGGRSGRFPSKFSGGGGRGDRFSGSDRFGDRYVDDRYDGGRYGGYREPIDSRDRYDGGRDRYASDRYPSGGDRFGADRYGAAPDRYAPSGGGGGYGRERERSYERDGIRGGGAYDRSGPRGGASYDRDGPRGGIGGGYDRDGPRGGGADYGSGGPSRYEGGGYRERPAPYDRPRGGGRFDDRY

SEQ ID NO: 3074 - protein, 314 aa, Brachypodium distachyon
MAGKEESRIFVGGLSFHTDERKLEEAFRRFGKVVDAQIMLERHTNRHRGFGFVTFSDPRAVESAISEMHTKELDGRTISVNRAEPKMNTDDTRYSSGGDRGADRGDYRGGKGDGPPPGNCYQCGRAGHWARDCPNPAGGRSGQLSSKFSGGGGRGDRFSGSDRFSDRYMDDRYDGGRYGYRDPIDNRDRYDGGRDRYASDRYPSGGDRFGADRYGGPDRYQPSGYGRERERSYERDAVRGGAAFDRSGPRGGASYDRDGPRGGIGGGYDRDGPRGGGADNYVSGGPARYDGGSYRDRPGPYDRPSRGGRYEDRF

SEQ ID NO: 3075 - protein, 356 aa, Hordeum vulgare
MASYDQQFKILEVPPIVQELVGAGVKEPPSQYVLPEQYRPAAAAVSEMPEPIPIIDLSRLSAGSAEEFDKLRSALENWNLFLAVGHGMEPSFLAEAMKATREFFNLSIEEKQKYSNIVGGEKMGMDGYGNDMVVKENQVLDWNDRLNLLVEPESLRTYRLWPTQPPSFRDVLCEYTVRCKAATNIVLRNMAKMLNLQEEHLVNMIGDNSITQAIFNYYPQCPRPDHVLGLKAHTDGSIITVNFADAEGLQLERNGVWYNVPIVPNALVMNIGDIMEILSNGFFKSLVHRVVTNAEKERLSLVLVYTLELETQLEPVSELVDDKRPARYMKIKLNDYMEKYHDTYATGTLAIDGVKI

SEQ ID NO: 3076 - protein, 355 aa, Triticum aestivum
MASYDKQFKVLEVPPIVQELVGAGVQEPPSQYVLPEQDRPAAAVSEMPEPIPIIDLSRLSAGSAEEFDKLRSALENWDLFLAVGHGMEPSFLAEAMKATREFFNLPLEEKQKYSNIVDGEKLGMDGYGNDMVVKENQVLDWNDRLNLLVEPEALRTYRLWPTQPPSFRDILSEYTVRCKAAANLVFRNMAKILNLQEEHLVNMIGENSITQAIFNYYPQCPRPDHVLGLKAHTDGSIITVNFADAEGLQLQRNGVWYNVPIVPNALIMNVGDIMEILSNGFFKSLVHRVVTNAEKERLSLVLVYTLELETELEPVSDLVDDKRPARYMKIKLHDYMEKYHDTYATGTLAIDGVKI

SEQ ID NO: 3077 - protein, 622 aa, Triticum aestivum
DEATNRATQTQITLPFQPLALSFNHVNYYVDMPAEMREQGFAESRLQLLSDISGAFRPGVLTALVGVSGAGKTTLMDVLAGRKTSGSIEGSITLSGYPKKQETFARISGYCEQTDIHSPNVTVYESILYSAWLRLSSDVDEKTRKLFVEEVMTLVELDVLRNAMVGLPGVDGLSTEQRKRLTIAVELVANPSIIFMDEPTSGLDARAAAIVMRAVRNTVNTGRTVVCTIHQPSIDIFESFDELLLMKRGGQVIYAGELGRHSYKLVEYFEAIPGVEKITQGYNPATWMLEVSSPLAEARLNVNFAEIYANSELYRENQQLIKELSVPPPGYEDLSFPTKYSQNFYNQCIANFWKQYKSYWKNPPHNAMRFLMTMINGLVFGTVFWQKGTKIGSQQDLFNLLGATYAAVFFLGAANCITVQPVVSIERTVFYREKAAGMYSPLSYAFAQTCVEVMYNIVQGIEYTAIIYAMIGYEWKAAKFFYFLFFIVSSFNYFTLFGMMLVSLTPSSMLANILISFVLPLWNLFAGFLVVRPLIPIWWRWYYWANPVSWTIYGVVASQFGDNKSPLKVPGGSDTFVKEFLEDNLGIKHDFLGYVVLAHFVFIIAFFFVFGYSIKVLNFQKR

SEQ ID NO: 3078 - protein, 1435 aa, Triticum aestivum
MELASGRGSRRSASAASWGSRRSFSIHSQAADPFGRAASQQGHHDDEENLRWAALEKLPTYDRMRRAVVHGGAAVDGHENTEMEGLVDINRLASGEAGRALLERVFQDDSERFLRRLRDRVDRVGIDLPAIEVRYQGLSVQVDAFVGSRALPTLWNSATNFLQGLVGRLASSNKKTIHILQNVNGIIKPSRMTLLLGPPSSGKSTLMRALTGKLDKSLKVSGNITYCGHTFEEFYPERTSVYVSQYDLHNAEMTVRETLDFSRRCLGVGARYDMLSELAAREREAGIKPDPEIDAYMKATAVQGQESNIVTDLTLKVLGLDICADMPIGDDMIRGISGGQKKRVTTGEMLTGPARALFMDEISTGLDSSSTFQIVKYIGQLVHVMNETVMISLLQPPPETYNLFDDIILLSEGYIVYHGPRDNILEFFEAAGFRCPERKGVADFLQEVTSKKDQQQYWYLDQEQYRHVSVPEFAERFKSFHVGQQMLKELQIPFDKSQTHPAALTTSKYGQSSWESFKTVMSRELLLMKRNSFIYIFKVTQLLILGLVAMTVFFRTKMPYGQISDSAKFFGALTFSLITVLFNGFAELQFTIKMLPTFYKQRDFLFFPPWTFGLVNIISKVPVSLVESSVWVILTYYVMGFAPAAGRFFRQLLAFFLTHQMAMGLFRFLGAVLKSMVVANTLGMFVILIIFIFGGFVIPRGDIQPWWIWAYWSSPMMYSQNAISVNEFLSSRWANPNNDTSIAARTVGEAILKSRGLFTGDSGFWVSIGAIVGFAILFNILYLLALTYLSFGSSSNTVSDEENENETNTSMPIDEATNRPTRSQITLPFQPLSLSFNHVNYYVDMPAEMREQGFAESRLQLLSDISGAFRPGVLTALVGVSGAGKTTLMDVLAGRKTSGSIEGSITLSGYPKKQETFARISGYCEQTDIHSPNVTVYESILYSAWLRLSSDVDEKTRKIFVEEVMTLVELDVLRNAMVGLPGVDGLSTEQRKRLTIAVELVANPSIIFMDEPTSGLDARAAAIVMRAVRNTVNTGRTVVCTIHQPSIDIFESFDELLLMKRGGRVIYAGELGRHSHKIVEYFEAIPGVEKITEGYNPATWMLEVSSPSAEARLNINFADIYANSDLYRKNQELIKELSVPPPGYEDLSFPTKYSQNFYNQCVANFWKQYKSYWKNPAHNAMRFLMTLIYALVFGTVFWQKGTKINSQQDLANLLGATYAAVFFLGSANCITVQPVVAIERTVFYREKAAGMYSPLAYAFTQTCVEVMYNIVQGIEYTLIIYSMIGYEWKAAKFFYFLFFIISCFNYFTLFGMMLVALSSSAMLANIIIAFVLPLWNLFSGFLVMRPLIPIWWRWYYWANPVSWTIYGVIGSQFGDNTSPVSVTGGSLVVVKQFLEDGMGIKHDFLGYVVLAHFAYVIGFFLVFAYSIKVLNFQKR

SEQ ID NO: 3079 - protein, 1412 aa, Brachypodium distachyon
METAAVVSASASRRRSTSWGSSMTHSFRQQADTEDPFGRAQSQQGHDDDEENLRWAALEKLPTYDRMRRAIIHQDDDDAGGNQLLDIEKVAGGEAGRALLERVFQDDSERFLRRLRDRVDRVGIDLPAIEVRYADLTVDADVFVGSRALPTLWNSTTNFLQGLIGRFGTSNKRTINILQHVHGILKPSRMTLLLGPPSSGKSTLMRALTGKLDKSLKVSGNITYCGHTFSEFYPERTSAYVSQYDLHNAEMTVRETLDFSRRCLGIGARYDMLAELAKRERDAGIKPDPEIDAFMKATAVQGQETNIITDLTLKVLGLDICADIIIGDEMIRGVSGGQKKRVTTGEMLTGPARALFMDEISTGLDSSSTFQIVKYVRQLVHVMNETVMISLLQPPPETYNLFDDIILLSEGYIVYHGPRENILEFFESAGFRCPERKGVADFLQEVSSKKDQRQYWYLEQEQYRYVSVLEFAERFKSFHVGQQMLKELQIPFEKSKTHPAALTTSKYGQSSWESLKAVMLREQLLMKRNSFIYIFKVTQLIILALMAMTVFLRTEMPVGKISDGTKFFGALAFSLITILFNGFAELQLTIKKLPVFFKHRDFLFFPPWTFGLANIILKVPVSLVESAVWVVLTYYVMGFAPAAGRFFRQLLAFFATHQMAMALFRFLGAILKTMVVANTFGMFVLLIIFIFGGFIIPRGDIRPWWIWGYWASPMMYSQNAISVNEFLASRWAIPNNDTTIDAPTVGKAILKSKGLFTEEWGFWVSTGAIVGFTILFNILYLLALTYLSYTNGAANRPTQSGIVLPFQPLSLSFNHINYYVDMPAEMKEQGFSESRLQLLSDISGAFRPGVLTALVGVSGAGKTTLMDVLAGRKTTGAIEGSIELSGYPKQQETFARISGYCEQTDIHSPNVTVYESILYSAWLRLSSDVDDSTRKMFVEEVMALVELDVLRNALVGLPGVDGLSTEQRKRLTIAVELVANPSIIFMDEPTSGLDARAAAIVMRTVRNTVNTGRTVVCTIHQPSIDIFESFDELLLLKRGGHVIYAGELGRHSHKLVEYFEAIPGVPKITEGYNPATWMLEVSSPLAEARLDINFAEIYANSVLYTKNQELIKELSVPPPGYQDLSFPTKYSQNFYNQCVANFWKQYKSYWKNPPYNAMRYLMTLLNGIVFGTVFWQKGKNLDSQQDLFNLLGATYAAIFFLGAANCITVQPVVAIERTVFYREKAAGMYSPLSYALAQTGVEVIYNILQGILYTLLIYVMIGYEWRADKFFYFLFFIVASFNYFTLFGMMLVSLTPSALIANILISFALPLWNLFAGFLVVRTAIPIWWRWYYWANPVSWTIYGVVASQFGENGGSLTVPGGNPVVVKQFLEDNLGIRHDFLGYVVLAHFAYIIAFFFVFGYSIKFFNFQKR

SEQ ID NO: 3080 - protein, 1469 aa, Zea mays
MMPESHPHPHAGAVLASTSSRRSLSLGSSISQSFRQMDTEDPFARSQSEHEHRDDEENLRWAALEKLPTYDRMRQGILRRALDQQQESGGGGVEIVDIHKLAAGDGGRALLERLFQDDSERFLRRLRDRIDMVGIELPTVEVRYEQLTVEADVITAGRALPTLWNAATNFLQGLIGRFGSSNKRNITILKNVNGILKPSRMTLLLGPPSSGKSTLMRALAGKLDKNLKVSGSITYCGHPISEFYPERTSAYVGQYDLHNAEMTVRETLDFSRRCLGIGARYEMITELARRERDAGIKPDPEIDAFMKATAVQGQETNIITDLTLKVLGLDICADVIIGDEMIRGISGGQKKRVTTGEMLTGPATALFMDEISTGLDSSSTFQIVKFMRHLVHVMNETVMISLLQPPPETYNLFDDIILLSEGYIVYHGPRENILEFFESVGFRCPDRKGVADFLQEVTSKKDQQQYWYLDQEQYHYVSVPDFAERFKSFHACQQMQKELQIPFEKSKTHPAALTTKKYGLSSWESLKAVMSREQLLMKRNSFIYIFKVTVLIILAFVSMTVFLRTKMPHGQIADGTKFFGALTFGLITIMFNGFAELQLTIKKLPVFYKHRDFLFFPAWTFGVANILLKVPISLVESVVWVVLTYYVMGFAPAAGRFFRQFIAFFATHQMAMALFRFLGAVLKTMVVANTFGMFVLLIIFIFGGFVIRRNDIKPWWIWGYWASPMMYSQNAISINEFLASRWAIPNNDTTIDAPTVGKAILKSKGLFTEEWGFWLSIGALIGFIILFNSLYLWALTYLSPSSGSNALVSEGEDDVNEIALKERSRDARSEDEISQVVYGDLGANTCTNGATNTLVQSRVTLPFQPLSLCFNHVNYYVDMPAEMKEQGFTESRLQLLSDISGAFRPGVLTALVGVSGAGKTTLMDVLAGRKTSGAIEGDITLSGYPKKQETFARISGYCEQTDIHSPNVTVFESITYSAWLRLSSDIDDGTKKMFVEEVMALVELDVLCDALVGLPGVSGLSTEQRKRLTIAVELVANPSIIFMDEPTSGLDARAAAIVMRTVRNTVNTGRTVVCTIHQPSIDIFESFDELLLLKRGGQVIYAGELGRHSHKLVEYFEAIPGVQKITEGYNPATWALEVSSPLSEARLNMNFAEIYANSVLYRKNQELIKELSVPSPDYQDLSFPTKYSQNFYNQCAANFWKQYRSYWKNPPYNAMRYLMTFLFGLVFGTVFWQKGKNIDSQQDLYNLLGATYAATFFLGASNSITVQPVVSIERAVFYREKAAGMYSPLSYAFAQTCVEVIYTILQGILYTVIIYATIGYDWKADKFLYFLFFMTACFNYFGLFGMMLVACTPSALLANILITFALPLWNLFAGFLIVRPAIPIWWRWYYWANPVSWTIYGVVASQFGENQGELSVPGGKPVVVKQFLKDNLGIQHDLLGYVVLVHFAYIIAFFFVFGYSIKFFNFQKR

SEQ ID NO: 3081 - protein, 646 aa, Triticum aestivum
  misc_feature (14)..(14): Xaa can be any naturally occurring amino acid
  misc_feature (24)..(25): Xaa can be any naturally occurring amino acid
  misc_feature (31)..(31): Xaa can be any naturally occurring amino acid
  misc_feature (118)..(118): Xaa can be any naturally occurring amino acid
  misc_feature (131)..(131): Xaa can be any naturally occurring amino acid
  misc_feature (166)..(166): Xaa can be any naturally occurring amino acid
SGSNTVSDKENENXTNTSTPMGTXXEATNRXTQTQITLPFQPLALSFNHVNYYVDMPAEMREQGFAESRLQLLSDISGAFRPGVLTALVGVSGAGKTTLMDVLAGRKTSGSIEGSITXSGYPKKQETFARXSGYCEQTDIHSPNVTVYESILYSAWLRLSSDVDEXTRKMFVEEVMTLVELDVLRNAMVGLPGVDGLSTEQRKRLTIAVELVANPSIIFMDEPTSGLDARAAAIVMRAVRNTVNTGRTVVCTIHQPSIDIFESFDELLLMKRGGRVIYAGELGQHSHKLVEYFEAIPGVEKITEGYNPATWMLEVSSPLAEARLNVNFAEIYANSDLYRKNQELIKELSVPPPGYEDLSFPTKYSQNFYNQCVANFWKQYKSYWKNPPHNAMRFLMTLIYGLVFGTVFWQKGTKIDSPQDLSNLLGATYAAVFFLGSANCITVQPVVSIERTVFYREKAAGMYSPLSYALAQTCVEMIYNVVQGIQYTVIIYAMIGYEWKAAKFFYFLFFTISCFNYFTLFGMMLVALTSSSMLANIPIAFVLPLWNLFAGFLVARPLLPIWWRWYYWANPVSWTIYGVIGSQFGDNTSPLSVPDGSRPVVKQFLEDNLGIKHDFLGYVVLAHFAYVIAFFLVFGYSIKVLNFQKR

SEQ ID NO: 3082 - protein, 1470 aa, Zea mays
MPMPESHPHAVAAAAAGLALASTSSRRSLSLGSSISQSFRQMDTEDPFGRAQSDHDDEENLRWAALEKLPTYDRMRQGILRRALDNDQQQQQRQSVEVVDIHKLAAGGDGGRALLDRLFQEDSERFLRRLRDRIDMVGIDLPTVEVRYHQLTVEADVITAGRALPTLWNAATNFLQGLIGRFGSSNKKNITILKNVNGILKPSRMTLLLGPPSSGKSTLMRALAGKLDKNLKVSGSITYCGHPISEFYPERTSAYVGQYDLHNAEMTVRETLDFSRRCLGIGARYEMIAELARRERDAGIKPDPEIDAFMKATAVQGQETNIITDLTLKVLGLDICADVIIGDEMIRGISGGQKKRVTTGEMLTGPARALFMDEISTGLDSSSTFEIVKFMRQLVHVMSETVMISLLQPPPETYNLFDDIILLSEGYIVYHGPRENILEFFESAGFRCPDRKGVADFLQEVTSKKDQQQYWYLDQEQYHYVSVPDFAERFKSFHACQQMQKELQIPFEKSKTHPAALTTRKYGLSSWESLKAVMSREQLLMKRNSFIYIFKVTQLIILALMSMTVFLRIKMPHGQIADGTKFFGALTFGLITIMFNGFAELQLTIKKLPVFYKHRDFLFFPAWTLGVANIILKVPVSFVESAVWVVLTYYVMGFAPAAGRFFRQFIAFFATHQMAMALFRFLGAVLKTMVVANTFGMFVLLIIFIFGGFVIRRNDIRPWWIWGYWASPMMYSQNAISVNEFLASRWAIPNNDTTIDAPTVGKAILKSKGLFTGEWGFWLSIGALIGFIILFNMLYLWALTYLSPSSGSNALVSEGEDDVNEMALEGRRKDARRSKDEISQVVSSDPGTNGGTNTLAQSRVTLPFQPLALCFNHVNYYVDMPAEMKEQGFTESRLQLLSDISGTFRPGVLTALVGVSGAGKTTLMDVLAGRKTSGAIEGDITLSGYPKKQETFARISGYCEQTDIHSPNVTVFESITYSAWLRLSSDIDDGTKKMFVEEVMALVELDVLRDALVGLPGVSGLSTEQRKRLTIAVELVANPSIIFMDEPTSGLDARAAAIVMRTVRNTVNTGRTVVCTIHQPSIDIFESFDELLLLKRGGQVIYAGELGRHSHKLVEYFEAIPGVPKITEGYNPATWVLEVSSPLSEARLNMNFAEIYASSVLYRKNQEVIKELSIPRSDNQDLSFPTKYSQNFYGQCAANFWKQYRSYWKNPPYNAMRYLMTCLFGLVFGTVFWQKGKNIDSQQDLYNLLGATYAATFFLGASNCITVQPVVSIERAVFYREKAAGMYSPLSYAFAQTCVEVIYTILQGILYTVIIYAMIGYDWKADKFFYFLFFITASFNYFTLFGMMLVACTPSALLANILITFALPLWNLFAGFLIVRPAIPIWWRWYYWANPVSWTIYGVVASQFGENEGELSVPGGTPVVVKQFLKDNLGIQHDLLGYVVLVHFAYVIVFFFVFGYSIKFFNFQKR

SEQ ID NO: 3083 - protein, 545 aa, Triticum aestivum
MSWQEGKLVDLLKEVSPSLVTLKKQETFARVSGYCEQTDIHSPNVTVYESILYSAWLRLSSDVDENTRKMFVEEVMTLVELDVLRNAMVGLPGVDGLSTEQRKRLTIAVELVANPSIIFMDEPTSGLDARAAAIVMRAVRNTVNTGRTVVCTIHQPSIDIFESFDELLLMKRGGRVIYAGELGQHSHKLVEYFEAIPGVEKITEGYNPATWMLEVSSPLAEARLNVNFAEIYANSDLYRKNQELIKELSVPPPGYEDLSFPTKYSQNFYNQCVANFWKQYKSYWKNPPHNAMRFLMTLIYGLVFGTVFWQKGTKIDSPQDLSNLLGATYAAVFFLGSANCITVQPVVSIERTVFYREKAAGMYSPLSYALAQTCVEMIYNIVQGIQYTVTIYAMIGYEWKAAKFFYFLFFTFMLQLLHIGWHDAGGVDLILHARKLPIAFILPLWNLFAGFLVARPLLPIWWRWYYWANPVSWTIYGVIGSQFGDNTSRLSVPGGSPTVVKQFLEDNMGIKHDFLGYVVLAHFAYVIGFFLMFGYSIKVLNFQKR

SEQ ID NO: 3084 - protein, 1334 aa, Sorghum bicolor
MEKLPTYDRMRQGILRQALAAGDQQQSGGVEVVDIQKLAGGDGGRELLERLFQDDSERFLRRLRDRIDMVGIELPTIEVRYEQLNVEADVIAAGRALPTLWNAATNLFEGLIGRFGSSNKRNITILKNVNGILKPSRMTLLLGPPSSGKSTLMRALAGKLDKNLKVSGSITYCGHPISEFYPERTSAYVGQYDLHNAEMTVRETLDFSRRCLGIGARYEMIAELARRERDAGIKPDPEIDAFMKATAVQGQETNIITDLTLKVLGLDICADVIIGDEMIRGISGGQKKRVTTGEMLTGPARALFMDEISTGLDSSSTFQIVKFMRQLVHVMNETVMISLLQPPPETYNLFDDIILLSEGYIVYHGPRENILEFFESAGFRCPDRKGVADFLQEVTSKKDQQQYWYLDQEQYHYVSVPDFAQRFKSFHACQQMQKELQIPFEKSKTHPAALTTRKYGLSSWESLKAVMSREQLLMKRNSFIYIFKVTQLIILALMSMTVFLRTKMPHGQIADGTKFFGALTFGLITIMFNGFAELQLTIKKLPVFYKHRDFLFFPAWTLGVANIILKVPVSLVESAVWVALTYYVMGFAPAAGRFFRQFIAFFATHQMAMALFRFLGAILKTMVVANTFGMFVLLIIFIFGGFVIRRNDIKPWWIWGYWASPMMYSQNAISINEFLASRWAIPNNDTTIDAPTVGKAILKSKGLFTGEWGFWLSIGALIGFIILFNMLYIWALTYLSRTNGATNTLAESRVTLPFQPLSLCFNHVNYYVDMPAEMKEQGFTESRLQLLSDISGAFRPGVLTALVGVSGAGKTTLMDVLAGRKTSGAIEGDITLSGFPKKQETFARISGYCEQTDIHSPNVTVFESITYSAWLRLSSDIDDGTKKMFVEEVMALVELDVLRDALVGLPGVSGLSTEQRKRLTIAVELVANPSIIFMDEPTSGLDARAAAIVMRTLLLLKRGGQVIYAGELGRHSHKLVEYFEAIPGVPKITEGYNPATWVLEVSSPLSEARLNMNFAEIYANSVLYRKNQELIKELSIPPPDYQDLSFPTKYSQNFYGQCISNFWKQYRSYWKNPPYNAMRYLMTFLFGLVFGTVFWQKGKNIDSQQDLYNLLGATYAATFFLGASNCITVQPVVSIERAVFYREKAAGMYSPLSYAFAQTCVEVIYNVLQGILYTVIIYAMIGYDWKADKFFYFLFFITASFNYFTLFGMMLVACTPSALLANIFITFALPLWNLFAGFLIVRPAIPIWWRWYYWANPVSWTIYGVVASQFGENEGELSVPGGSGKPVVVKQFLKDNLGIQHDFLGYVVLVHFAYIIAFFFVFGYSIKFFNFQKR

SEQ ID NO: 3085 - protein, 1383 aa, Zea mays
AVLASTSSRRSLSLGSSISQSFRQMDTEDPFARSQSEHEHRDDEENLRWAALEKLPTYDRMRQGILRRALDQQQESGGGGVEIVDIHKLAAGDGGRALLERLFQDDSERFLRRLRDRIDMVGIELPTVEVRYEQLTVEADVITAGRALPTLWNAATNFLQGLIGRFGSSNKRNITILKNVNGILKPSRMTLLLGPPSSGKSTLMRALAGKLDKNLKVSGSITYCGHPISEFYPERTSAYVGQYDLHNAEMTVRETLDFSRRCLGIGARYEMITELARRERDAGIKPDPEIDAFMKATAVQGQETNIITDLTLKVLGLDICADVIIGDEMIRGISGGQKKRVTTGEMLTGPATALFMDEISTGLDSSSTFQIVKFMRHLVHVMNETVMISLLQPPPETYNLFDDIILLSEGYIVYHGPRENILEFFESVGFRCPDRKGVADFLQEVTSKKDQQQYWYLDQEQYHYVSVPDFAERFKSFHACQQMQKELQIPFEKSKTHPAALTTKKYGLSSWESLKAVMSREQLLMKRNSFIYIFKVTVLIILAFVSMTVFLRTKMPHGQIADGTKFFGALTFGLITIMFNGFAELQLTIKKLPVFYKHRDFLFFPAWTFGVANILLKVPISLVESVVWVVLTYYVMGFAPAAGRFFRQFIAFFATHQMAMALFRFLGAVLKTMVVANTFGMFVLLIIFIFGGFVIRRNDIKPWWIWGYWASPMMYSQNAISINEFLASRWAIPNNDTTIDAPTVGKAILKSKGLFTEEWGFWLSIGALIGFIILFNSLYLWALTYLSRTNGATNTLVQSRVTLPFQPLSLCFNHVNYYVDMPAEMKEQGFTESRLQLLSDISGAFRPGVLTALVGVSGAGKTTLMDVLAGRKTSGAIEGDITLSGYPKKQETFARISGYCEQTDIHSPNVTVFESITYSAWLRLSSDIDDGTKKMFVEEVMALVELDVLCDALVGLPGVSGLSTEQRKRLTIAVELVANPSIIFMDEPTSGLDARAAAIVMRTLLLLKRGGQVIYAGELGRHSHKLVEYFEAIPGVQKITEGYNPATWALEVSSPLSEARLNMNFAEIYANSVLYRKNQELIKELSVPSPDYQDLSFPTKYSQNFYNQCAANFWKQYRSYWKNPPYNAMRYLMTFLFGLVFGTVFWQKGKNIDSQQDLYNLLGATYAATFFLGASNSITVQPVVSIERAVFYREKAAGMYSPLSYAFAQTCVEVIYTILQGILYTVIIYATIGYDWKADKFLYFLFFMTACFNYFGLFGMMLVACTPSALLANILITFALPLWNLFAGFLIVRPAIPIWWRWYYWANPVSWTIYGVVASQFGENQGELSVPGGKPVVVKQFLKDNLGIQHDLLGYVVLVHFAYIIAFFFVFGYSIKFFNFQKR

SEQ ID NO: 3086 - protein, 1397 aa, Zea mays
NLRWAALQKLPTYDRMRQGILRRALDDQEQQSGDGDVEVVDIHKLAAGDGGRALLERLFQEDSDPFLRRLRDRIDMVGIELPTVEVRYEQLTVQADVVAAGRALPTLWNAATNFLQGLIGRFGSSNKRNITILKNVNGILKPSRMTLLLGPPSSGKSTLMRALAGKLDKNLKVSGNITYCGHPISEFYPERTSAYVGQYDLHNAEMTVRETLDFSRRCLGVGARYEMIAELARRERDAGIKPDPEIDAFMKATAVQGQETNIITDFTLKVLGLDICADVIIGDEMIRGISGGQKKRVTTGEMLTGTARALFMDEISTGLDSSSTFQIVKFMRQLVHVMNETVMISLLQPPPETYNLFDDIILLSEGYIVYHGPRENILEFFESAGFRCPDRKGVADFLQEVTSKKDQQQYWYLDQEQYRYVSVPDFAERFKSFHACQQMHKELQIPFDKSKTHPAALTTTKYGLSSWESFKVVMSREQLLMKRNSFVYIFKVTQLIILALMSMTVFLRIKMPHGQIADGNKFFGALTFGLITIMFNGFAELQMTIKKLPVFYKHRDFLFFPAWTLGVANILLKVPISFVESLVWVVLTYYVMGFAPAAGRFFRQFIAFFATHQMAMALFRFLGAVLKTMVVANTFGMFVLLIIFIFGGFVIRRNDIKPWWIWGYWASPMMYSQNALSVNEFLASRWASPNNDTIIDAPTVGKAILISKGLFTGEWGFWLSIGALVGFIILFNMLYLWALTYLSRTNGATNTVAQSSRVTLPFQPLALCFNHVNYYVDMPAEMKEQGFTESRLQLLSDISGTFRPGVLTALVGFSGAGKTTLMDVLAGRKTSGAIEGDITLSGYPKKQETFARISGYCEQTDIHSPNVTVFESITYSAWLRLSSDIDDDTKKMFVEEVMTLVELDVLRDALVGLPGVNGLSTEQRKRLTIAVELVANPSIIFMDEPTSGLDARAAAIVMRTVRNTVNTGRTVVCTIHQPSIDIFESFDEVSYPPSSLTTADYYFFSNILTTVGLLIFQLLLLKRGGQVIYAGELGRHSHKLVEYFESISGVPKITEGYNPATWVLEVSSPLSEARLNMNFAEIYANSVLYRKNQELIKELSIPPPDYQDLSFPTKYSQNFYGQCVANFWKQCRSYWKNPPYNAMRYLMTSLFGLVFGTVFWQKGKNIDSQQDLYNLLGATYAAIFFLGASNCITVQPVVSIERAVFYREKAAGMYSPLSYAFAQTCVEVIYTTLQGILYTVIIYGMIGYDWKSDKFFYFLFFITASFNYFTLFGMMLVACTPSALLANILITFALPFWNLFAGFLIVRPAIPIWWRWYYWANPVSWTIYGVVASQFGENQGELSVPGGKPMLVNQFLKDNLGIQHDLLGYVVLVHFAYVIVFFFVFGYSIKFFNFQKR

SEQ ID NO: 3087 - protein, 1382 aa, Zea mays
LALASTSSRRSLSLGSSISQSFRQMDTEDPFGRAQSDHDDEENLRWAALEKLPTYDRMRQGILRRALDNDQQQQQRQSVEVVDIHKLAAGGDGGRALLDRLFQEDSERFLRRLRDRIDMVGIDLPTVEVRYHQLTVEADVITAGRALPTLWNAATNFLQGLIGRFGSSNKKNITILKNVNGILKPSRMTLLLGPPSSGKSTLMRALAGKLDKNLKVSGSITYCGHPISEFYPERTSAYVGQYDLHNAEMTVRETLDFSRRCLGIGARYEMIAELARRERDAGIKPDPEIDAFMKATAVQGQETNIITDLTLKVLGLDICADVIIGDEMIRGISGGQKKRVTTGEMLTGPARALFMDEISTGLDSSSTFEIVKFMRQLVHVMSETVMISLLQPPPETYNLFDDIILLSEGYIVYHGPRENILEFFESAGFRCPDRKGVADFLQEVTSKKDQQQYWYLDQEQYHYVSVPDFAERFKSFHACQQMQKELQIPFEKSKTHPAALTTRKYGLSSWESLKAVMSREQLLMKRNSFIYIFKVTQLIILALMSMTVFLRIKMPHGQIADGTKFFGALTFGLITIMFNGFAELQLTIKKLPVFYKHRDFLFFPAWTLGVANIILKVPVSFVESAVWVVLTYYVMGFAPAAGRFFRQFIAFFATHQMAMALFRFLGAVLKTMVVANTFGMFVLLIIFIFGGFVIRRNDIRPWWIWGYWASPMMYSQNAISVNEFLASRWAIPNNDTTIDAPTVGKAILKSKGLFTGEWGFWLSIGALIGFIILFNMLYLWALTYLSRTNGGTNTLAQSRVTLPFQPLALCFNHVNYYVDMPAEMKEQGFTESRLQLLSDISGTFRPGVLTALVGVSGAGKTTLMDVLAGRKTSGAIEGDITLSGYPKKQETFARISGYCEQTDIHSPNVTVFESITYSAWLRLSSDIDDGTKKMFVEEVMALVELDVLRDALVGLPGVSGLSTEQRKRLTIAVELVANPSIIFMDEPTSGLDARAAAIVMRTLLLLKRGGQVIYAGELGRHSHKLVEYFEAIPGVPKITEGYNPATWVLEVSSPLSEARLNMNFAEIYASSVLYRKNQEVIKELSIPRSDNQDLSFPTKYSQNFYGQCAANFWKQYRSYWKNPPYNAMRYLMTCLFGLVFGTVFWQKGKNIDSQQDLYNLLGATYAATFFLGASNCITVQPVVSIERAVFYREKAAGMYSPLSYAFAQTCVEVIYTILQGILYTVIIYAMIGYDWKADKFFYFLFFITASFNYFTLFGMMLVACTPSALLANILITFALPLWNLFAGFLIVRPAIPIWWRWYYWANPVSWTIYGVVASQFGENEGELSVPGGTPVVVKQFLKDNLGIQHDLLGYVVLVHFAYVIVFFFVFGYSIKFFNFQKR

SEQ ID NO: 3088 - protein, 1387 aa, Zea mays
AGLASTSSRRSLSLGSSISQSFRQMDSTDDPFARAQSEHEHRDDDEENLRWAALQKLPTYDRMRQGILRRALDDQEQQSGDGDVEVVDIHKLAAGDGGRALLERLFQEDSDPFLRRLRDRIDMVGIELPTVEVRYEQLTVQADVVAAGRALPTLWNAATNFLQGLIGRFGSSNKRNITILKNVNGILKPSRMTLLLGPPSSGKSTLMRALAGKLDKNLKVSGNITYCGHPISEFYPERTSAYVGQYDLHNAEMTVRETLDFSRRCLGVGARYEMIAELARRERDAGIKPDPEIDAFMKATAVQGQETNIITDFTLKVLGLDICADVIIGDEMIRGISGGQKKRVTTGEMLTGTARALFMDEISTGLDSSSTFQIVKFMRQLVHVMNETVMISLLQPPPETYNLFDDIILLSEGYIVYHGPRENILEFFESAGFRCPDRKGVADFLQEVTSKKDQQQYWYLDQEQYRYVSVPDFAERFKSFHACQQMHKELQIPFDKSKTHPAALTTTKYGLSSWESFKVVMSREQLLMKRNSFVYIFKVTQLIILALMSMTVFLRIKMPHGQIADGNKFFGALTFGLITIMFNGFAELQMTIKKLPVFYKHRDFLFFPAWTLGVANILLKVPISFVESLVWVVLTYYVMGFAPAAGRFFRQFIAFFATHQMAMALFRFLGAVLKTMVVANTFGMFVLLIIFIFGGFVIRRNDIKPWWIWGYWASPMMYSQNALSVNEFLASRWASPNNDTIIDAPTVGKAILISKGLFTGEWGFWLSIGALVGFIILFNMLYLWALTYLSRTNGATNTVAQSSRVTLPFQPLALCFNHVNYYVDMPAEMKEQGFTESRLQLLSDISGTFRPGVLTALVGFSGAGKTTLMDVLAGRKTSGAIEGDITLSGYPKKQETFARISGYCEQTDIHSPNVTVFESITYSAWLRLSSDIDDDTKKMFVEEVMTLVELDVLRDALVGLPGVNGLSTEQRKRLTIAVELVANPSIIFMDEPTSGLDARAAAIVMRTLLLLKRGGQVIYAGELGRHSHKLVEYFESISGVPKITEGYNPATWVLEVSSPLSEARLNMNFAEIYANSVLYRKNQELIKELSIPPPDYQDLSFPTKYSQNFYGQCVANFWKQCRSYWKNPPYNAMRYLMTSLFGLVFGTVFWQKGKNIDSQQDLYNLLGATYAAIFFLGASNCITVQPVVSIERAVFYREKAAGMYSPLSYAFAQTCVEVIYTTLQGILYTVIIYGMIGYDWKSDKFFYFLFFITASFNYFTLFGMMLVACTPSALLANILITFALPFWNLFAGFLIVRPAIPIWWRWYYWANPVSWTIYGVVASQFGENQGELSVPGGKPMLVNQFLKDNLGIQHDLLGYVVLVHFAYVIVFFFVFGYSIKFFNFQKR

SEQ ID NO: 3089 - protein, 1454 aa, Oryza sativa
MAGEITPSGSRRSWLSSGAASLARSLRDGDDPFRRSAAASRRDAGDDEENLRWAALEKLPTYDRMRRGILRKAVDGGGDGEGAGSLFKADEVDIANLDPREGRELMERVFKAVEDDNERFLRRFRDRLDQVGIELPKIEVRYQHLDIEADVHVGKRALPTLLNATINTLEGLVSLFISSNKRKLKILNDVNGIIKPSRMTLLLGPPSSGKSTLMRALTGKPDKNLKVSGEITYCGHTFKEFYPERTSAYVSQHDLHNPEMTVRETLDFSRRCLGSGARYDMLSELTRRERNAGIKPDPEIDALMKATVVEGKQNNIVTDLVLKALGLDICADTIVGGAMIRGISGGQKKRVTTGEMLTGPATALFMDEISTGLDSSSTFQIVKYIRQVTHVMNATVMMSLLQPPPETYALFDDIVLIAEGYIVYHGPRENILEFFESAGFRCPERKGVADFLQEVTSRKDQQQYWFLEQDHYRYVSVEEFAQNFKKFHVGQKLQKELQVPYDKSKTHPAALTTKKYGLSSLESLKAVMSREWLLMKRNSFLFIFKAFQLFVLGFITMTLFLRTKMPHEKFSDTSKYVGALTASLITIMFNGFGELQLTIDKLPIFYKQRDFLFFPAWTYGLANIILKVPLSLMESSLWIVLTYYVVGFAPAAGRFFKQFLAYFWTHQMALALFRLLGAILRSMVVANTFGMFVLLLIFLFGGFLVSRKDIKPWWIWGYWTSPMMYSNNALSVNEFLASRWAIPNNDSSISAPTIGKAFLQSKGYFTGEWGYWLSIGAMIGFMIVFNILYLCALTFLRPIGSASTVVSDDDTKSELEAESNQEQMSEVINGTNGTENRRSQRGMVLPFQPLSLSFNHMNYYVDMPAEMKAQGFTESRLQLLSDISGAFRPGVLTALVGVSGAGKTTLMDVLAGRKTSGTIEGDIKLSGYPKKQETFARISGYCEQTDIHSPNLTVYESIVYSAWLRLSSEVDKNTRKVFVEEVMSLVELDVLRDALVGLPGVSGLSTEQRKRLTIAVELVANPSIIFMDEPTSGLDARAAAIVMRTVRNTVNTGRTVVCTIHQPSIDIFESFDELLLLKRGGRVIYAGQLGLHSQILVEYFEAIPGVPKITEGYNPATWMLEVSSSLAEARLDIDFAEVYANSALYRSNQELIKQLSVPPPGFQDLSFPTKYSQNFLNQCVANTWKQFQSYWKDPPYNAMRYVMTLLYGLVFGTVFWRRGKNIESVNDLNNLLGATYAAVFFLGAANLLTLLPVVSVERTVFYREKAAGMYSPLSYAFAQGFVEFCYSAVQGVLYTILIYSMIGYEWKADKFFYFLFFMIAAFAYFTLFSMMLVACTASEMLAAVLVSFVLSSWNNFAGFIIPRPLIPVWWRWFYWANPVSWTIYGVIASQFADSDRVVTVPGQSTTMVVKDFLEKNMGFKHDFLGYVVLAHFGYVIIFFFLFGYGIKCLNFQKR

SEQ ID NO: 3090 - protein, 639 aa, Triticum aestivum
MAITGGPRGRLLLLPLFLVAAAVCLVSTPARAFYLPGVAPRDFQKDDDLQVKVNKLSSIKTQLPYDYYFLDYCKPEAIKNSAENLGEVLRGDRIENSVYNFKMRRDESCKVVCRTKLSAEAAKNFREKIDDEYRVNMILDNLPVVVPRQTREGSQPIFDHGYRVGYKLKDDKYYINNHLSFKVLYHEDLNSPEARIVGFHVIPSSIKHEYGAWDDKNPTVQTCNANTKITPGSHTPQEVAPDAYVVFSYDVTFESSEIIWASRWDVYLLSSDSQIHWFSIINSLMIVLFLSGMIAMIMMRTLYKDIANYNQLDNQEEAQEETGWKLVHGDAFRPPVHSGLLCVYVGTGVQFFGMTVVTMMFALLGFLSPANRGGLMTAMVLLWVFMGVLAGYTSSRLYKMFKGTEWKKITLKTAFMFPGIIFGVFFVLNALIWGEKSSGAVPFGTMFALVLLWFGISVPLVFVGSFLGFKQPAIEDPVKTNKIPRQIPEQAWYLQPAFSILAGGILPFGAVFIELFFILTSIWLNQFYYIFGFLFIVFVILLVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 3091 - protein, 637 aa, Brachypodium distachyon
MAITGGPRRRLLLPLIVCSIFLASSPARAFYLPGVAPRDFQKDDDLQVKVNKLSSIKTQLPYDYYFLDYCKPEAIKNSAENLGEVLRGDRIENSVYNFKMRRDESCKVVCRTKLSPEAAKNFKEKIDDEYRVNMILDNLPVVVPRQTREGSQTPSFEHGYRVGYKLKDDKYYINNHLSFTVLYHEDLNAAEARIVGFHVIPSSIKHEYGAWDDKNPTVQTCNANTKITPGSHTPQEVAPEAYVVFSYDVIFEASEIIWASRWDVYLLSSDSQIHWFSIINSLMIVLFLSGMIAMIMMRTLYKDIANYNQLDNQEEAQEETGWKLVHGDAFRPPVHSGLLCVYVGTGVQFFGMTVVTMMFALLGFLSPANRGGLMTAMVLLWVFMGVLAGYTSSRLYKMFKGTEWKKITLKTAFMFPGIIFGVFFVLNALIWGEKSSGAVPFGTMFALFLLWFGISVPLVFVGSFLGFKQPAIEDPVKTNKIPRQIPEQAWYLQPAFSILAGGILPFGAVFIELFFILTSIWLNQFYYIFGFLFIVFVILLVTCAEITIVLCYFQLCSEDYHWWWRAYLTAGSSALYLFAYAIFYFFNRLEITKLVSGILYFGYMLIISYAFFVLTGTIGFYACFWFVRKIYASVKID

SEQ ID NO: 3092 - protein, 639 aa, Sorghum bicolor
MATHGGGPRPCHLLILLAAAALYSASSPAGAFYLPGVAPRDFQKDDELQVKVNKLSSIKTQLPYDYYFLDYCKPEAIKNSAENLGEVLRGDRIENSVYNFKMRRDESCKVVCRKQLSQEAAKNFKEKIDDEYRVNMILDNLPVVVPRQTREGSQTPSFEHGYRVGYKLKDDKYYINNHLSFKVLYHEDQTSPDARIVGFHVIPSSIKHEYGAWDDNNPTAQTCNANIKITPGSHTPQEVAPDAYVVFSYDVTFESSDIIWASRWDVYLLSSDSQIHWFSIVNSLMIVLFLSGMVAMIMMRTLYKDIANYNQLDNQDEAQEETGWKLVHGDVFRPPVHSGLLCVYVGTGVQFFGMTLVTMMFALLGFLSPANRGGLMTAMVLLWVFMGVLAGYTSSRLYKMFKGTEWKKITLKTAFMFPGIIFSVFFFLNALIWGEKSSGAVPFGTMFALFLLWFGISVPLVFVGSFLGFKQPAIEDPVKTNKIPRQIPEQAWYLQPAFAILAGGILPFGAVFIELFFILTSIWLNQFYYIFGFLFIVFVILIVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 3093 - protein, 642 aa, Oryza sativa
MAIAGGTGCRRGLLLPPLLFAAALLLSAASPARAFYLPGVAPRDFQKDDELQVKVNKLSSTKTQLPYDYYFLDYCKPEAIKNSAENLGEVLRGDRIENSVYNFKMRRDETCKVVCRSKLSPEAAKNFKEKIDDEYRVNMILDNLPVVVPRQTREGSQTPSFEHGYRVGYKLKDDKYYINNHLSFKVLYHEDPNSPDARIVGFHVIPSSIKHEYSAWDDKNPTVQTCNANNKITPGSHTPQDVVPEAYVVFSYDVTFEASEIIWASRWDVYLLSSDSQIHWFSIINSLMIVLFLSGMVAMIMMRTLYKDIANYNQLDNQDEAQEETGWKLVHGDVFRPPVHSGLLCVYVGTGVQFFGMTLVTMMFALLGFLSPANRGGLMTAMVLLWVFMGVLAGYTSSRLYKMFKGTEWKKITLKTAFMFPGIIFALFFFLNALIWGEKSSGAVPFGTMFALFLLWFGISVPLVFVGSFLGFKQPAIEDPVKTNKIPRQIPEQAWYLQPAFSILAGGILPFGAVFIELFFILTSIWLNQFYYIFGFLFIVFIILIVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 3094 - protein, 640 aa, Panicum virgatum
MANPGGGLRPRHLLIFVAAAVLCAVSSPAGAFYLPGVAPRDFQKDDELQMKVNKLSSIKTQLPYDYYFLDYCKPEAIKNSAENLGEVLRGDRIENSVYNFKMRRDESCKIVCRKKLSQEAVKNFKEKIDDEYRVNMILDNLPVVVPRQTREGSQTPSFEHGYRVGYKLKDDKYYINNHLSFKVLYHEDQTSPDARIVGFHVIPSSIKHEYGAWDDANPTAQTCNANIKITPGSHTPQEVAPDAYVVFSYDVTFEASDIIWASRWDVYLLSSDSQIHWFSIVNSLMIVLFLSGMVAMIMMRTLYKDIANYNQLDNQDEAQEETGWKLVHGDVFRASWSIQVSFCVYVGTGVQFFGMTLVTMMFALLGFLSPANRGGLMTAMVLLWVFMGVLAGYTSSRLYKMFKGTEWKKITLKTAFMFPGIIFAVFFFLNALIWGEKSSGAVPFGTMFALFLLWFGISVPLVFVGSFLGFKQPAIEDPVKTNKIPRQIPEQAWYLQPAFAILAGGILPFGAVFIELFFILTSIWLNQFYYIFGFLFIVFIILIVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 3095 - protein, 614 aa, Setaria italica
SSDLGAFYLPGVAPRDFQKDDELQVKVNKLSSIKTQLPYDYYFLDYCKPQAIKNSAENLGEVLRGDRIENSVYNFKMRRDESCKVVCRRKLSQEAAKNFKEKIDDEYRVNMILDNLPVVVPRQTREGSQTPSFEHGYRVGYKLKDDKYYINNHLSFKVLYHEDQTSPDARIVGFHVIPSSIKHEYGTWDDNNPTVQTCNANIKITPGSHTPQEVAPDAYVVFSYDVTFEASEIIWASRWDVYLLSSDSQIHWFSIVNSLMIVLFLSGMVAMIMMRTLYKDIANYNQLDNQDEAQEETGWKLVHGDVFRPPVHSGLLCVYVGTGVQFFGMTLVTMMFALLGFLSPANRGGLMTAMVLLWVFMGVLAGYTSSRLYKMFKGTEWKKITLKTAFMFPGIIFALFFFLNALIWGEKSSGAVPFGTMFALFLLWFGISVPLVFVGSFLGFKQPAIEDPVKTNKIPRQIPEQAWYLQPAFAILAGGILPFGAVFIELFFILTSIWLNQFYYIFGFLFIVFIILIVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 3096 - protein, 540 aa, Brachypodium distachyon
MAPAWSGLFRLGPGGRVTVAPGASIISRTEIQRVWGAARQKEHLHFLRFSPCKTLPNPSLLCTRTHVLVFPKAAKRRVVDLHPLDFFPIPSPSKFIPFVKYCSSSASGTKTGKIFISSLHRKYLKFGVRLLIPRRTNLRSPGMGERSPSPPLRPAPSLPLPLVYTNVIRTGDSSSALFDLLVRSTGYQFRWDDDLQVKVNKLSSIKTQLPYDYYFLDYCKPEAIKNSAENLGEVLRGDRIESSVYNFKMRRDESCKVVCRTKLSPEAAKNFKEKIDDEYRVNMILDNLPVVVPRQTQEGSQTPSFEHGYRVGYKLKDDKYNINNHLSFKVLYHEDLNAAEARIVGFHVIPSSIKHEYGAWDDKNPTVQTCNANTKITPGSHTPQEVAPEAYVVFSYDVIFEASEIIWASRWDVYLLSSDSQIHWFSIINSLMIVLFLSGMIAMIMMRTLYKDIANYNQLDNQEEAQEETGWKLVHGDAFRPPVHSGLLCVYVGTGVQFFGMTVVTMMFALLGFLSPANRGGLMTAMVLSWVFMGVLAGYT

SEQ ID NO: 3097 - protein, 540 aa, Pennisetum glaucum
FKMRRDESCKIVCRRKLSQEAAKNFKEKIDDEYRVNMILDNLPVVVPRQTREGSQTPSFEHGYRVGYKLKDDKYYINNHLSFKVLYHEDQTSPEARIVGFHVIPSSIKHEYGTWDDNNPTAQTCNANIKITPGSHTPQEVAPDAYVVFSYDVTFEASEIIWASRWDVYLLSSDSQIHWFSIVNSLMIVLFLSGMVAMIMMRTLYKDIANYNQLDNQDEAQEETGWKLVHGDVFRPPVHSGLLCVYVGTGVQFFGMTLVTMMFALLGFLSPANRGGLMTAMVLLWVFMGVLAGYTSSRLYKMFKGTEWKKITLKTAFMFPGIIFALFFFLNALIWGEKSSGAVPFGTMFALFLLWFGISVPLVFVGSFLGFKQPALEDPVKTNKIPRQIPEQAWYLQPAFAILAGGILPFGAVFIELFFILTSIWLNQFYYIFGFLFIVFIILMVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 3098 - protein, 537 aa, Saccharum officinarum
MRRDESCKVVCRRHLSQEAAKNFKEKIDDEYRVNMILDNLPVVVPRQTREGSQTPSFEHGYRVGYKLKDDKYYMNNHLSFKVLYHEDQTSDARIVGFHVIPSSIKHEYGAWDDNNPTAQTCNANIKITPGSHTPQEVAPDAYVVFSYDVTFESSDIIWASRWDVYLLSSDSQIHWFSIVNSLMIVLFLSGMVAMIMMRTLYKDIANYNQLDNQDEAQEETGWKLVHGDVFRPPVHSGLLCVYVGTGVQFFGMTLVTMMFALLGFLSPANRGGLMTAMVLLWVFMGVLAGYTSSRLYKMFKGTEWKKITLKTAFMFPGIIFSVFFFLNALIWGEKSSGAVPFGTMFALFLLWFGISVPLVFVGSFLGFKQPAIEDPVKTNKIPRQIPEQAWYLQPAFAILAGGILPFGAVFIELFFILTSIWLNQFYYIFGFLFIVFVILIVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 3099 - protein, 285 aa, Saccharum officinarum
MAMATAKLVLLMILVAGSSCGGSAWGPLSRLRMLPTAQDVEAAAERLKEDVSAPLIHALHPLLGSAGDLGRRAGVPCDSWRLAVETYNKRDWTTVPASCEGYVGHYMLGGHYRRDSRVVVDEAIAYAEALRLGGNGKEVWVFDIDETSLSNLPYYATHGFGTKPYNATSFNEYVLEGSAPVLPETQRLFKKLISLGIKPVFLTGRTEDQRAITVTNLRRQGYSGWMDLLLKPVGLKATAIAYKSGERQKLQDAGYVIVGNIGDQWSDILGAPEGARTFKLPDPLY

SEQ ID NO: 3100 - protein, 535 aa, Setaria italica
RKDACYVARQKSVSKRRTLKKKKKNKGSKASGKKSASAKAKKSAPVRRRRKRSMIDEYEEDEDEDEDDDDFIVEDERPRKKARKRNGREAELDAEVSPVEEETWPNLESDTSDFEFATSDEEHNNVETPVVEQITVKKGRKKRISGSESSSDSEFVVSDKELEDLRETELPKPVPIMLPASMRRICITRHGEGKGKEKQEQEEAGKPICGICLSEEQRATVQGVLNCCSHYFCFGCIMEWSRVESRCPLCKQRFTTITKSSKVDLGLGVRKAVIKVEERDQVYQPTEEEIRRWLDPYENVVCIECNQGGDDSLMLLCDICDSSAHTYCVGLGREVPEGNWYCGGCRLGDEGPSYTGIQRTVAYERQNYRNHVDSSSVSFGTAAPSGTLERPPSINPRRSFQGIDLNLSPREFPGETHPAESQVSTDSVSTPTGRRATLSGRRQIHRYIRILLTRPRPPSRQDAYHNIAQHSGGVPRTEPNRRNFPSSSEENTSHSMPDGIQNHHNGLPFVQAHNNFAPCMSLDGDEGVKSNLRNI

SEQ ID NO: 3101 - protein, 409 aa, Panicum virgatum
VEQISVRKGRKKRISGSESSSDSEFVVSDKELEDLKEPELPKPVPMLPASIRRICITRQGEGKGKEKQEPEEAGNPICGICLSEEQRATVQGVLNCCSHYFCFACIMEWSRVESRCPLCKQRFTTITKSSKVDLGLGVRKSVIKVEERDQVYQPTEEEIRRWLDPYENVVCIECNRGVDDSLMLLCDICDSSAHTYCVGLGREVPEGNWYCGGCRLGDEGPSYTGIQRTVANERQNYRTQVDSSSVSFGPAAPSGTFERSPSINPRRSFQGIDLNLSPRDFPGDTHPAESQVSTDSVSTPTGRRATLSGRRQIHRYIRILLTRPRQPSRQDTYHNVAQHSGGVPRTEPNRRNFPSSSEANTSHSLPDGIQNHHNGLPFVQAHSNFAPCMSLDGDDFQQLEGVKSNLRNV

SEQ ID NO: 3102 - protein, 238 aa, Triticum aestivum
KVEERDQVYQPTEEEIRRWLDPYENVVCIECNQGGDDSLMLLCDICDSSAHTYCVGLGREVPEGNWYCGGCRLGDEGPSYTGIQRTVAYERQTYRNHVDSSSVSFGMLASSGTFERPPSINPRHSFQGIDLNLSPREFPGESHPAESQVSTDSVSTPTGRRTVSARRQIHRYIRILLARPRQPSRPDVFHNIAQHSGGVPRTEPNRQNFPSSSEANTSHNLPDGIQNHHGSLPFVQAQ

SEQ ID NO: 3103 - protein, 679 aa, Zea mays
MGTGEGSPPARRGISGRRRRWPDEDDDEYVLEEEEEEDYVEELSASSAGEEGDGLDSDAEYQEAEEEDDDEIETPRPKRRAKGSNRVRKGKVDLAAARSRRRKYEEDEDYEEEVDEDDEVEEEYHDDLEEVEEEEEVAPQRPKSIVKCGARGRNVKLSLAAKRSHQRKQEDDEDMDFDPELDDEEVEIDEDIDFDPDVDGDEEDEYQDEEEEELVPARARKVTVKNPVKRKSISKRRTPKKKKKNRGSKVSRRKGASAKVKKSAPVRRRRKRSVIDDYEDEDVDDDDDDDFIVDDEVIVNRHPKKKARIGSGRETVVDPQVSIEEETWPDLESDSSDFEFATSDEEPNNVETPVAEQTTVRKGRKKRISESESSSDSEFVVSGKELEELREPEPPKAAPNLHVSLRRICITRHGEGKGKEKQEHEEAGKPICGICLSEELRATVQGVLNCCSHYFCFACIMEWSRVESRCPLCKQRFTTITKSSKVDLGLGVRKAVVKVEERDQVYQPTEEEIRRWLDPYENVVCIECNQGGDDNLMLLCDICDSSAHTYCVGLGREVPEGNWYCGGCRLGDEGPSYTGIQRTVAYERQNYRSHVGSSVSFGMAVPGGTFERPSSINPRHSFQGIDLNLSPREFPGESHPAESQVSTDSVSTPTGRAGSYFRKASNTTVHSEFVQTKST

SEQ ID NO: 3104 - protein, 868 aa, Zea mays
MGTGEGSPPARRGISGRRRRWPDEDDDEYVLEEEEEEDYVEELSASSAGEEGVDSDAEYQEAEEEDEIEKPRPKRPAKGITSSAGERGLDSDAEYQEAEEDDEIEPPRLKRPAKGSTSSAGEEGLDSDAEYQEAEEDEMETPRPKRPAKDSTSSAGEDGLDSDAEYQEAEEEDDDEIETPRPKRRAKGSNRVRKGKVDLAAARSRRRKYEEDEDYEEEVDEDDEVEEEYHDDLEEVEEEEEVAPQRPKSIVKCGARGRNVKLSLAAKRSHQRKQEDDEDMDFDPELDDEEVEIDEDIDFDPDVDGDEEDEYQDEEEEELVPARARKVTVKNPVKRKSISKRRTPKKKKKNRGSKVSRRKGASAKVKKSAPVRRRRKRSVIDDYEDEDVDDDDDDDFIVDDEVIVNRHPKKKARIGSGRETVVDPQVSIEEETWPDLESDSSDFEFATSDEEPNNVETPVAEQTTVRKGRKKRISESESSSDSEFVVSGKELEELREPEPPKAAPNLHVSLRRICITRHGEGKGKEKQEQEEAGKPICGICLSEELRATVQGVLNCCSHYFCFACIMEWSRVESRCPLCKQRFTTITKSSKVDLGLGVRKAVVKVEERDQVYQPTEEEIRRWLDPYENVVCIECNQGGDDNLMLLCDICDSSAHTYCVGLGREVPEGNWYCGGCRLGDEGPSYTGIQRTVAYERQNYRSHVGSSVSFGMAVPGGTFERPSSINPRHSFQGIDLNLSPREFPGESHPAESQVSTDSVSTPTGRAGRTISGRRELQRYIQSLFRPSLPSRPDTYHNIAQNSGGVSRNEPNRWNFPSSSEANTSQNLPDGIQNHHSDLPFVQAHSNFAPFMSPDGDDFQQIEGVKSNLRNMQ

SEQ ID NO: 3105 - protein, 464 aa, Panicum virgatum
MNTPGRRPGTRNGREAQVDPEVSPVEEETWPNVESDTSDFEFATSDEEHNNVETQVVEQISVRKGRKKRISGSESSSDSEFVVSDKELEDLKEPELPKPVPMLPSSIRRICITRHGEGKGKEKQEPEEAGNPICGICLSEEQRATVQGVLNCCSHYFCFACIMEWSRVESRCPLCKQRFTTITKSSKVDLGLGVRKSVIKVEERDQVYQPTEEEIRRWLDPYENVVCIECNRGGDDSLMLLCDICDSSAHTYCVGLGREVPEGNWYCGGCRLGDEGPSYTGIQRTVANERQNYRTQVDNSSVSFGPAAPSGTFERSPSINPRGSFQGIDLNLSPRDFPGDTHPAESQVSTDSVSTPTGRRATLSGRRQIHRYIRILLNRPRQPSRQDTYHNVAQHSGVVPRTEPNWLNFPSSEPNTSHSLPDGIQNHHNGLPFVQAHSSFAPCMSLDGDDFQQIEGVKSNLRNV

SEQ ID NO: 3106 - protein, 334 aa, Pennisetum glaucum
TGTRGVWEKPICGICLSEEQRATVQGVLNCCSHYFCFACIMEWSRVESRCPLCKQRFTTITKSSKVDLGLGVRKAVIKVEERDQVYQPTEEEIRRWLDPYENVVCIECNQGGDDSLMLLCDICDSSAHTYCVGLGREVPEGNWYCGGCRLGDEGPSYTGIQRTVAYERQNYRIVDNSFGSAAPSGTLERPPSINTRRSFQGIDLNLSPREFPGETHTAESQVSTDSVSTPTGRRATLSGRRQIHRYIRILLTRPRPPSRQDAYHNIAQHSGGVPRAEPSRRNLPTSSETNTSHSLPDGIQNHHSDLPFVQAHNNFAPCTPLDGDEGVKSNLRNL

SEQ ID NO: 3107 - protein, 481 aa, Pennisetum glaucum
RRRKKRSVIDEYEDDDDDDEDDDDFIVEDERPRKKARTRNGREDPEVSPVEEETWPNLESDTSEFEFATSDEEHNDAETPVVEQITVKKGRKKRTSGSESSSDSEFVVSDKELEDLRETELPKPMPMLPASVRRLCITRNGEGKGKEKQEQEESGKPICGICLSEEQRATVQGVLNCCSHYFCFACIMEWSRVESRCPLCKQRFTTITKSSKVDLGLGVRKAVIKVEERDQVYQPTEEEIRRWLDPYENVVCIECNQGGDDSLMLLCDICDSSAHTYCVGLGREVPEGNWYCGGCRLGDEGPSYTGIQRTVAYERQNYRIVDNSFGSAAPSGTLERPPSINTRRSFQGIDLNLSPREFPGETHTAESQVSTDSVSTPTGRRATLSGRRQIHRYIRILLTRPRPPSRQDAYHNIAQHSGGVPRAEPSRRNLPTSSETNTSHSLPDGIQNHHSDLPFVQAHNNFAPCTPLDGDEGVKSNLRNL

SEQ ID NO: 3108 - protein, 664 aa, Pennisetum glaucum
EEEEEVEEYRDEPDEEEVEYCDELEEEEEVEEYRDELEEEEVEYRDELEEVEEEEPPRPKGLAKCGGRSRNVKPATAAKRSHQRRHLDDDDMDFDPELDDEDELDEDIDFDPEADDDDEDEYQDEEEEELSAIRARKVTVKNPAKRKSVSKRRTLKKKKKKSKGSKASGKKSASAKAKKSAPVRRRKKRSVIDEYEDDDDDDEDDDDFIVEDERPRKKARTRNGREDPEVSPVEEETWPNLESDTSEFEFATSDEEHNDAETPVVEQITVKKGRKKRTSGSESSSDSEFVVSDKELEDLRETELPKPMPMLPASVRRLCITRNGEGKGKEKQEQEESGKPICGICLSEEQRATVQGVLNCCSHYFCFACIMEWSRVESRCPLCKQRFTTITKSSKVDLGLGVRKAVIKVEERDQVYQPTEEEIRRWLDPYENVVCIECNQGGDDSLMLLCDICDSSAHTYCVGLGREVPEGNWYCGGCRLGDEGPSYTGIQRTVAYERQNYRIVDNSFGSAAPSGTLERPPSINTRRSFQGIDLNLSPREFPGETHTAESQVSTDSVSTPTGRRATLSGRRQIHRYIRILLTRPRPPSRQDAYHNIAQHSGGVPRAEPSRRNLPTSSETNTSHSLPDGIQNHHSDLPFVQAHNNFAPCTPLDGDEGVKSNLRNL

SEQ ID NO: 3109 - protein, 201 aa, Solanum tuberosum
MGVVHTLHFVFGIFGNATALFLFLAPIITFKRVIQNRSTEQFSGLPYVMTLLNCLLSAWYGLPFVSPNNLLVSTINGTGAVIETIYVLIFIAFAPSKEKKKISALLLLVLTVFAAVALVSMLALHGSKRKLFCGIAATIFSIIMYGSPLSIIRLVIKTKSVEFMPFFLSLFVFLCGASWFAFGLLGKEPFVAIPNGFRAWV

SEQ ID NO: 3110 - protein, 224 aa, Gossypium hirsutum
MSLTIPTNLSKSLLKPKINSQLTPKVSRSLVVCSTDKTSSPPSSASPLQAFSAALALSSILLSAPQPAVADIAGLTPCKESKQFAKREKQQIKKLESSLKLYAPDSAPALAIKATIEKTKRRFDNYGKYGLLCGSDGLPHLIVSGDQRHWGEFITPGLLFLYIAGWIGWVGRSYLIAISDDKKPAMKEIIIDVPLATGLIFRGFIWPVAAYRELINGDLVVKDV

SEQ ID NO: 3111 - protein, 224 aa, Gossypium hirsutum
MSLTIPTNLSKSLLKPKINSQLTPKVSRSLVVCSTDKTSSPPSSASSLQAFSAALALSSILLSAPQPAVADIAGLTPCKESKQFAKREKQQIKKLESSLKLYAPDSAPALAIKATIEKTKRRFDNYGKYGLLCGSDGLPHLIVSGDQRHWGEFITPGLLFLYIAGWIGWVGRSYLIAISDDKKPAMKEIIIDVPLATGLIFRGFIWPVAAYRELINGDLVVKDV

SEQ ID NO: 3112 - protein, 225 aa, Ricinus communis
MSLTIPSNLSKPMLKPKLGSSLTPRSSMIVCSASQTPSTQEKDSSKSPLQAFSAALALSSILLSAPLPAVADISGLTPCKDSKQFAKREKQQIKKLESSLKLYAPDSAPALAIKATVEKTKRRFDNYGKQGLLCGSDGLPHLIVSGDQRHWGEFITPGILFLYIAGWIGWVGRSYLIAIRGEKKPAMKEIIIDVPLATGLIFRGFSWPVAAYREFVNGELVVKDV

SEQ ID NO: 3113 - protein, 225 aa, Castanea mollissima
MSLTIPTNLSKPILKPKLSSSPTPKSRPTIVCSSQNSNQDEKITTSPLKAFSAALALSSILVSAPILPANADIAGLTPCKDSKQFAKREKQQIKKLESSLKLYAPDSAPALAIKASVEKTKRRFDNYGKQGLLCGSDGLPHLIVSGDQRHWGEFITPGILFLYIAGWIGWVGRSYLIAIRDDKKPTQKEIIIDVPLASSLLFRGFIWPVAAYRELVNGDLVVKDV

SEQ ID NO: 3114 - protein, 230 aa, Unknown
  Sequence found in Organisms: Citrus sinensis, Citrus clementina, Citrus sinensis
MSLTIPTNLSKPLLKPRSNSQLSHAKLSKQMITCSSSAGSEETSSSSGKAAKPLQAFSAALALSSILLSAPQPAVADISGLTPCKESKQFAKREKQQLKKLESSLKLYAPDSAPALAIKATMEKTKRRFDNYGKYGLLCGSDGLPHLIVSGDQRHWGEFITPGLLFLYIAGWIGWVGRSYLIAISGEKKPAMKEIIIDVPLASRLVFRGFSWPVAAYREFVNGELVVKDV

SEQ ID NO: 3115 - protein, 234 aa, Tamarix hispida
MSLTIPTTNVTKPLSMKPKLNLPSSLTPTRSSSSLRILCSSSEQPQQHKSSSPSASPLQAFSAALALSSILLSSPQPAVADISGLTPCKESKQFAKREKQQLKKLQSSLKLYAPDSAPALAIKATMEKTKRRFDNYGKYGLLCGSDGLPHLIVSGDQRHWGEFITPGLLFLYIAGWIGWVGRSYLIAIRDEKKPAQKEIIIDVPLATGLIFRGFSWPIAAYRELLNGDLVDKTV

SEQ ID NO: 3116 - protein, 222 aa, Euphorbia esula
MSLTIPSNLSILKPKLGLNPSRTPSRSSAIVCSSSSGEESSKTSNLQAFSAALALSSILLSAPLPAVADISGLTPCKESKQFAKREKQQIKKWESSLKLYAPDSAPALALKATIEKTKRRFQAYGDKGLLCGSDGLPHLIVSGDQRHWGEFITPGLLFLYIAGWIGWVGRSYLIAIRGEKKPAMKEIIIDVPLASSLVFKGFSWPIAAYRELLNGELVVKDV

SEQ ID NO: 3117 - protein, 225 aa, Cleome gynandra
MSLTIPTNLVLKPRSNSLSQSIPKSSTTARFVCSAASSDEKLASPAAPLKAFSAAIALSSILLSTPMPAAADISGLTPCKESKQFAKREKQQIKKLESSLKLYAPDSAPALAIKAQIEKTKRRFDNYGKYGLLCGSEGLPHLIVNGDQRHWGEFITPGLLFLYIAGWIGWVGRSYLIAISDEKKPAMKEIIIDVPLATRLLFRGFSWPVAAYREFLNGDLVVKDV

SEQ ID NO: 3118 - protein, 225 aa, Cleome spinosa
MSLTVPTNLVLRPRSNSLSQCVPKSSAAARFVCSAASSDEKSASPAAPLKAFSAAVALSSILLSAPMPAAADISGLTPCKESKQFAKREKQQIKKLESSLKLYAPDSAPALAINAQIEKTKRRFDNYGKYGLLCGSDGLPHLIVNGDQRHWGEFITPGLLFLYIAGWIGWVGRSYLIAISDEKKPAMKEIIIDVPLATRLLFRGFIWPVAAYREFLNGDLVVKDV

SEQ ID NO: 3119 - protein, 156 aa, Fagus grandifolia
MADIAGLTPCKDSKQFAKREKQQIKKLESSLKLYAPDSAPALAINATIEKTKRRFDNYGKQGLLCGSDGLPHLIVSGDQRHWGEFITPGILFLYIAGWIGWVGRSYLIAIRDEKKPTEKEIIIDVPLASSLLFRGFIWPVSAYRAFVTGDLVVKDV

SEQ ID NO: 3120 - protein, 224 aa, Cucumis sativus
MSLTIPTNLSKPLLKPKFSSPLALKPKPSSSILCSASQNQNQNTSSSLQAFSAALALSSILLSAPLPAVADISGLTPCKESKQFAKREKQQIKKLESSLKNYAPDSAPALAIKATIEKTKRRFAFYGKQGLLCGADGLPHLIVSGDQRHWGEFITPGFLFLYIAGWIGWVGRSYLIAIRDEKKPTQKEIIIDVPLATSLVFRGFSWPVAAYRELVNGELIAKDV

SEQ ID NO: 3121 - protein, 220 aa, Vigna unguiculata
MSLTIPTNLSKPAALRPKLGAKLRPTIVCSATPNNSDNNISSDLKAFSAALALSSILLSAPLPAVADISGLTPCKESKQFAKREKQSIKKLESSLKLYEPDSAPALAIKASVEKTKRRFDNYAKQGLLCGADGLPHLIVSGDQRHWGEFITPGFLFLYIAGWIGWVGRSYLIAIRDEKKPTMKEIIIDVPLASRLLFRGFSWPVAAYRELINGDLIAKDV

SEQ ID NO: 3122 - protein, 216 aa, Brassica juncea
MSLTIPTNLVVNSISSNKTLTQSVPKSTARFVCSTDDKSMKAFSAAVALSSILLSAPMPAVADISGLTPCKESKQFAKREKQQIKKLESSLKLYAPESAPALALNAQIEKTKRRFDNYGKYGLLCGADGLPHLIVNGDQRHWGEFITPGLLFLYIAGWIGWVGRSYLIAISDEKKPAMKEIIIDVPLASRLIFRGFIWPVAAYRALLNGDLIAKDV

SEQ ID NO: 3123 - protein, 227 aa, Eucalyptus grandis
MSLTIPTNLSKPIAAPKLSPSKSVRPAATLIRCSSSSPEQGSASTSAASPLQAFSAALALSSILLSAPQPAAADIAGLTPCKESKQFAKREKQQLKKLESSLKLYAPDSAPALALKATMEKTKRRFDNYGKQGLLCGTDGLPHLIVSGDQRHWGEFITPGILFLYIAGWIGWVGRSYLIAIRDEKKPTQKEIIIDVPLASRLVFRGFSWPIAAYRELVNGELIAKDV

SEQ ID NO: 3124 - protein, 221 aa, Vitis vinifera
MSLTIPTNLSKPLKPRLSSPSFQKARPMIVCSASTEPQPTNKSPLQAFSAALALSSIILAAPVPAYADIAGLTPCKESKQFAKREKQALKKLESSLKLYAPDSAPALAINATIEKTKRRFTNYANQGLLCGSDGLPHLIVSGDQRHWGEFITPGILFLYIAGWIGWVGRSYLIAIRDEKKPTQKEIIIDVPLASRLVFRGFIWPVAAYREFVNGDLIAKDV

SEQ ID NO: 3125 - protein, 226 aa, Cucumis melo
MSLTIPTNLSKPLLKPKLSSPLALKPKPSSSILCSAFPNQNQSQNPSSSLQAFSAALALSSILLSAPLPAVADISGLTPCKESKQFAKREKQQIKKLESALKNYAPDSAPALAIKATIEKTKRRFAFYGKQGLLCGADGLPHLIVSGDQRHWGEFITPGFLFLYIAGWIGWVGRSYLIAIRNEKKPTQKEIIIDVPLATSLVFRGFSWPVAAYRELVNGELIAKDV

SEQ ID NO: 3126 - protein, 483 aa, Glycine max
MDSPLLENIDNSTTYVEEKKTLNSVVKKFGFESKKLWKIAGPAILTSICQYSLGALTQTFAGLVGDLELAAVSVENSVVAGLAFGVMLGMGSALETLCGQAYGAGQSTMLGVYMQRSWVILFVTALILLPLYIWSPPILRLFGQTAEISDAAGKFALWMIPQLFAYAINFPMVKFLQAQRKVLVMLWISVVVLVLHTFFSWFLIFKLGWGLIGAAITLNTSWWVIVIAQLLYIFITKSDGAWNGFTWLAFSDLFGFVKLSLASAVMLCLEFWYLMILVVITGRLKNPLVPVDAISICMNINGWDAMIAIGFNAAISVRVSNELGAGDFKAAKFSVWVVSITSVFIGVVAMIGVLSTKDYFPYLFTTSVPVANETTRLAALLGVTVLLNSLQPVLSGVAVGAGWQSLVACINIVCYYVIGLPAGIILGFPLGLGAEGIWSGMIAGIVLQTTILIIVTSIRNWKKEAEEAESRVKKWGGAIAYDQ

SEQ ID NO: 3127 - protein, 460 aa, Glycine max
SVVKKFGFESKKLWKIAGPAILTSICQYSLGALTQTFAGLVGDLELAAVSVENSVVAGLAFGVMLGMGSALETLCGQAYGAGQSTMLGVYMQRSWVILFVTALILLPLYIWSPPILRLFGQTAEISDAAGKFALWMIPQLFAYAINFPMVKFLQAQRKVLVMLWISVVVLVLHTFFSWFLIFKLGWGLIGAAITLNTSWWVIVIAQLLYIFITKSDGAWNGFTWLAFSDLFGFVKLSLASAVMLCLEFWYLMILVVITGRLKNPLVPVDAISICMNINGWDAMIAIGFNAAISVRVSNELGAGDFKAAKFSVWVVSITSVFIGVVAMIGVLSTKDYFPYLFTTSVPVANETTRLAALLGVTVLLNSLQPVLSGVAVGAGWQSLVACINIVCYYVIGLPAGIILGFPLGLGAEGIWSGMIAGIVLQTTILIIVTSIRNWKKEAEEAESRVKKWGGAIAYDQ

SEQ ID NO: 3128 - protein, 101 aa, Glycine max
MWESIVLTVVATAGNNIGKILQKKGTVILPPLSFKLKACHKGICFEQNLAHRFCNGYIWGTVDVKGISSCSCLRHPTSFWLWIGNSLSLFSFLSQGSYEYC

SEQ ID NO: 3129 - protein, 343 aa, Cajanus cajan
MWESIVLTVVATAGNNIGKILQKKGTVILPPLSFKLKVIRAYALNTTWVIGFLMDIFGALLMLRALALAPVSVIQPVSGCGLAILSVFSHFYLKEVMNIIDWVGITLAGFGTIGVGAGGEEQEAAALSIFHIPWLASVVFILFLLLNGWLRICKRHRREQEMMEYDVVEEIIYGLESGILFGMASVISKMGFLFLEQGFNKLLVPICIMISVCSSGTGFYYQTRGLKHGRAIVVSTCAAVASILTGVLAGMLALGERLPSAPNARLLLLLGWLLIIFGVILLVGSTKIVRILRNSSQRLKSSVDKNYGPRRSGTSRIREPSPTAVIQTATLNQLLSSSSKEKA

SEQ ID NO: 3130 - protein, 344 aa, Lotus japonicus
MWESIVLTVVATAGNNIGKILQKKGTVILPPFSFKFKVLRSYAMNKTWLTGFVMDIFGALLMLRALALAPVSVIQPVSGCGLAILSIFSHFYLKEVMNAVDWVGITLAGFGTIGVGAGGEEQEAAALSIFHIPWLAFAVFILFILLNGWLRIRKRQRREQEMMEYDVVEEIIYGLESGILFGMASVISKMGFLFLEQGFPKLLVPLCLIISVCSSGTGFYYQTRGLKHGRAIVVSTCAAVASILTGVLAGMLALGERLPSAPKARLVLLLGWLLIILGVILLVGSTRVVRFLRLNSQRFKRTSVDKNHGPRRSAASRIREPSPTAVIQAATLNHLLASSSKEKA

SEQ ID NO: 3131 - protein, 343 aa, Medicago truncatula
MWESILLTVAATAGNNIGKILQKKGTIILPPLSFKLKVIRAYALNKTWSIGFLMDIFGALLMLRALSLAPVSVIQPVSGCGLAILSIFSHFYLQEVMNVVDWVGITLAGFGTIGVGAGGEEQQEMVALSIFHIPWLAFVVSILFILLNGWLRIYKRQRREQEMMEYDVVEEIIYGLESGILFGMSSVISKMGFLFLEQGFPKILVPICLLISVSCSGIGFYYQTRGLKHGRAIIVSTCAAVASILTGVLAGMLALGERLPSAPKARLALLLGWLLIITGVILLVGSTRLLRFITSRQKRSNMEKNYGPRRSTTSRVREPSPNSAVIQASTLNHLLSSSSKEKA

SEQ ID NO: 3132 - protein, 338 aa, Arachis hypogaea
MWESIVLTVVATAGNNVGKILQKKGTLILPPLSFKLKVIKAYASNKTWLIGFLMDIIGALLMLRALSLAPVSVIQPVSGSGLAILSIFSHFYLKEVMNVVDWVGITLAGFGTIGVGAGGEEQEASALSILHIPWLAFVVFILFILLSAWLRICKRHRREQEMMEYDVVEEIIYGLESGILFGMASVISKMGFLFLEQGFPSLLVPMCIIISVFFSGAGLFYQTRGLKHGRAIIVSTCAAVASILTGVLAGMLALGERLPSAPKARFALLLGWLLIIVGVVLLVGSKRLVRFLRVPSRRFKNYGTRRAGTSRIKEPSPTAVVQAATLNHLLSSASKEKA

SEQ ID NO: 3133 - protein, 165 aa, Glycine max
MWESIVLTVVATAGNNIGKILQKKGTVILPPLSFKLKVIRAYALNKTWLIGFVMDIFGALLMLRALALAPVSVIQPVSGCGLAILSVFSHFYLKEVMNIVDWVGITLAGFGTIGVGAGGEEQEAAALSIFHIPWLAFVVFILFVGTLSYVLLLFLIVRNNCTDNA

SEQ ID NO: 3134 - protein, 355 aa, Glycine max
MWESVVLTVAATAGNNIGKILQKKGTIILPPLSFKLKAFIISFYSCVYLVIRSYALNKTWVVGFLMDILGALLMLRALSLAPVSVIQPVSGCGLAILSIFSHFYLKEVMNAVDWVGITLAGFGTIGVGAGGEEQEVVALSIFHIPGLAFVVFILFILLSGWLRICKCQRREQEMVEYDVVEEVIYGLESGILFGMSSVISKMGFLFLEQGFPKLLVPMCIMISVCCSGTGFYYQTRGLKHGRAIVVSTCAAVASILTGVLAGMLALGERLPSEPKARLALLLGWLLIIVGVILLVGSTRLVRFLSCSSQRKRSNVDKNFDLRRATSSRVRETSPSAVIQAATLNHLLSSSSKEKA

SEQ ID NO: 3135 - protein, 355 aa, Glycine max
MWESILLTVAATAGNNIGKILQKKGTIILPPLSFKLKAFIITFYSCVYLVIRSYALNKTWVVGFLIDIFGALLMLRALSLAPVSVIQPVSGCGLAILSIFSHFYLKEVMNAVDWVGITLAGFGTIGVGAGGEEQEVVALSIFHIPGLAFIVFILFILLSGWLRICKRQRREQEMMEYDVVEEVIYGFESGILFGMSSVISKMGFLFLEQGFPKLLVPMCIMISVCCSGTGIYYQTRGLKHGRAIVVSTCAAVASILTGVLAGMLALGERLPSEPKARLALLLGWLLIIVGVILLVGSTRLVRFLSCSSRQKRSNVEKNFGLRGATSSRVREPSPSAVIQAATLNHLLSSSSKEKA

SEQ ID NO: 3136 - protein, 344 aa, Arachis hypogaea
MWESIVLTVAATAGNNIGKILQKKGTVILPPLSLKFKVIRAYAFNKIWVIGFLMDIGGALLMLRALSLAPVSVIQPVSGVGLAILSIFSHFYLKEIMNAVDWVGIALAGVGTIGVGAGGEEQEAATLSIFHIPCLAFVVAILFVLLNGGLRICRRHRREQEMMEYDVVEEIIYGLESGILFGMSSVISKMGFLFLEQGFHQLLVPLCIIFSVCCSGTGFYYQTRGLKHGRAIVVSTCAAVASIVSGVLAGMLALGERLPSAPKARLALLLGWLLIITGVILLVGSTRLVKFLSCSSGRTKRSNADKSYGARRPSSLRIGEPNPSAVIPATTLNHLLPSASKEKA

SEQ ID NO: 3137 - protein, 344 aa, Prunus persica
MWESIFLTLAATAGNNIGKILQKKGTVILPPLSFKLKVIRAYALNRAWLIGFLMDIFGALLMLRALSLAPVSVIQPVSGCGLAILSIFSHFYLKEIMNAVDWMGITLAGIGTIGVGAGGEEQKASAISIFHLPWLAIVVAILFVLLNGWLRIYRRQRKEQELMEYDVVEEIIYGLESGILFGMASVISKMGFVFLEQGFPIMLVPICLIFSICCSGTGFFYQTWGLKHGRAIVVSTCAAVASIVTGVLAGMLALGERLPSAPTARLSLVLGWLFIIIGVILLVSSTRLVRNLPRPLRHFIQSGVDKNFSQRKSGSIRTRDSSPSTVIQAATLHHLIPTSSKEKA

SEQ ID NO: 3138 - protein, 276 aa, Leymus cinereus x Leymus triticoides
MATTTCLLAVWALVAAGLFGTGLARSSVAPAVGKEQREFDYFALALQWPGTICSSTRHCCAVNGCCRKEPLHTFTIHGLWPDYDDGTWPSCCRHTNFDMDKITPLKPTLDKYWPSLYCSSSSTCFSGRGPFWAHEWEKHGTCSAPVVHEELQYFTTALDLYFKYNVTEMLATGDILISNGKEYALSDVIDTIKHAFGGSPQIICKKGSVEELRLCFTKDLKPRDCLTTSAMYKNLSKSKHCPRKISLPTYDPIVLTNSTLEIVPEASDNGMYFYTS

SEQ ID NO: 3139 - protein, 279 aa, Triticum aestivum
MATATATCLLAVWALVAAGLFGTGLARASVAPAAVGKEQREFDYFALALQWPGTICSSTRHCCAVNGCCRSEALHTFTIHGLWPDYDDGTWPSCCRHTSFDMDKITPLKPTLDKYWPSLYCSTSSTCFSGRGPFWAHEWEKHGTCSSPVVHEELQYFTTAIDLYLKYNVTEMLATGDILVSNGKEYALSDVIDTIKHAFGGSPQIICKKGSVEELRLCFTKDLKPRDCLTTSAMYKNLSKSKHCPRKISLPTYDPIVLTNSTLEIVPEASDNGLYFFTS

SEQ ID NO: 3140 - protein, 279 aa, Pseudoroegneria spicata
  misc_feature (11)..(11): Xaa can be any naturally occurring amino acid
  misc_feature (14)..(14): Xaa can be any naturally occurring amino acid
  misc_feature (28)..(28): Xaa can be any naturally occurring amino acid
MATTTTTCLLXVWXLVAAGLIGTGLARXSVAPAAVGKEQREFDYFALALQWPGTICSSTRHCCAVNGCCRSEPLHTFTIHGLWPDYDDGTWPSCCRHTNFDMDKITPLKPTLDKYWPSLYCSSSSTCFSGKGPFWAHEWEKHGTCSAPAVQEELQYFSTALDLYFKYNVTEMLATGDILVSNGKEYALSDVIDTIKHAFGGSPQIICKKGSVEELRLCFTKDLKPRDCLTTSAMYKNLSKSKHCPKKVSLPTYDPIVLTNSTLEIVPEASDNGLYFFTS

SEQ ID NO: 3141 - protein, 279 aa, Triticum aestivum
MATATATCLLAVWALVAAGLFGTGLARASVAPAAVGKEQREFDYFALALQWPGTICSSTRHCCAVNGCCRSEALHTFTIHGLWPDYDDGTWPSCCRHTSFDMDKITPLKPTLDKYWPSLYCSTSSTCFSGRGPFWAHEWEKHGTCSSPVVHEELQYFTTAIDLYLKYNVTEMLATGDILVSNGKEYALSDVIDTIKHAFGGSPQIICKKGSVEELRLCFTKDLKPRDCLTTSAMYKNLSKSKHCPKKISLPTYDPIVLTNSTLEIVPEASDNGLYFFTS

SEQ ID NO: 3142 - protein, 281 aa, Triticum aestivum
MATATATTACLLAVWSLVAAGLFGTGLARSSVAPAAVGKEQREFDYFALALQWPGTICSSTRHCCAVNGCCRSEALHTFTIHGLWPDYDDGTWPSCCRHTSFDMDKLTPLKPALDKYWPSLYCSSSSTCFSGRGAFWAHEWEKHGTCSAPVVHEELQYFTAAIDLYLKYNVTEMLATGDILVSNGKEYALSDVIDTIKHAFGGSPQIICKKGSVEELRLCFTKDLKPRDCLTTSAMYKNLSKSKHCPKKISLPTYDPIVLTNSTLEIVPEASDNGLYFYTS

SEQ ID NO: 3143 - protein, 306 aa, Triticum aestivum
ETTTHPAARGREGKGEKETPRRAEAMATATATATCLLAVWALVAAGLFGTGLARASVAPAAVGKEQREFDYFALALQWPGTICSSTRHCCAVNGCCRSEALHTFTIHGLWPDYDDGTWPSCCRHTSFDMDKLTPLKPTLDKYWPSLYCSTSSTCFSGRGPFWAHEWEKHGTCSAPVVHEELQYFTTALDLYYKYNVTEMLATGDILVSNGKEYALSDVIDTIKHAFGGSPQIICKKGSVEELRLCFTKDLKPRDCLTTSAMYKNLSKSKHCPKKISLPTYDPIVLTNSTLEIVPEASDNGLYFFTS

SEQ ID NO: 3144 - protein, 279 aa, Avena sativa
MATTTYLLVAWALVAADLFGTGLARPSASVPVAAVGKAQREFDYFALALQWPGTICSSTRHCCAINGCCRSEPLQTFTIHGLWPDYDDGTWPSCCRHTNFDMDKISTLKPKMDQYWPSLYCSTSSTCFSGKGPFWAHEWEKHGTCSSPAVDDELQYFSTALDLYFKYNVTEMLATGNIFTSNGKEYALSDVVDTIKHAFGGSPQIICKKGSVEELRLCFTKDLKPRDCLTTSLMYKNLSKAKHCPRSISLPAYDPNAFLNSTLEILPEASNSGMYFYTS

SEQ ID NO: 3145 - protein, 275 aa, Avena sativa
MATMTYLLVAWALVAADLFGTGLARPSVAEVGKAQREFDYFALALQWPGTICSSTRHCCAINGCCRSEPLQTFTIHGLWPDYDDGTWPSCCRHTNFDMDKISTLKPKMDQYWPSLYCSTSSTCFSGKGPFWAHEWEKHGTCSSPAVDDELQYFSTALDLYFKYNVTEMLATGNIFTSNGKEYALSDVVDTIKHAFGGSPQIICKKGSVEELRLCFTKDLKPRDCLTTSLMYKNLSKAKHCPRSISLPAYDPNAFLNSTLEILPEASNSGMYFYTS

SEQ ID NO: 3146 - protein, 308 aa, Triticum aestivum
NSETTTHPAARGREGKGEKETPRRAEAMATATATTACLLAVWSLVAAGLFGTGLARSSVAPAAVGKEQREFDYFALALQWPGTICSSTRHCCAVNGCCRSEALHTFTIHGLWPDYDDGTWPSCCRHTSFDMDKLTPLKPALDKYWPSLYCSSSSTCFSGRGAFWAHEWEKHGTCSAPVVHEELQYFTAAIDLYLKYNVTEMLATGDILVSNGKEYALSDVIDTIKHAFGGSPQIICKKGSVEELRLCFTKDLKPRDCLTTSAMYKNLSKSKHCPKKISLPTYDPIVLTNSTLEIVPEASDNGLYFYTS

SEQ ID NO: 3147 - protein, 303 aa, Festuca arundinacea
GTRYDPPSPEEREGKWESETPGRRAMATTKARATCLLVVWALVAADLFGTGHARASVAAVGKEQREFDYFALALQWPGTICASTRYCCAINGCCRPEPLQTFTIHGLWPDYDDGTWPSCCRETNYDADKISPLKPMMDKYWPSLYCSTSSTCFSGKGPFWAHEWEKHGTCSSPVVEDELQYFSTALDLYFKYNVTEMLATGDILISNGKEYALTDVINTIKNAFGGSPQIICKKGSVEELRLCFTKDLKPRDCLTTSALSKNLSKSSCPKNISLPTYDPNAFINSTLAVLPEASNSKMYFYTS

SEQ ID NO: 3148 - protein, 276 aa, Gossypium hirsutum
MGKGPGLYSDIGKKPRDILYKDYQADHKFTVTTYTSNGVAITSTGIKKGELLLADVSTELKNNNITTNVKVDTKSNLFATVTVDEPAPGLKTIFSFIVPDQRSGKVELQYQHEYAGISTSIGLNANPLVNFSGVVGNNCVSVGTDLSFDTASGNFTKLNAGLNFTHSDLIASLTLNDKGDTLNASYYHIVSPLTNTAVGAELTHSFSSNENTLTIGTQHALDPLTTVKARLNNYGRASGLIQHEWRPKSLFTISGDVDTRAIEKSAKVGLALALKP

SEQ ID NO: 3149 - protein, 276 aa, Gossypium hirsutum
MGKGPGLYSDIGKKPRDILYKDYQADHKFTVTTYTSNGVAITSTGIKKGELLLADVSTELKNNNITTNVKVDTKSNLFATVTVDEPAPGLKTIFSFIVPDQRSGKVELQYQHEYAGISTSIGLNANPLVNFSGVVGNNCVSVGTDLSFDTASGNFTKLNAGLNFTHSDLIASLTLNDKGDTLNASYYHIVSPLTNTAVGAELTHSFSSNENTLTIGTQHALDPLTTVRTRLNNYGRASALIQHEWRPKSLFTISGEVDTRAIEKSAKVGLALALKP

SEQ ID NO: 3150 - protein, 276 aa, Gossypium hirsutum
MGKGPGLYTDIGKKARDLLYKDYQADHKFTLTTYTSNGVAITSTGTKKGELLLADISTELKNKNITTNVKVDTSSKLFATVTVDEPAPGLKTIFSFIAPDQRSGKVELQYQHEYAGISTSIGLTANPLVNFSGVVGNNSVTVGTDLSFDTASGNFTKLNAGLNFTHSDLIASLTLNDKGDTLNASYYHIVSPLTNTAVGAELSHSFSSNENTLTIGTQHALDPLTTVKARLNNYGRASALIQHEWRPKSLITISGEVDTGAIEKSAKVGLALALKP

SEQ ID NO: 3151 - protein, 276 aa, Theobroma cacao
MGKGPGLYSEIGKKARDLLYKDYQGDHKFTVTTYTSDGVAITSTGIKKGELLLADVSTQLKNKNITTDVKVDTSSKLFTTVTVDEPAPGLKTIFSFVVPDQRSGKVELQYQHEYAGISTSIGLTANPLVNFSGVVGNNCVSVGTDLSFDTASGNFTKLNAGLNFTHSDLIASVTVNDKCDNLTASYYHIVSPLTNTAVGAELTHSFSSNENTLTFGTQYELDPLTTVKARWNNFGRASALIQHEFRPKSLLTISGEVDTRAIEKSAKVGMALLLKP

SEQ ID NO: 3152 - protein, 276 aa, Theobroma cacao
  misc_feature (250)..(250): Xaa can be any naturally occurring amino acid
MGKGPGLYSEIGKKARDLLYKDYQGDHKFTVTTYTSDGVAITSTGIKKGELLLADVSTQLKNKNITTDVKVDTSSKLFTTVTVDEPAPGLKTIFSFVVPDQRSGKVELQYQHEYAGISTSIGLTANPLVNFSGVVGNNCVSVGTDLSFDTASGNFTKLNAGLNFTHSDLIASVTVNDKCDNLTASYYHIVSPLTNTAVGAELTHSFSSNENTLTFGTQYELDPLTTVKARWNNFGRASALIQHEFRPKSXLTISGEVDTRAIEKSAKVGMALLLKP

SEQ ID NO: 3153 - protein, 276 aa, Castanea mollissima
MVKGPGLYSDIGKKARDLLYKDYQSDHKFTVTTYTSTGVAITSTGIKKGELFLADVSTQLKNKNITTDIKVDTNSNLLTTVTIDEPAPGLKTIFSFIVPDQRSGKVELQYQHEYAGISTGIGLTANPIVNFSGVIGNNVVSLGTDLAFDTASGNFNKLNAGLSYTQSDLIASLTVNDKGDTLNASYYHIVSPLTSTAVGAELSHSFSTNENTLTIGTQHALDPLTSVKARVNNYGRASALIQHEWRPKSLFTISGEVDTRAIEKSAKIGLALALKP

SEQ ID NO: 3154 - protein, 276 aa, Quercus alba
MVKGPGLYSDIGKKARDLLYKDYQSDHKFTVTTYTSTGVAITSTGIKKGELFLADVSTQLKNKNITTDIKVDTNSNLLTTVTVDEPAPGLKTIFSFIVPDQRSGKVELQYQHEYAGISTSIGLTANPIVNFSGVIGNNVVSLGTDLAFDTASGNFNKLNAGLSYTQSDLIASLTVNDKGDTLNASYYHIVSPLTSTAVGAELSHSFSSNENTLTIGTQHALDPLTSVKARVNNYGRASALIQHEWRPKSLFTISGEVDTRAIEKSAKIGLALALKP

SEQ ID NO: 3155 - protein, 276 aa, Unknown
  Sequence found in Organisms: Citrus sinensis, Citrus clementina
MVKGPGLYSEIGKKARDLLYKDYQSDHKFTVTTYTSAGVAITSSGVKKGELFLADVSTQLKNKNITTDVKVDTNSNLFTTITVDEPAPGLKSIFSFIVPDQRSGKVELQYQHEYAGISTGIGFTANPIVNFSGVVGNNSVALGTDLSFDTATGNFTKCNAGLSYTHTDLIASLTLNDKGDTLNASYYHIVSPLTNTAVGAELTHSFSSNENTLTIGTQHALDPLTSVKARVNNYGRASALIQHEWRPKSLFTISGEVDTRAIEKSAKIGLALALKP

SEQ ID NO: 3156 - protein, 276 aa, Citrus sinensis
MVKGPGLYSEIGKKARDLLYKDYQSDHKFTVTTYTSAGVAITSSGVKKGELFLADVSTQLKNKNITTDVKVDTNSNLFTTITVDEPAPGLKSIFSFIVPDQRSGKVELQYQHEYAGISTGIGFTANPIVNFSGVVGNNSVALGTDLSFDTATGNFTKCNAGLSYTHIDLIASLTLNDKGDTLNASYYHIVSPLTNTAVGAELTHSFSSNENTLTIGTQHALDPLTSVKARVNNYGRASALIQHEWRPKSLFTISGEVDTRAIEKSAKIGLALALKP

SEQ ID NO: 3157 - protein, 276 aa, Momordica charantia
MGKGPGLYSDIGKKARDLLYKDYQSDHKFTVTTYTSGGVAISSTGVKKGELFLADVSTQLKNNNITTDIKVDTNSNVHTTVTIDEPAPGLKTIFSFRVPDQRSGKVDLQYQHEYAGISTGIGLTASPIVNFSGVVGNDKLSLGTDLSFDTASGNITKLNAGLSYTHSDLIAALTLNDKGDALTASYYHLVSPLSNTAVGAELSHSFSSNENTLTIGTQHALDPLTSVKARVNNYGRASALIQHEWRPKSLFTISGEVDTRAIEKSAKIGLALALKP

SEQ ID NO: 3158 - protein, 276 aa, Cucumis sativus
MGKGPGLYSDIGKKARDLLYKDYQSDHKFTVTTYTSGGVAISSTGIKKGEIFLADVSTQLKNNNITTDVKVDTHSNVHTTVTIDEPAPGLKTIFSFRVPDQRSGKVELQYQHEYAGISTGIGLTASPIVNFAGVIGNDKLSLGTDLSFDTASGNITKLNAGLSYTHSDLIAALTLNDKGDALTASYYHLVSPLSNTAVGAELSHSFSSNENTLTIGTQHALDPLTSVKARVNNYGRASALIQHEWRPKSLFTISGEVDTRAIDKSAKIGLALVLKP

SEQ ID NO: 3159 - protein, 276 aa, Carica papaya
MGKGPGLYSDIGKKARDLLYKDYQSDHKFTLTTYTSTGVAITSNGIKKGELFLADVSTQLKNKNITTDVKVDTKSNLFTTITVDEPAPGLKTIFSFIVPDQRSGKVELQYQHEYAGISTSIGLTANPIVNFSGVIGNNSVAVGTDLSFDTATGNFTKCNTGLSYTTSDLIASLTLNEKADTLNASYYHVVSPLTNTAVGAELTHTFSSNENTLTVGTQHALDPLTTVKARVNNYGRASALIQHEWRPRSLFTISGEVDTRAIEKSAKVGLALAIKQ

SEQ ID NO: 3160 - protein, 157 aa, Quercus alba
MAKGPGLYSEIGKKTRDLLYKDYQTDHKFTITTYSPTGVAITSSGIKKGELFLADVNTQLKNKNITTDVKVDTNSNLFTTITIDEPAPGLKTIFSFRVPDQRSGKVELQYLHDYAGISTSIGLTANPIVNFSGVIGNNVVPLGLILHLTLPLGTSTS

SEQ ID NO: 3161 - protein, 276 aa, Cucumis melo
MGKGPGLYSDIGKKARDLLYKDYQSDHKFTVTTYTAGGVAISSTGVKKGDIFLADVSTQLKNNNITTDVKVDTHSNVHTTVTIDEPAPGLKTIFSFRVPDQRSGKVELQYQHEYAGISTGIGLTASPIVNFAGVIGNEKLSLGTDLSFDTASGNITKLNAGLSYTHSDLIAALTLNDKGDALTASYYHLVSPLSNTAVGAELSHSFSSNENTLTIGTQHALDPLTSVKARVNNYGRASALIQHEWRPKSLFTISGEVDTRAIDKSAKIGLALALKP

SEQ ID NO: 3162 - protein, 276 aa, Camellia sinensis
MGKGPGLYSDIGKKARDLLYRDYQSDHKFTVTTYTSTGVAITTSGTKKGELYLADVTTQLKNKNITTDIKVDTNSNVLTTITIDEPAPGLKTIFSFIVPDQRSGKVELQYLHEYAGISTGIGLTASPIVNFSGVVGNDVVSLGTDLSFDTVTGNFTKCNAGLNFSKSDLIASLALNDKGDTVTASYYHTVSPLTNTAVGAELTRSFSKNENTLTIGTQHALDPLTTVKARVNSYGKASALIQHAWRPKSLFTISGEVDTTAIEKSAKIGLALALKP

SEQ ID NO: 3163 - protein, 214 aa, Cucumis melo
  misc_feature (172)..(172): Xaa can be any naturally occurring amino acid
  misc_feature (190)..(191): Xaa can be any naturally occurring amino acid
MGKGPGLYSDIGKKARDLLYKDYQSDHKFTVTTYTAGGVAISSTGVKKGDIFLADVSTQLKNNNITTDVKVDTHSNVHTTVTIDEPAPGLKTIFSFRVPDQRSGKVELQYQHEYAGISTGIGLTASPIVNFAGVIGNEKLSLGTDLSFDTASGNITKLNAGLSYTHSDLIAXLTLNDKGDALTASYYHLXXPLSNTAVGAELSHSFSSNETLSL

SEQ ID NO: 3164 - protein, 276 aa, Eucalyptus grandis
MAKGPGLYSDIGKKARDLLYKDYQGDHKFTITTYTSTGIALTSTGIKKGEFFLADVSTQLKNKNITTDVKVDTNSNLLTTITVDEPAPGLKTIFSFIVPDQRSGKVELQYQHEYAGISTSIGLTANPIVNFSGVVGNNLLALGTDLSFDTASGNFTKCNAGLSFTNSDLIASLTLNDKGDTLSASYYHTVSPLTSTAVGAELSHSFSSNENMLTIGTQHALDPLTNVKARVNNYGRASALIQHEWRPKSLFTISGEVDTRAIEKSAKIGLALALKP

SEQ ID NO: 3165 - protein, 276 aa, Prunus persica
MVKGPGLYLDIGKKARDLLYKDYQSDHKFTVTTYTSTGVAISSTGIRKGDLYLGDVSTQLKNKNITTDVKVDTDSNLRTTITIDEPAPGLKAIFSFIVPDQRSGKVELQYQHEYAGISTGIGLTANPIVNFSGVVGNNLLSLGTDLSFDTASGNFTKWNAGLNFTHTDLIASLILNDKADTVTASYYHTVSPLTNTAVGAELSHSFSSNENSLTIGTQHALDPLTTVKGRVNNYGRASALIQHEWRPKSFFTISGEVDTRAIEKSAKIGLALALKP

SEQ ID NO: 3166 - protein, 276 aa, Malus domestica
MVKGPGLYFDIGKKARDLLYKDYQSDHKFTVTTYTSTGVAISSTGIRKGELYLGDVSTQLKNKNITTDVKVDTNSNLLTTITIDEPAPGLKAIFSFIAPDQRSGKVELQYQHEYAGISTSIGLTANPIVNFSGVVGNNLLSLGTDLSFDTASGNFTKVNAGLNFTHSDLIASLLLNDKADTITASYYHTVSPLTNTAVGAELSHSFSSNENSLTIGTAHALDPLTTVKARVNNYGRASALIQHEWRPKSFFTISGEVDTRAIEKSAKIGLALALKP

SEQ ID NO: 3167 - protein, 276 aa, Populus trichocarpa
MGKGPGLYVDIGKKARDLLYKDYQSDHKFTVTTYTSTGVALTSTGIKKGELFLADVSGQLKNKNITTDIKVDTNSNLLTTITIDEPAPGLKTIFSFKVPDQRSGKVELQYQHEYAGISTSLGLTANPIVNFSGVIGSNVVSLGTDLSFDTATGNFTKYNAGLSYTNADLIASLTVNDKGDTLTASYYHTVRPLTSTAVGAELTRSFSSNENTLTIGTQHALDPLTTVKARLNNYGKASALIQHEWRPKSLFTISGEVDTKAIEKSAKIGLALALKP

SEQ ID NO: 3168 - protein, 276 aa, Eschscholzia californica
MVKGPGLYTDIGKKARDLLYRDYQSDHKFTLTTYTSSGVAITSSGTKKGELFLADVNTQLKQKNITTDVKVDTNSRLFTTITVDEPAPGIKTIFSFIVPDQRSGRVELQYQHEYAGISSSIGLTANPVVNFSGVFGSNLCALGTDVAFDTASGNFTKYNAGLSFTHSDLIASLTLNDKGDTLNASYYHIVSPLTNTAVGAELTHSFSSNENTLTIGTQHALDPLTTVKARLNNFGKASALIQHEWRPKSLFTISGEVDTKAIEKSAKVGLALALKP

SEQ ID NO: 3169 - protein, 276 aa, Prunus persica
MVKGPGLYLDIGKKARDLLYKDYQSDHKFTVTTYTSTGVAISSTGIRKGDLYLGDVSTQLKNKNITTDVKVDTDSNLRTTITIDEPAPGLKAIFSFIVPDQRSGKVELQYQHEYAGISTSIGLTANPIVNFSGVVGNNLLSLGTDLSFDTASGNFTKWNAGLNFTHTDLIASLILNDKADTVTASYYHTVSPLTNTAVGAELSHSFSSNENSLTIGTQHALDPLTTVKGRVNNYGRASALIQHEWRPKSFFTISGEVDTRAIEKSAKIGLALALKP

SEQ ID NO: 3170 - protein, 276 aa, Ricinus communis
MGKGPGLYTDIGKKARDLLYKDYQGDHKFTVTTYTSTGVAITSTGIKKGEIYLGDITSQLKNKNITTDIKVDTSSNVSTTITVDEPAPGLKTIFSFKIPDQRSGKVELQYQHEHAGISTSIGLTANPIVNFSGVIGSSAVALGTDLSFDTASGNFTKLNAGLSYSNTDLIASLTLNDKGDTLNASYYHIVSPLTNTAVGAELTHSFSSNENTLTFGTQHALDPLTTVKARVNSYGKASALIQHEWRPKSLFTISGEVDTRAIEKSAKIGLALALKP

SEQ ID NO: 3171 - protein, 276 aa, Coffea canephora
MVEGPGLYSDIGKRARDLLYKDYQGDHKFTVTTYTANGVAITSSGIKKGELFLADVNTQLKNKNITTDVKVDTNSKVFTTITVDEPAPGLKTIISFVVPDQRSGKVELQYLHEYAGISTGIGLTANPIVNFSGVAGNDKLALGADLSFDTATGNFTKYNAGFSFTNSDLIAALTLNDKGDTLTASYYHSVSPLTNTAVGAELSHGFSSNENTLTIGTQHSLDPLTTLKARVNNYGKASALIQHEWRPKSLFTISGEVDTRAIEKSAKIGLAVALKP

SEQ ID NO: 3172 - protein, 276 aa, Populus trichocarpa
MGKGPGLYFDIGKKARDLLYKDYQSDHKFTVTTYTSAGVAITSTGIKKGELFLADISSQLKNKNITTDVKVDTNSNLLTTITIDEPAPGLKTIFSFKVPDQRSGKVELQYQHEYAGISTSLGLTANPIVNFSGVVGSNVVALGTDLSFDTATGNFTKCNAGLSYTNSDLIASLTVNDKGDTLSASYYHTVSPLTSTAVGAELTHSFSSNENILTIGTQHALDPLTTVKARLNNYGKVSALIQNEWRPKSLFTISGEVDTKAIEKSAKVGLALSLKP

SEQ ID NO: 3173 - protein, 276 aa, Nicotiana tabacum
MVKGPGLYSNIGKKARDLLYRDYVSDHKFTVTTYTSNGVAITSSGVKKGEFLLADVNTQLKNKNFTTDVKVDTNSNVYTTITVDEPAPGLKTIFSFVVPDQKSGKVELQYLHEYAGISTSIGLAASPLVNFSGVAGNNKIALGTDLSFDTSSGNFTKCNAGLNFTTSDLIASLALNDKGDTLSASYYHTVNPLTNTAVGAELTHSFSSNENTMTIGTHHSLDPLTTVKARVNSYGKASALIQHEWRPKSLFTISGDVDTRAIEKSAKVGLAVALKP

SEQ ID NO: 3174 - protein, 276 aa, Malus domestica
MVKGPGLYLDIGKKARDLLYKDYQSDHKFTVTTYTSTGVAISSTGIRKGDLYLGDVSTQLKNKNITTDVKVDTNSNVITTITVDEPSPGLKAIFSFIAPDQRSGKVELQYQHEYAGISTSIGLTANPIVHFSGVVGNNLLSLGTDLSFDTASGNFTKVNAGLNFTHSDLIASLLLNDKADTITASYYHTVSPLTNTAVGAELSHSFSSNENSLTIGTAHALDPLTTVKARVNNYGRASALIQHEWRPKSFFTISGEVDTRAIEKSAKVGLALALKP

SEQ ID NO: 3175 - protein, 276 aa, Liriodendron tulipifera
MVKGPGLYSDIGKKARDLLYKDYQSDHKFNLTTYTATGVAITASGTKKGELFLADVNTQLKNKNITTDVKVDTNSNLFTTITIDEPAPGLKTIFSFIIPDQRSGKVELQYVHDYAGISTSIGLTANPIVNFSGVVGSSGLSVGTDLSFDTASGNFTKYNAGLSFASDDLIASLILNDKGDTLTASYYHMVSPLSNMAVGAELSHSFASNDNTLTIGTQHALDPLTTVKARLNNYGKASALIQHEWRPKSLFTISGEVDTRAIEKNAKIGLALALKP

SEQ ID NO: 3176 - protein, 276 aa, Nicotiana tabacum
MVKGPGLYSDIGKKARDLLYRDYVSDHKFTVTTYSSTGVAITSSGLKKGELFLADVNTQLKNKNVTTDVKVDTNSNVYTTITVDEPAPGLKTIVSFVLPDQKSGKVELQYLHEYAGISTGIGLTASPLVNFSGVAGNNTVALGTDLSFNTASGNFTKCNAGLSFSTSDLIASLALNDKGDTLSASYYHTVKPVTNTAVGAELTHSFSSNENTLTIGTQHLLDPLTTVKARVNSYGKACALIQHEWRPKSLFTISGEVDTRAIEKSAKIGLAVALKP

SEQ ID NO: 3177 - protein, 268 aa, Manihot esculenta
MGKGPGLYSDIGKKARDLLYKDYQADQKVTLTTYTSTGVAITSSGTKKGELFLADVSSQFKNKNITTDVKVDTNSNLFTTITVDEPAPGLKSIFSFRVELQYQHEYAGISTSIGLTAKPIVNFSGVIGNNVIALGTDLSFDTATGNFTKLNAGLSYTNADIITSLTLNDKGDTLNASYYHTVSPLTNTAVGAELTHSFSSNEKTLSIGTQHALDPLTTVKARVNNYGRASALIQHEWRPKSLFTISGEVDTRAIEKSAKIGLALALKP

SEQ ID NO: 3178 - protein, 276 aa, Vitis vinifera
MGKGPGLYSDIGKIARDLLYRDYQSDHKFTVTTYTSSGVAITSSGTKKGELFIADVNTQLKNKNITTDVKVDTNSNLFTTITVDEPAPGLKTIFSFIIPDQRSGKVELQYLHEYAGISTSIGLTANPIVNFSGVVGNNTLSLGTDLSFDTATGNFTKCNAGLGFSNADLIAALTLNDKGDTLNASYYHTVSPLTNTAVGAELSHCFSTNENTLTIGTQHALDPLTKVKARANNSGKVSALIQHEWRPKSLFTISGEVDARAVEKSAKIGLALALKP

SEQ ID NO: 3179 - protein, 276 aa, Euphorbia esula
  misc_feature (27)..(27): Xaa can be any naturally occurring amino acid
  misc_feature (54)..(54): Xaa can be any naturally occurring amino acid
MGKGPGLYTDIGKKARDLLYKDYQGDXKFTVTTYASNGVAITSSGIKKGELFLXDVSSQLKNKNITTDVKVDTASNLFTTITIDEPAPGLKTIFSFKVPDQRSGKIELQYQHDYAGISTAIGLTANPIVNFSGVVGKNSIALGTDLSFDTASGNFTKVNAGLTYNHGDLIAALTLNDKGDSLNASYYHIVSPLTNTAVGADFTHNFSSNENTLTIGTQHALDPLTSVKARVNSFGKASALIQHEWRPKSLFTISGEVDTRAIEKSAKIGLALALKP

SEQ ID NO: 3180 - protein, 276 aa, Petunia hybrida
MVKGPGLYTDIGKKARDLLYRDYVSDHKFTLPTYTSNGVAITSSGMKKGEFLLADVNTQLKNKNITTDVKVDTNSNVYTTITVDEPAPGLKTIFSFVVPDQKSGKVELQYLHEYAGISTSIGLAASPLVNFSGVAGNNTIALGTDLSFDTSSGSFTKCNVGLNYTASDLIASLAVNDKGDTLTGSYYHIVNPLTNTAVGAELTHSLSSNENTLTVGTHHSLDPLTTVKARVNNYGKASALIQHEWRPKSLFTISGEVDTRAIEKSAKIGLAVSLKP

SEQ ID NO: 3181 - protein, 276 aa, Unknown
  Sequence found in Organisms: Solanum tuberosum, Solanum phureja
MVKGPGLYSDIGKKARDLLYRDYVSDHKFTVTTYSTTGVAITASGLKKGELFLADVSTQLKNKNITTDVKVDTNSNVYTTITVDEPAPGLKTIFSFVVPDQKSGKVELQYLHEYAGINTSIGLTASPLVNFSGVAGNNTVALGTDLSFDTATGNFTKCNAGLSFSSSDLIASLALNDKGDTVSASYYHTVKPVTNTAVGAELTHSFSSNENTLTIGTQHLLDPLTTVKARVNSYGKASALIQHEWRPKSLFTISGEVDTRAIEKSAKIGLAVALKP

SEQ ID NO: 3182 - protein, 276 aa, Helianthus annuus
MVKGPGLYPDIGKKARDLLYKDYQSDHKFTLTTYTANGVAITSSGAKKGELFLADVSTKLINKNITTDVKVDTNSKLFTTITIDEPAPGLKTIFSFVVPDQRSGKVELQYLHEYAGISTSIGLTASPLVNFSGVAGNNTVALGTDVCFDTASGNFTKYNAALSFSTSDLIASLILNDKADTLTASYYHTVSPLTNTAVGAELSHGFSSNENSLTIGTQHSLDPLTTVKARVNNAGIASALLQHEWRPKSVLTISGEVDTRAIEKSAKVGLALALKP

SEQ ID NO: 3183 - protein, 276 aa, Tragopogon dubius
MGKGPGLYPDIGKKARDLLYKDYQSDHKFTLTTYAANGVAITSSGAKKGELFLADVSTKLINKNITTDVKVDTNSKVFTTITIDDAAPGLKTIFSFVAPDQRSGKVELQYLHEYAGISTGIGLTASPIVNFSGVAGNNTVSLGTDVSFDTASGNFTKYNAALSFTSSDLIASLILNDKADTLTASYYHTVSPLTNTVVGAELSHGFSSNENSLTIGTQHSLDPLTTVKARVNNAGIASALLQHEWRPKSLFTISGEVDTRAIEKSAKVGLALALKP

SEQ ID NO: 3184 - protein, 276 aa, Liriodendron tulipifera
MSKGPGLYSDIGKKARDLLCKDYQSDHKFTITTYTSTGVAITSTGIKKGELFLADINTQLKNKNITTDIKVDTNSNLFTTITVNEPAPGLKTIVSFIVPDQKSGKVELQYLHDYAGIATSIGLTANPVVNFSGVVGSNVLAVGADLSFDTASGNFTKYNAGLSYSNADLIASLTLNDKGDNLKASYYHTVRPLTSTAVGAELSHSFTSNENTLTIGTQHALDPLTSVKARVNNYGKASALIQHEWRPKSLFTISGEVDTRAIEKSAKIGLALALKP

SEQ ID NO: 3185 - protein, 275 aa, Petunia hybrida
MKGPGLYSDIGKKARDLLYRDYVSDHKFTVTTYSTTGVAITSSGLKKGELFLADVNTQLKNKNITTDVKVDTLSNVYTTITVDEPAPGLKTIFSFVVPDQKSGKVELQYLHEFAGINTSIGLTASPLVHFSGVAGNNTVALGTDVSFNTATGNFTKCNAGLSFSTSDLIASLALNDKGDTLTASYFHTVKPLTNTAVGAELTHSFSSNENTLTVGTQHLLDPLTTVKARVNNYGKASALIQHEWRPRSLFTISGEVDTRAIEKSAKIGLAVALKP

SEQ ID NO: 3186 - protein, 276 aa, Solanum lycopersicum
MVKGPGLYSDIGKKARDLLYRDYVSDHKFTITTFSTTGVAITSSGLKKGELFLADVSTQLKNKNITTDVKVDTNSNLYTTITVDEPAPGLKTIFSFVVPDQKSGKVELQYLHEYAGINTSIGLTASPLVNFSGVAGNNIVALGTDVSFDTATGNFTKCNAGLSFSSSDLIASLALNDKGDTVSASYYHTVKPVTNTAVGAELTHSFSSNENTLTIGTQHLLDPLTTVKARVNSYGKASALIQHEWRPKSLFTISGEVDTRAIEKSAKIGLAVALKP

SEQ ID NO: 3187 - protein, 289 aa, Lactuca sativa
AGIQFLKHEEQKRWGKVQVSTPDIGKKTRDLLYRDYQSDHKFSLTTYTANGVSITSSGAKKGELFLADVNTKLINKNITTDVKVDTNSKVFTTITIDEPAPGLKTIFSFVVPDQRSGKVELQYLHEHAGISTSIGLTASPIVNFSGVAGNNTVAVGTDISFDTASGNFTKYNAGLSFSTSDLIASLTLNDKGDTLTGSYYHTVSPLTNTAVGAELTHGFSSNENSLTFGTQHSFDPLTMVKARVNNFGIASALIQHEWRPKSVFTISGEVDTRAIEKSAKVGLALALKP

SEQ ID NO: 3188 - protein, 276 aa, Centaurea maculosa
  misc_feature (253)..(253): Xaa can be any naturally occurring amino acid
MGKGPGLYPDIGKKARDLLYKDYQGDHKFTITTYTANGVAITASGAKKGELILADVNTKLINKNITTDVKVDTNSKLFTTVTIDEAAPGLKTIFSFVAPDQRSGKVELQYLHEYAGISTSIGLTASPIVNFSGVAGNNTVALGTDVSFDTASGNFTKYNAALSFSTSDLIASLTVNDKADSVTASYYHIVRPLTNTAVGAELSHGFSSNENSLTIGTQHSLDPLTTVKTRVNNSGIASALLQHEWRPKSLFTXSGEVDTRAIEKSAKVGLALALKP

SEQ ID NO: 3189 - protein, 276 aa, Cichorium intybus
MGKGPGLYPDIGKKARDLLYRDYQSDHKFTLTTYAANGVAITSSGSKKGELFLADVSTKLVNKNITTDVKVDTNSKLFATITIDEAAPGLKTIFSFVAPDQKSGKVELQYLHEYAGISTSIGLTASPMVNFSGVAGNNTVSLGTDVSFDTASGNFTKYNAALSFTTSDLIASLILNDKADTLTASYYHTVSPLTNTVVGAELSHGFSSNENSLTIGTQHLLDPLTMVKARVNNAGIASAVLQHEWRPKSLFTISGEVDTRAIEKSAKVGLALALKP

SEQ ID NO: 3190 - protein, 276 aa, Coffea canephora
MVKGPGLYSDIGKRARDLLYKDYQGDHKFSVTTYSPNGVAITASGLKKGELFLGDVNTQLKNKNITTDFKVDTNSKVFTTITVDEPAPGLKTIFSFVVPDQRSGKVELQYLHEYAGISSSIGLTANPIVNFSGVAGNDKLALGTDVSFDTATGNFTKYNAGLSFTNSDLIAALTLNDKGDTLTASYYHSVSPLTNTAVGAELSHSFSTNENSLTLGTQHLLDPLTTVKARVNNYGKASALIQHEWRPKSLLTISGEVDTRAIEKSAKIGLAVALKP

SEQ ID NO: 3191 - protein, 276 aa, Solanum melongena
MVKGPGLYSDIGKKARDLLYRDYVSDHKFTITTYSSTGVAITSSGLKKGELFLADVSTQLKNKNITTDVKVDTNSNVYTTITVDEPAPGLKTIFSFVVPDQKSGKVELQYLHEYAGINTNIGLAASPLVNFSGVAGNNTVALGTDVSFDTATGNFTKCNAGLSFSTSDLIASLALNDKGDTVNASYFHTVKPLTNTAVGAELTHSFSSNENTLTIGTQHLLDPLTMVKARVNSYGKASALIQHEWRPKSLFTISGEVDTRAIEKSAKIGLAVALKP

SEQ ID NO: 3192 - protein, 276 aa, Lotus japonicus
MVKGPGLYSDIGKKARDLLFKDYQNDHKFTITTYTSAGVEITSTGVKKGEIYLADVSTKLKNKNITTDVKVDTNSNLHTTITVDEPAPGLKTIFSFIFPDQKSGKVELQYQHEYAGISTSIGLTASPIVNFSGIIGNNLVAVGTDLSFDTASGNFTKYNAGLNVTHADLIASLTLNDKGDSLNASYYHVVSPLTNTAVGAELSHSFSSNENILTIGTQHALDPITLLKARVNNYGRASALIQHEWNPRTRVSLVGEVDTGAIEKSAKVGLALALKP

SEQ ID NO: 3193 - protein, 276 aa, Parthenium argentatum
MVKGPGLYPDIGKKARDLLYKDYQSDHKFSLTTYTANGAAITSSGAKKGELFLADVSTKLINKNITTDVKVDTNSKLYTTITIDEPAPGLKTIFSFVVPDQRSGKVELQYLHEYAGISTSIGLTASPLVNFSGVAGNNTVALGTDVCFDTATGNFTKYNAALSFSTSDLIASLILNDKADTLTASYYHTVSPLTNTAVGAELSHGFSSNENSLTIGTQHSLDPLTTVKARVNNAGIASALLQHEWRPKSLLTISGEVDTRAIEKSAKVGLALALKP

SEQ ID NO: 3194 - protein, 276 aa, Cajanus cajan
MVKGPGLYTDIGKRARDLLFKDYQNDHKFTITTYTSTGVEITSTGVRKGEIYLADVSTKLKNKNITTDVKVDTNSNLRTTVTVDEPAPGLKTIFSFIFPDQKSGKVELQYQHEYAGISTSIGLTANPIVNFSGVVGNNLVSVGTDLSFDTASGNFTKYNAGLNISHADLIASLTLNDKGDTLNASYYHIVSPLTNTAVGAELSHSFSSNENLLTIGTQHALDPLTLLKARVNSYGRASALIQHDWTPRARFSLVGEVDTGAIGKSAKVGLAVALKP

SEQ ID NO: 3195 - protein, 276 aa, Capsicum annuum
MVKGPGLYSDIGKKARDLLYRDYVSDHKFTVTTYSTTGVAITSSGLKKGELFLADVSTQLKNKNITTDVKVDTNSNVYTTITVDEPAPGLKTIVSFVIPDQKSGKVELQYLHEYAGINTSIGLTASPLVNFSGVAGNNTVALGTDLSFDTATGNFTKCNAGLSFCTADLIASLALNDKGDTISASYYHTVKPVTNTAVGAELTHSFSGNENTLTIGTQHLLDPLTTVKARVNSYGKASALIQHEWRPKSLFTISGEVDTRAIEKSAKIGLAVALKP

SEQ ID NO: 3196 - protein, 276 aa, Quercus alba
MAKGPGLYSEIGKKTRDLLYKDYQADHKFTITTYSPTGVAITSSGTKKGELFLADVNTQLKNKNITTDVKVDTNSNLFTTITIDEPAPGLKTIFSFRVPDQRSGKVELQYLHDYAAISTSVGLTANPVVNFSGVIGTNLVGLGTDLSFDTKTGNFTKVNTGLSFSNADLIAALTVNDKGDTLNASYYHTVNPLTKTAVGAEVSHSFSTNENTITVGTQHALDPLTTVKARVNNFGKASALIQHEWRPKSLFTISGEVDTRAIEKSAKVGLALALKP

SEQ ID NO: 3197 - protein, 276 aa, Arachis hypogaea
MVNGPGLYSDIGKKARELLFKDYQNDHKFTITTYTSTGVEITSTGIRKGEIYLADVNTKLKNKNITTDIKVDSNSNLLTTVTVDEPAPGLKSIFSFIFPDQKSGKVELQYRHEYAGISTSLGLTATPIVNFSGVVGNDLVAVGTDLSFDTASGNFIKYNAGLNFTHADLIASLTVNDKGDTVNASYYHVVSPLTNTAVGAELSHSFSSNENMLTIGTQHALDPLTLVKARVNNYGRANAVIQHDWNPRTRVSLSGEVDTGAIEKSAKVGLAVALKP

SEQ ID NO: 3198 - protein, 223 aa, Persea americana
MAKGPGLYFDIGKKARDLLYKDYQCDQKFTLTTYTSTGVAITSTGIKKGELFLADINTQLKNKNITTDIKVDTNSNLFTTITVDEPAPGLKTIFSFIVPDQRSGKVELQYLHDYAGINTSIGLTANPVVNFSGVIGSGAVALGADVAFDTATGNFTKYNAGFNFTNADLITSLTLNDKGDTLRASYYHTVSPLTNSAVVQSCPTASQVMTIPSPSGPSMHWIH

SEQ ID NO: 3199 - protein, 276 aa, Ipomoea nil
MVKGPGLYSDIGKKAKDLLYRDYVADHKFTITTYSATGVAITSSGVKKGELLVADVNTQLKNKNITTDLKVDTNSKLYTTITVDEPAPGLKTIISFVAPDQKSGKVELQYLHEYAGISTSIGLTASPLVSFSGVAGNNTLALGTDVSFDTATGKFTKYNAGLSFSTSDLIASLTLNDKGDFLGASYYHTVRPLTNTAVGAELTHSFSSNENTLTIGTQHKLDPATTVKAKVNNFGKAHALIQHEWRPKSLFTISGEVDTRAIEKSAKIGLAVALKP

SEQ ID NO: 3200 - protein, 276 aa, Lactuca sativa
MGKGPGLYPDIGKKARDLLYRDYQGDHKFSLTTYTANGVSITSSGAKKGELFLADVNTKLINKNITTDVKVDTNSKVFTTITIDEAAPGLKTIFSFVVPDQRSGKVELQYLHEHAGISTSIGLTASPIVNFSGVAGNNTVAVGTDISFDTASGNFTKYNAGLSFSTSDLIASLTLNDKGDTITASYYHTVSPLTNTAVGGELTHGFSSNENSLTFGTQHSLDPLTMVKARVNNFGIASGLLQHEWRPKSVFTISGEVDTRAIEKSAKVGLALAFKP

SEQ ID NO: 3201 - protein, 68 aa, Tropaeolum majus
MGKGPGLYSDIGKIARDLLYRDYQNDHKFTLTTYTSNGVGITTNGIKKGELLLADLSTQLKTKISLLM

SEQ ID NO: 3202 - protein, 276 aa, Fragaria vesca
MVKGPGLYSDIGKKARDLLYRDYQTDHKFTVTTLTASGVAITSSGIKKGDLLLGDVSTQLKNKNITTDVKVDTNSNLLATITVDEPAPGLKAILSFIVPDQKSARVELQYQHEYAGISTSLGLTANPVINFSGVVGNAALSLGTDVSFDTASGNLTKLNAGLNFIHTDLIASLLVNDKGDTLTASYYQTVSPITCTAVGAELSHSFSSNENTFTIGTQHALDPLTSVKARVNNYGRASALIQHEWRPKSLFTISGEVDTRAIEKSAKIGLALALKP

SEQ ID NO: 3203 - protein, 276 aa, Senecio madagascariensis
MAKGPGLYPDIGKKARDLLYRDYQSDHKFSLTTFTANGVSITSSGAKKGDFFLADVNTKLVNKNITTDVRVDTSSKVFTTITVDEPAPGLKTIFSFVVPDQKSGKVELQYLHENAGISTSIGLTASPIVNFSGVAGNNAVALGTDISFDTATGNFTKYNAGLSFSTSDLIASLTLNDKADTLVASYYHTVSPLTNTAVGAELTHGFSSNENSLTIGTQHSLDPLTTVKARVNNFGIASALLQHEWRPKSLFTISGEVDTRAIEKSAKVGLALALKP

SEQ ID NO: 3204 - protein, 276 aa, Helianthus annuus
MVKGPGLYTDIGKKARDLLYKDYQSDHKFTLTTYAANGVAITSSGAKKGELFLADVSTKLINKNITTDVKVDTNSKLFTTITIDEPAPGVKSIFSFVVPDQRSGKVELQYLQEYAGISTSIGLTASPVVNFSGVAGNDTLALGTDVSFDTATGNFTKYNGALSFTTSDLIASLILSDKADTLTASYYHTVSPLTNTAVGAELSHGFSSNENTLTIGTQHSLDPLTTVKARVNNAGIASALLQHEWRPKSLVTISGEVDTRAIDKSAKVGLALALKP

SEQ ID NO: 3205 - protein, 360 aa, Solanum phureja
MAQATPNHTQTVAGWAAHDSSGKITPFNFKRRENGENDVTIEILYCGICHTDIHHVKDDWGITKYPVVPGHEITGIITKVGSNVSKFKMGDRVGVGCLAATCLKCEYCEESQENYCDQVEFTYNGIFWDGSITYGGYSKMLVADHRYVVRIPDNMAMDRAAPLLCAGITVFTPLKDNNLVDTKGKKIGIIGLGGLGHVAVKFGKAFGHHVTVISTSPIKEQEAKDNLGADDFIISTNPKQMLEKKRTLDFILDTVSAKHSLGSYLELLKVNGTLVIVGAPDKPIDLPAFPMIFGKRTVKGSMIGSIEETQEMMDLCGKHNILSDIEIITTDQINEGLERLAKNDVKYRFVIDIAGPSSHL

SEQ ID NO: 3206 - protein, 361 aa, Capsicum annuum
MAQTAPNHTQTVYGWAAHDSSGKITPFIFKRRENGENDVTIEILYCGMCHTDVHHVKDDWGITVYPVVPGHEITGIITKVGSKVRKFQIGDKVGVGGLAATCLKCEYCENSQENYCDQVQCTYNGIFWDGSITYGGYSKMLVADHRYVVRIPDNMAMDRAAPLLCAGITVYTPLKDNNLVDTKGKKIGVIGLGGLGHVAVKFGKAFGHHVTVISTSPSKEQEAKETLGADDFILSTNPKRMQAKKRTLDFILDTVSAKHSLGSYLELLKVNGTLVIVGAPHKPIDLPAFPMIFGKRIVKGSMIGSIEETQEMMDLCGKHNILSDIEIITTDQINEGLDRLVNNDVKYRFVIDIAGGQSSQL

SEQ ID NO: 3207 - protein, 356 aa, Nicotiana tabacum
  misc_feature (160)..(160): Xaa can be any naturally occurring amino acid
  misc_feature (196)..(198): Xaa can be any naturally occurring amino acid
  misc_feature (203)..(203): Xaa can be any naturally occurring amino acid
  misc_feature (285)..(285): Xaa can be any naturally occurring amino acid
AAAHTQSVSGWAAHDSSGKITPFTFKRRENGENDVSIRILYCGMCHTDLHHVKNDWGITMYPVVPGHEITGIITKVGSNVTKFKNGDRVGVGCLAATCLKCEYCKDSQENYCDQVQFTYNGIFWDGTITYGGYSNMLVADHRYVVRIPDNLAMDRAAPLXCAGITVYTPLKDNNLVETQGKKIGVIGLGGLGHVAXXXGKAFXHHVTVISTSPSKEQEAKHNLGADDFILSTNPKQIQARKRSLDFILDTVAAKHSLGIYLELLKVKGTLVIVGAPDKPIDLPAXPMIFGKRTVKGSMIGSIEETQEMMDLCGKYNILSDIEIITTDQINEGLDRLAQNDVKYRFVIDIAGQSSNR

SEQ ID NO: 3208 - protein, 360 aa, Mimulus guttatus
MAQTTPNHTQTVSGWAAHDTSGNITPYTFKRRENGVDDVTIKILYCGICHTDLHQAKNDWGITMYPVVPGHEIVGIITKVGSNVKNFTVGDRAGVGCLAATCLKCEHCIQGQENYCDAVQFVYNGVFWDGSITYGGYSESLVADHRYVVRVPENLPMDAAAPLLCAGITVFAPMKDNNLLDSPGKRIGIVGLGGLGHVAVKFAKAFGHHVTIISTSPSKEKEAKDNLGADDFILSTDPKQMLLKKRNLDFILDTVSAHHSLGPILELLKVNGTLVIVGAPDKPIDLPSFPLIFGKRVVKGSMIGSIKETQDMMDLCGKHNITCDIEVVKPDKINEALLRLAKNDVKYRFVIDIAGESSKL

SEQ ID NO: 3209 - protein, 920 aa, Zea mays
MGAAQLVILFLALATAVGAPPSEVAVGALFTYDSTIGRAAKLAIELAVDDVNSDGKVLPRTQLNLVPQDTNCSGFLGTIEALQLMEKNVVALIGPQSSGIGHVISHVVNELHVPLLSFAATDPTLSASEYPYFIRTTISDYFQMNAIASIVDYYQWKRVTAIFVDDDYGRGGVEALGDALALKRAKISYKAAIPPNSNTDVINDVLFKANMMESRVMIVHVNPDTGMRIFSVAKNLQMMASGYVWIVTDWLAAVLDSSANRGLKDMSHIQGLIVLRQHIPESEAKDKFISKWNNVAHNRNITSGLNSYGFYAYDSVWAVARAVDKFLSNGQQINFSTDPRLEDSNGSTLHLSSLKIFDGGEQMLHQLLLTNFTGVTGPVQFDSEHNLVRPAYDILNVVGSGSRLIGYWSNYSGLSVAAPETLYQMPRNTSTSAQQLHDVVWPGDSTTKPKGWVFPNTGLPLRVGVPIKASFKELVSGRGDNMSGYCIEIFNAAIKLLPYPVPCQFITIGDGTKNPSYIDIIRMVAANSLDAAVGDFAIVRNGTQLAEYTQPYIESGLVIVAPVKHVTSSAWAFLEPFTLEMWCVTVALFILVGIVVWLLEHRTNEEFRGSPRRQVITMLWFSFSTMFFSHRENTVSTLGRFVLIIWLFVVLIITSSYTASLTSILTVQQLSTGITGIDSLVSSSLPIGYQAGKFTKRYLTENFNVPLSRLVPLNSIQEYADALNRGPKNGGVAAIVDEKPYIDIFLSNYCSFRIVGEEFTKEGWGFAFQRDSPLAADLSTAILQLSESGQLQRIHDEWFSRSSCSSDDSEVGATRLGLGSFWGLFLVCALICLFALLVFFIRVCRQYNQYSSSEAAGEPSTAAADPVLRQRRPSRLGSFKDLIQFVDKKEEEIKKTMKRRSGEKDSQAAGFSYAQSVASA

SEQ ID NO: 3210 - protein, 945 aa, Zea mays
MGALQVMLLRLVLLAASAATTAVTVTAAPPPSEVAVGALFTYDSTIGRAARLAIELAVDDVNADRTVLAGTRLNLLAQDTNCSGFLGAVEALQLMERNVVAVIGPQSSGIGHVISHVVNELHVPLLSFAATDPTLSASEYPYFIRTTISDYFQMNAVASIVDYYQWKEVTAIFVDDDYGRGGVSALGDALAAKRARISYKAAIPPNSNTDVINDVLFKANMMESRVMVVHVNPDTGTRIFSVANKLQMMATGYVWIVTDWLAAVLDSSTSRDRKEMSHIQGLIVLRQHTPESVAKNKFISKWNNAARNRSITSGLNSYGFYAYDSVWAIARGVDQFLNNGQQINFSTDPVLHDTNGSSLHLSTLKIFDGGEQMLQQLLLTNFTGLTGRVQFNSDRNLVHPAYDILNIGGSGSRLIGYWSNYSGLSVAAPEILYQKPPDTSSIAQRLHNVVWPGDSTTTPKGWVFPNNGQPLRVGVPIKPSFKELVAAGKGPDNVTGYCIDIFNAAIRLLPYPVPCQFIAIGDGRKNPNYDDIISMVAANSLDAAVGDFAIVRNRTKIAEFTQPYIESGLVIVAPVKQATSSAWAFLKPFTLEMWCVTGALFIFVGIVVWILEHRSNEEFRGSPRRQLITIFWFSFSTMFFSHRQNTVSALGRFVLIIWLFVVLIINSSYTASLTSILTVQQLATGITGIDSLISSGLPIGYQAGKFTRNYLIEELNIPESRLVPLNTIQEYADALKRGPKDGGVVAIVDEMPYVEIFLSYHCNFRIVGQEFTKEGWGFAFKRDFPLAADLSTAILQLSESGQLQRIHDEWFTRPSCSSDDSEVGATRLGLGSFWGLFLVCALICLLALLVFFIRICWQYNKYSNSEAAGEPSAAAAAAAAVDAAAAAADAVERQRRPSRLGSFKDIIQFVDKKEEEIKKTMKRRVSEKDNNQAAGSSEAHSVASA

SEQ ID NO: 3211 - protein, 191 aa, Panicum virgatum
MGAAQLVAWFLAFAAAAGAVSAAGARPSEVAVGALFTYDSTIGHAARLAIELAVDDVNADGTVLSGTKLSLKSRNTNCSAFIGTVEALQLMEENVVAVIGPQSSGIGHVISHVANELHVPLLSFAATDPTLSALEYPYFLRTTISDYFQMNAVASIVDYYQWKRVTAIYVDDDYGRGGVSALGDALASKGQ

SEQ ID NO: 3212 - protein, 210 aa, Unknown
  Sequence found in Organisms: Solanum tuberosum, Solanum phureja
MVKNEVMVDEIPFPSQFMVNNKPLPLMGHGITDIEIHFLQIKFTAIGVYLDPEIVTHLQQWKGKTGEELTENDEFFEAIVNAPVDKFLRVVVIKEIKGSQYGVQLESAIRDRLAEVDKYEEDEEEALEKIVEFFQSKYFKKDSVITYYFPATSGSAKISCTIEGKENLEIEVENANVVEMMKKWYLGGTRGVSPTTISSLANNICVELSK

SEQ ID NO: 3213 - protein, 210 aa, Nicotiana tabacum
MGKNEVMVDEFPFPSQFMINTKPLSLMGHGITDIEIHFLQIKFTAIGVYLDPEIVTHLQQWKGKTGAELTENDDFFEAIVNAPVDKFLRVVVIKEIKGSQYGVQLESAVRDRLAEVDKYEEEEEEALEKIVEFFQSKYFKKSSVITYSFPSTSGIAKISFATEGKEDSEIEVKNANVVEMMKKWYLGGNRGVSPTTISSLADNLSAELSN

SEQ ID NO: 3214 - protein, 210 aa, Nicotiana benthamiana
MGKNEVMVDEFPFPSQFMINTKPLSLIGHGITDIEIHFLQIKFTAIGVYLDPEIVTHLQQWKGRTGAELTENDDFFEAIVNAPVDKLLRIVVIKEIKGSQYGVQLESAVRDRLAEVDKYEEEEEEALEKIVEFFQSKYFKKSSVITYSFPATSGIAKISFATEGKEDSEIEVENANVVKMMKKWYLGGSRGVSPTTTSSLANNLSAELSK

SEQ ID NO: 3215 - protein, 210 aa, Petunia hybrida
MGKNEVMVDEIPFPSQFMMTTKPLPLMGHGITDIEIHFLQIKFTAIGVYLDPEIVTHLQQWKGKSGAELIENDEFFEAIVNAPVDKFLRVVVIKEIKGSQYGVQLESAVRDRLAEVDKYEEEEEEALEKIVEFFQSKYFKKDSVVTYSFPATSGNVKISFATEGKEDSEIEVQNANVAGEIKKWYLGGSRGLSPTTISSLANTLSAELSK

SEQ ID NO: 3216 - protein, 217 aa, Triticum aestivum
MGSEQEKKAAATVEVEGIPFPREIAAAKTLSLVGHGVTDIEIHFLQIKFNAIGVYLDVDGAMEHLQGWKGKSQLMEDEAFFDALVSAPVEKVLRVVVIKEIKGSQYGVQLESSVRDRLVAADKYEDEEEEALEKVSDFFQSKYFRPGSVVTFHFPATATAAPEISFVTEGKEEAKVAVENAAVAEMIQRWYLGGDSAVSQTTVRSIADSFAAMLSSP

SEQ ID NO: 3217 - protein, 217 aa, Triticum aestivum
MGSEQEKKAAATVEVEGIPFPREIAGAKTLSLVGHGVTDIEIHFLQIKFNAIGVYLDVDGAMEHLQGWKGKSQLMEDEAFFDALVSAPVEKVLRVVVIKEIKGSQYGVQLESSVRDRLVAADKYEDDEEEALEKVSDFFQSKYFRPGSVVTFHFPATATAAPEISFVTEGKEEAKVAVENAAVAEMIQRWYLGGDSAVSQTTVRSIADSFAAMLSSP

SEQ ID NO: 3218 - protein, 217 aa, Pseudoroegneria spicata
MGSEQEKKAAATVEVEGISFPREIAGAKTLSLVGHGVTDIEIHFLQIKFNAIGVYLDVDGAMEHLQGWKGKSQLMEDEAFFDALVSAPVEKVLRVVVIKEIKGSQYGVQLESSVRDRLVAADKYDEEEEEALEKVSDFFQSKYFRPGSVVTFHFPATATAAPEISFVTEGKEEAKVAVENAAVAEMIQRWYLGGESAVSQTTVRSIADRFGAILSSP

SEQ ID NO: 3219 - protein, 217 aa, Triticum aestivum
MGSEQEKKAAATVEVEGIPFPREIAGAKALSLVGHGVTDIEIHFLQIKFNAVGVYLDVDGAMEHLQGWKGKSQLMEDEAFFDALVSAPVEKVLRVVVIKEIKGSQYGVQLESSVRDRLVAADKYEDDEEEALEKVSDFFQSKYFRPGSVVTFHFPATPTAAPEITFVTEGKEEAKVAVENAAVAEMIQRWYLGGESAVSQTTVRSIADSFAAMLSSP

SEQ ID NO: 3220 - protein, 217 aa, Triticum aestivum
MGSEQEKKAAATVEVEGIPFPREIAGAKTLSLVGHGVTDIEIHFLQIKFNAIGVYLDVDGAMEHLQGWKGKSQLMEDEAFFDALVSAPVEKVLRVVVIKEIKGSQYGVQLESSVRDRLVAADKYEDDEEEALEKVSDFFQSKYFRPGSVVTFHFPATVTAAPEISFVTEGKEEAKVAVENAAVAEMIQRWYLGGDSAVSQTTVRSIADSFAAMLTSP

SEQ ID NO: 3221 - protein, 219 aa, Brachypodium distachyon
MGSEHEKAAVDTATVEVEGIPFPQEIAGAKTLSLVGHGVTDIEIHFLQIKFNAIGVYLDEGGIMEHLQSWKGKDQLQVEDDAFFSALVSAPVEKVLRVVVIKEIKGSQYGVQLESSVRDRLVAADRYDDDEEEALEKVAEFFQSKYFRPGSVVTFHFPATATAAEISFATEGKDEAKVAVENAAVAEMIQRWYLGGASAVSQTTVRSLADHFTALLSSP

SEQ ID NO: 3222 - protein, 1111 aa, Solanum lycopersicum
MEGGGDILKVSSARLGSSTVWRNSGVDVFSRSSREDYDDEEALKWAALEKLPTYLRIRRGILSEEEGQYREVDITKLDLVERRNLLERLVKIADEDNEKFLLKLKKRIDRVGLDLPTIEVRFEHLNVDAEARVGSRALPTIFNFTVNIIEDFLNYLHILPSRKKPLPILHEISGIIKPGRMTLLLGPPSSGKTTLLLGLAGKLDKDLKVSGRVTYNGHGMDEFVPQRTSAYISQNDLHIGEMTVRETLAFSARCQGVGAKYEILAELSRREKEANIKPDPDVDIFMKSAWNDGQEANVVTDYTLKILGLEICADTIVGDEMIRGISGGQRKRLTTGEMMVGPARALFMDEISTGLDSSTTYQIVNSIRQSIHILQGTAVISLLQPAPETYDLFDDIILLSDGQIVYQGPRENVLEFFEYIGFKCPQRKGVADFLQEVTSRKDQEQYWARRDEPYKFITVREFSEAFQSFHVGRKLGDELAVPFDKSKSHPAALTTERYGVSKKELLKACTAREYLLMKRNSFVYIFKMIQLTLMATITMTLFLRTEMHRDTMIDGAVFLGALYYAVIMIMFNGFSELALSIMKLPSFYKHRDLLFFPAWTYALPTWILKIPITLVEVAIWVCMTYYVIGFEADVGRFFKQLFLLICLNQMASGLFRFLAALGRNVIVANTFGSCALLIVLVMGGFILSRDNVKQWLIWGYWISPMMYAQNAIAVNEFLGKSWAHVPPNSTGTDTLGVSFLKSRGIFPEARWYWIGVGALLGYVLLFNFLFTVALAYLNPFGKPQAVLSEETVAERNASKRERGNDVRRSASSRSMSSRVGNIAEGDLNKRKGMILPFEPLSITFDDIRYAVDMPQEMKAQGFTEDRLELLKGVSGAFRPGVLTALMGVSGAGKTTLMDVLAGRKTGGYIEGTISISGYPKQQATFARIAGYCEQTDIHSPHVTVYESLQYSAWLRLPREVDTETRKRFIEEVMELVELKPLREALVGLPGVNGLSTEQRKRLTVAVELVANPSIIFMDEPTSGLDARAAAIVMRTVRNTVDTGRTVVCTIHQPSIDIFDAFDELLLLKRGGEEIFVGPLGRHSSHLIKYFEVRELLGKETGIPIMLVQCTK

SEQ ID NO: 3223 - protein, 557 aa, Saccharum officinarum
MAVALRFPGVAPESLDASKLGRERHSVCGSARPGAQCWRPRRGLAVRCQTGAAPAVLRTEEAAAGRNAQAGFTVVMKFGGSSLASAERMREVADLILSFPDETPVVVLSAMGKTTNNLLLAGEKAVSCGAPKASEIPELAVIKDLHLRTVDELGLDSSIVSGLLDELEQLLKGVAMMKELTLRTRDYLVSFGECMSTRIFAAYLHKLGKKARQYDAFDIGFITTDDFTNADILEVTYPAVAKRLHGDWMDDPAIPIVTGFLGKGCKSCAVTTLGRGGSDLTATTIGKALGLREIQVWKDVDGVLTCDPNIYANAIPVPYLTFDEAAELAYFGAQVLHPQSMRPARDGDIPVRVKNSYNRHAPGTVITKSRDMSKSILTSIVLKSNVTMLDIVSTRMLGQYGFLAKVFSIFEDLGISVDVVATSEVSISLTLDPSKLWSRELIQQELDHVVEELEKFSVVHLLQRRSIISLIGNVQRSSLILEKAFNVLRRNGVNVQMISQGASKVNISLVVNDSEAKQCVQALHSAFFENGFLSEVEGADVPQNGASLNSNGAIYAN

SEQ ID NO: 3224 - protein, 566 aa, Sorghum bicolor
MAEALRFPGVVAGESLDAPIAASKLGRERHSVSASARPGAQCWRRRKGLAVSCQTGAAPAVLRTEETTAAAAAGSNAQAEFTVVMKFGGSSLASAERMREVADLILSFPDETPVVVLSAMGKTTNNLLLAGEKAVSCGAPKASEIPELAVIKDLHLRTVDELGLDRSIVSGLLDELEQLLKGVAMMKELTLRTRDYLVSFGECMSTRIFAAYLNKLGKKARQYDAFDIGFITTDDFTNADILEVTYPTVAKRLHRDWMDNPAIPIVTGFLGKGCKSCAVTTLGRGGSDLTATTIGKALGLREIQVWKDVDGVLTCDPNIYANAIPVPYLTFDEAAELAYFGAQVLHPQSMRPARDGDIPVRVKNSYNRHAPGTVITKSRDMSKSILTSIVLKSNVTMLDIVSTRMLGQYGFLAKVFSIFEDLGISVDVVATSEVSISLTLDPSKLWSRELIQQELDHVVEELEKFSVVHLLQRRSIISLIGNVQRSSLVLEKAFNVLRRNGVNVQMISQGASKVNISLVVNDSEAKQCVQALHSAFFENGFLSEVEGADVPQNGSSLNSNGAIYAN

SEQ ID NO: 3225 - protein, 565 aa, Panicum virgatum
MAVALRLPGVARGSPAALAIRAAAKHVREQDSVRACCARPPAQCWRRSRLVVRCQTAAAALLKKKEATAAAAAHKPRTGFTVVMKFGGSSLASADRMREVADLILSFPEETPVIVLSAMGKTTNNLLLAGEKAVSCGAPKASEIPELAVIKDLHLRTIDELGLDRSVVSGLLDELEQLLKGVAMMKELTRRTRDYLVSFGECMSTRIFAAYLNKLGKKARQYDAFDIGFITTDDFTNADILEVTYPAVAKRLNGDWMDDPAIPIVTGFLGKGCKSCAVTTLGRGGSDLTATTIGKALGLREVQVWKDVDGVLTCDPNIYANAIPVPYLTFDEAAELAYFGAQVLHPQSMRPAREGDIPVRVKNSYNRHAPGTVITKARDMSKSILTSIVLKSNVTMLDIVSTRMLGQYGFLAKVFSIFEDLGISVDCVATSEVSVSLTLDPSKLWSRELIQQELDHVVEELEKFAVVHLLQHRSIISLIGNVQRSSLILEKAFNVLRRNGVNVQMISQGASKVNISLVVNDSEAKQCVQALHSAFFENGFMSEIEGADVPQNGASLNSNRAIYGN

SEQ ID NO: 3226 - protein, 557 aa, Triticum aestivum
MATALRLAAVARDSPAAVSKLGRERALLRAAARPGGQCCARRGLVLRCQSGAATLKKGEAADGAGAAAGFTVVMKFGGSSVSSAARMREVADLILSFPEETPVVVLSAMGKTTNNLLLAGEKAVSCGAPKASEINELAVIKELHLRTIDELGLDSSIVSGFLDELEQLLKGVAMMKELTLRTRDYLVSFGECMSTRIFAAYLNKLGKKARQYDAFDLGFITTDDFTNADILEATYPAVAKRLHGDWIDDPAIPIVTGFLGKGWKSCAVTTLGRGGSDLTATTIGKALGLREIQVWKDVDGVLTCDPNIYANAVPVPYLTFDEAAELAYFGAQVLHPQSMRPAREGGIPVRVKNSYNRHAPGTVITKTRDMRKSILTSIVLKSNITMLDIVSTRMLGQYGFLAKVFSIFEDLGISVDSVATSEVSISLTLDPSKLWSRELIQQELDHVVEELEKIAVVHLLQHRSIISLIGNVQRSSLILEKAFNVLRRNGVNVQMISQGASKVNISLVVNDSEAKQCVQALHSAFFENGFLSEVEEADLAQKRAPVLVSSNGAINGN

SEQ ID NO: 3227 - protein, 565 aa, Oryza sativa
MAVALRFAAVARDSPAAAAPPRVGREQQYLACAAAARPGGRCSRRRGLVVRCQSGAAAVVLNKDDAASVAAAAASSATGFTVAMKFGGSSVASAERMREVADLILSFPEETPVVVLSAMGKTTNNLLLAGEKAVSCGAPKASEIPELAVIKELHVRTIDELGLDRSIVSGLLEELEQLLKGVAMMKELTPRTRDYLVSFGECMSTRIFAAYLNKLGKKARQYDAFDIGFITTDDFTNADILEATYPAVAKRLQGDWIDDPAIPIVTGFLGKGWKSCAVTTLGRGGSDLTATTIGKALGLREIQVWKDVDGVLTCDPNICANAIPVPYLTFEEAAELAYFGAQVLHPQSMRPAKEGDIPVRVKNSYNRRAPGTVITKTRDLSKSILTSIVLKSNITMLDIVSTRMLGQYGFLAKVFSIFEDLGISVDCVATSEVSISLTLDPSKLWCRELIQQELDHVVEELEKIAVVHLLQHRSIISLIGNVQRSSLILEKAFNVLRRNGVNVQMISQGASKVNISLVVHDSEAKQCIQALHSAFFENGFLSEVEEEDLQHNGSPVSPNGVIYGN

SEQ ID NO: 3228 - protein, 569 aa, Brachypodium distachyon
MATAPALRLAGVSVRGPASGLGREREAPCGAARPGLQCWRRRGLVLRCQSGAVATTLKKGEEASSSLESSAAEAARDRATGFTVVMKFGGSSVATAERMKEVADLVLSFPEETPVVVLSAMGKTTNNLLLAGEKAVSCGAPKASEIEELAVIKELHLRTIDELGLDESIVSGFLDELEQLLKGVAMMKELTLRTRDYLVSFGECMSTRIFAAHLNKLGKKARQYDAFDLGFITTDDFTNADILEATYPAVAKRLHGDWIDDPAIPIVTGFLGKGWKSCAVTTLGRGGSDLTATTIGKALGLREIQVWKDVDGVLTCDPNIYANAVPVPYLTFDEAAELAYFGAQVLHPQSMRPAREGGIPVRVKNSYNRHAPGTVITKTRDMRKSILTSIVLKSNITMLDIVSTRMLGQYGFLAKVFSIFEDLGISVDSVATSEVSISLTLDPSKLWSRELIQQELDNVVEELEKIAVVHLLQHRSIISLIGNVQRSSLILEKAFNVLRRNGVNVQMISQGASKVNISLVVHDSEAKQCVQALHSAFFENGFLSEVEEADLAQNGSPVPVNSNGALYGN

SEQ ID NO: 3229 - protein, 526 aa, Triticum aestivum
  misc_feature (50)..(51): Xaa can be any naturally occurring amino acid
  misc_feature (63)..(63): Xaa can be any naturally occurring amino acid
ARPGGQCCARRGLVLRCQSGAATLKKGEAADGAGAAAGFTVVMKFGGSSXXSAARMREVADLXLSFPEETPVVVLSAMGKTTNNLLLAGEKAVSCGAPKASEIYELAVIKELHLRTIDELGLDSSIVSGFLDELEQLLKGVAMMKELTLRTRDYLVSFGECMSTRIFAAYLNKLGKKARQYDAFDLGFITTDDFTNADILEATYPAVAKRLHGDWIDDPAIPIVTGFLGKGWKSCAVTTLGRGGSDLTATTIGKALGLREIQVWKDVDGVLTCDPNIYANAVPVPYLTFDEAAELAYFGAQVLHPQSMRPAREGGIPVRVKNSYNRHAPGTVITKTRDMRKSILTSIVLKSNITMLDIVSTRMLGQYGFLAKVFSIFEDLGISVDSVATSEVSISLTLDPSKLWSRELIQQELDHVVEELEKIAVVHLLQHRSIISLIGNVQRSSLILEKAFNVLRRNGVNVQMISQGASKVNISLVVNDSEAKQCVQALHSAFFENGFLSEVEEADLAQKRAPVLVSSNGAINGN

SEQ ID NO: 3230 - protein, 552 aa, Festuca arundinacea
  misc_feature (46)..(46): Xaa can be any naturally occurring amino acid
  misc_feature (57)..(57): Xaa can be any naturally occurring amino acid
  misc_feature (88)..(88): Xaa can be any naturally occurring amino acid
  misc_feature (90)..(90): Xaa can be any naturally occurring amino acid
  misc_feature (139)..(139): Xaa can be any naturally occurring amino acid
  misc_feature (149)..(149): Xaa can be any naturally occurring amino acid
ARGRLVRERDSACGAARPGAQCWARRGLVLRCQSGAAATTTLKKGXAPAPAVSDGGXPPAAAGFTVVMKFGGSSVASAERMREVADLXLXFPEETPVIVLSAMGKTTNNLLLAGEKAVSCGAPKASELDELKAIKELHXRTIDELGLDXSIVSGFLDELEQLLKGVAMMKELTPRTRDYLVSFGECMSTRIFAAYLNKLGKKARQYDAFDLGFITTDDFTNADILEATYPAVAKRLQGDWIDDPAIPIVTGFLGKGWKSCAVTTLGRGGSDLTATTIGKALGLREIQVWKDVDGVLTCDPNIYANAVPVPFLTFDEAAELAYFGGQVLHPQSMRPAREGGIPVRVKNSYNRHAPGTVITTTRDMRKSILTSIVLKSNITMLDIVSTRMLGQYGFLAKVFSIFEDLGISVDSVATSEVSISLTLDPSKLWSRELIQQELDNVVEELEKIAVVHLLQHRSIISLIGNVQRSSLILEKAFNVLRRNGVNVQMISQGASKVNISLVVHDSEAKQCVQALHSAFFENGFLSEVEEADIAQKNGSPLLVNSNGAMHGN

SEQ ID NO: 3231 - protein, 595 aa, Avena sativa
LLLALSSPARRGTEKRGEERSGRDGRAALRGGRAGGPHRSLRRLQAREGEGLVSPARGRHQCKAGRAMLGAEGAGAPVPERGGRHDYPEEGRRGLPRHAGDGARGWVHRRHEIRRLLGGVGGADEGGGRPHPQLPRGDARRRPLRDGEDHQQPPPGRREGRELWRPNAAEIDELKAIKELHFRTIDELGLDSSIVSGFLDELEQLLKGVAMMKELTPRTRDYLVSFGECMSTRIFAAYLNKLGKKARQYDAFELGFITTDDFTNADILEATYPAVAKRLHGDWIDEPAIPIVTGFLGKGWKSCAVTTLGRGGSDLTATTIGKALGLREIQVWKDVDGVLTCDPNIYANAVPVPYLTFDEAAELAYFGGQVLHPQSMRPAREGGIPVRVKNSYNRHAPGTVITKSRDMRKSILTSIVLKSNITMLDIVSTRMLGQYGFLAKVFSIFEDLGISVDSVATSEVSISLTLDPSKLWSRELIQQELDNVVEELEKIAVVHLLQHRSIISLIGNVERSSLILEKAFNVLRRNGVNVQMISQGASKVNISLVVHDSEAKQCVQALHSAFFENGFLAEVEEVDRAQKNGSLAPVNSNGAVHGN

SEQ ID NO: 3232 - protein, 586 aa, Avena sativa
RRGTEKRGEERSGRDGRAALRGGRAGGPHRSLRRLQAREGEGLVSPARGRHQCKAGRAMLGAEGAGAPVPERGGRHDYPEEGRRGLPRHAGDGARGWVHRRHEIRRLLGGVGGADEGGGRPHPQLPRGDARRRPLRDGEDHQQPPPGRREGRELWRPNAAEIDELKAIKELHFRTIDELGLDSSIVSGFLDELEQLLKGVAMMKELTPRTRDYLVSFGECMSTRIFAAYLNKLGKKARQYDAFELGFITTDDFTNADILEATYPAVAKRLHGDWIDEPAIPIVTGFLGKGWKSCAVTTLGRGGSDLTATTIGKALGLREIQVWKDVDGVLTCDPNIYANAVPVPYLTFDEAAELAYFGGQVLHPQSMRPAREGGIPVRVKNSYNRHAPGTVITKSRDMRKSILTSIVLKSNITMLDIVSTRMLGQYGFLAKVFSIFEDLGISVDSVATSEVSISLTLDPSKLWSRELIQQELDNVVEELEKIAVVHLLQHRSIISLIGNVERSSLILEKAFNVLRRNGVNVQMISQGASKVNISLVVHDSEAKQCVQALHSAFFENGFLAEVEEVDRAQKNGSLAPVNSNGAVHGN

SEQ ID NO: 3233 - protein, 499 aa, Triticum aestivum
GGGWSRGSGGVHRRDEVRRLVASVGRADARGGRPRSQLSPRRRPSSSSPPWGRPTNNLLLAGEKAVSCGAPKASEIYELAVIKELHLRTIDELGLDSSIVSGFLDELEQLLKGVAMMKELTLRTRDYLVSFGECMSTRIFSAYLNKLGKKARQYDAFDLGFITTDDFTNADILEATYPAVAKRLHGDWIDDPAIPIVTGFLGKGWKSCAVTTLGRGGSDLTATTIGKALGLREIQVWKDVDGVLTCDPNIYANAVAVPYLTFDEAAELAYFGAQVLHPQSMRPAREGGIPVRVKNSYNRHAPGTVITKTRDMRKSILTSIVLKSNITMLDIVSTRMLGQYGFLAKVFSIFEDLGISVDSVATSEVSISLTLDPSKLWSRELIQQELDHVVEELEKIAVVHLLQHRSIISLIGNVQRSSLILEKAFNVLRRNGVNVQMISQGASKVNISLVVNDSEAKQCVQALHSAFFENGFLSEVEEADLAQKRAPVLVSSNGAINGN

SEQ ID NO: 3234 - protein, 347 aa, Solanum phureja
MAETHETVFKSVQELANDNQVPEKYIHTQGSINSSSPLLDVPVVDLSLLTSPARQQELNKLQSGLEFCGCIQVINHGLVDSFLDKVHEISKQFFALPAEEKLKYARTVDDIYGYGNDSVLSDKQKLDWTDRLYLNVFPEDIRNLKLWPQKPECFREVLEEYIKNMKLLSESLLKAMAASLNLEENCFLDQCGERGDMIARFNFYPPCPTPEVVLGVKPHADASAITILLQDKEVEGLQVLKDDQWFRVPIVPYGLLVNVGDQVEIMSNGIFKSPVHRVVTNAERERNTLAVFIMPDVTVGIGPVEKLINEERPRAYKDVKNYVELFFQSYQHGKRPIETAMICQEQD

SEQ ID NO: 3235 - protein, 347 aa, Solanum lycopersicum
MAETQETVSKSVQELANTNQVPEKYIYAQGSINTYPLLFDVPQVDLSLLTSPNRQQQLNKLQSGLKSCGCIQVINHGMEDSFLDKVREISKKFFALPTEEKLKYARTVNQIEGYGNDKVLTDKQRLDWSDRLCLNVFPEDIRELRFWPQKPECFREVFEEYMKNMKLLSESLLKAMAASLNVEENCFLDQCGERGTTTARFNFYPPCPRPDVVLGVKQHADASAITILLQDKEVEGLQVLKDDQWFRVPVVPYGLLINVGDQVEVMSNGIFKSPVHRVVTNAERERNTLAVFIMPDVHVGIGPVEKLINEERPRGYKDIKNYVALFFQSYQQGKIPIEAAKISQEFH

SEQ ID NO: 3236 - protein, 348 aa, Solanum phureja
MAETQQEIVFKSVLELANNNQVPEKYIYAQGSINTSPPLLAVPQVDLSLLTSPNRQQELNKLLSGLKSCGCIHVINHGIEDSFLDKVREISKQFFALPTEEKLKYARTVNQTEGYGNDKVLTDNQRLDWSDRLYLNVFPEDIRKLQFWPQKPECFREVFEKYIKDMKLLSESLLKAMAASLNVEENCFLDQCGERGNMIARFNFYPPCPRPDVVLGVKQHADSSAITILLQDKEVEGLQVLKDDQWFRVPVVPYGLLINVGDQVEIMSNGIFKSPVHRVLTNAERERNTLAIFIMPDVDVGIGPVEKLINEERPRAYKDINNYVALFFQSYQQGKRPIEAAKISQELH

SEQ ID NO: 3237 - protein, 344 aa, Quercus alba
MWESILLTLAATAGNNIGKVLQKKGTVILPPLSFKFKVIRAYAFNKSWLVGFLMDIFGAMLMLRALSQAPVSVIQPVSGCGLAILSIFSHFYLKEVMNAIDWMGITLAGIGTIGVGAGGEEQDATSISILHLPWLAFIVAILFVLLNGWLRIYRRQRREQEMMEFEVVEEIIYGLESGILFGMASVISKMGFVFFEQGFHSMLVPICISISVCCSGTGFYYQTRGLKHGRAIVVSTCAAVASIVTGVLAGMLALGERLPSAPTARFSLLLGWLLIILGVILLVTSTRLLRHLPRPLRDFIQSGVDRNFNLRRSGSARVRDTNPSAVIQAATLHSLISSPSKEKA

SEQ ID NO: 3238 - protein, 344 aa, Mimulus guttatus
MWESICLTVAATAGNNIGKVLQKKGTLILPPLSLKLKVIKAYASNRDWILGFLMDIFGAVLMLLALSQAPVSVIQPVSGCGLAILSVFSHFYLKEIMNAIDWIGIALAGIGTIGVGAGGEEQKSSSISVFHLPWLAFVVAFLFVLLNGWLRVYRRQRREQELMQYEVVEEIIYGLQSGILFGMASVISKMGFVFLEQGFSKLLLPICVSISICCSGSGFVYQTRGLKHGRAIVVSTCAAVASIVTGVLAGMFALGERLPSAPMARLTLLLGWLCIIVGVILLVTSTRLVRHLPRPWRRFARNGTERNFGLRQTGLARTRDSNPSAVIQTTTLHQLMSSPSKAKS

SEQ ID NO: 3239 - protein, 457 aa, Triticum aestivum
MERTQGFFAALKQEVARGLSPARARRRSDSADLDATALRFSGPGEMLAPLMEGPDPESGDGDARAAAGARREGWGRWVRGQLARTPSSVAAAAAGAGAARNDLRLLLGVMGAPLAPVHVCAAEPLPHLSIKDTPIETSSAQYILQQYLAASGGHRLLASVRNSYAMGKVRMVATEFENAGRLVKNRNAARCAEPGRFVLWQMAPEKWYIELAVGGSKVHAGCNGKLVWRHTPWLGSHAAKGPVRPLRRALQGLDPLTAASMFAGARCIGERKVNGEDCFILKLCTDPETLKARTEGLAEIIRHVMFGYFSQRTGLLVHIEDSHLTRIQSTTGGDAVYWETTINSFIEDYRPVDGIMIAHSGRSAVTLFRFGEVAMSHTKTRMEEAWSIEEVAFNVPGLSMDCFIPPTDIKSGSVSETVELPHGGEKNKFGPPPGHRAKVAALEKTDGGELAWRGTHT

SEQ ID NO: 3240 - protein, 451 aa, Triticum aestivum
  misc_feature (32)..(33): Xaa can be any naturally occurring amino acid
  misc_feature (36)..(36): Xaa can be any naturally occurring amino acid
  misc_feature (45)..(45): Xaa can be any naturally occurring amino acid
  misc_feature (59)..(59): Xaa can be any naturally occurring amino acid
  misc_feature (87)..(87): Xaa can be any naturally occurring amino acid
  misc_feature (96)..(97): Xaa can be any naturally occurring amino acid
  misc_feature (99)..(99): Xaa can be any naturally occurring amino acid
  misc_feature (149)..(149): Xaa can be any naturally occurring amino acid
  misc_feature (234)..(234): Xaa can be any naturally occurring amino acid
  misc_feature (421)..(421): Xaa can be any naturally occurring amino acid
  misc_feature (449)..(449): Xaa can be any naturally occurring amino acid
RGLPWRRPTRPVARGLSPARARRRSELADLDXXALXFSGPGEMLXPLMEGPDPESGDGXGAGARREGWGRWVRGQLARTPSSVAAAXAGAGAARNXXRXLLGVMGAPLAPVHVCAAEPLPHLSIKDTPIETSSAQYILQQYLAASGGHXLLASVRNSYAMGKVRMVATEFENAGRLVKNRNAARCAEPGRFVLWQMAPEKWYIELAVGGSKVHAGCNGKLVWRHTPWLGSHAAXGPVRPLRRALQGLDPLTAASMFAGARCIGERKVNGEDCFILKLCTDPETLKARTEGLAEIIRHVMFGYFSQRTGLLVHIEDSHLTRIQSTTGGDAVYWETTINSFIEDYRPVDGIMIAHSGRSAVTLFRFGEVAMSHTKTRMEEAWSIEEVAFNVPGLSMDCFIPPTDIKSGSVSETVELPHGGEKXKFGPPPGHRAKVAALEKTDGGELAWRGXHT

SEQ ID NO: 3241 - protein, 453 aa, Brachypodium distachyon
MERRQGFFAALRQEVSRGLSPARARRRSEAAELDAALRSSAAPGGGEMLAPLMEGPDPESGDGDGGGAGGASARKEGWGQWVRGQLARTPSSVAAAAAAGAGAARNDLRLLLGVMGAPLAPVHVSAAEPLPHLSIKDTPIETSSAQYILQQYLAASGGQKLLASVRNTYVMGKVRMVATEFENAGRLVKNRNAARGAEPGRFVLWQMAPEMWYIELAVGGSKVHAGCNGKLVWRHTPWLGSHAAKGPVRPLRRALQGLDPLTAASMFAGARCIGERKVSGEDCFILKLCTDPETLKARTEGLAEIIRHVMFGYFSQRTGLLVHIEDSHLTRIQSTTGGDAVYWETTTNSFIEDYRPVDGIMIAHSGRSAVTLFRFGEVAMSHTKTRMEEAWSIEEVAFNVPGLSMDCFIPPTDIKSGSVGETVELSHGEKSKFGPPPGHRAKVAALEKADDRD

SEQ ID NO: 3242 - protein, 463 aa, Triticum aestivum
MDKKQGFFSALREEVARGLSPARARRRAEEVAAAKAALRYAGGGGGEALAPLMEGPDPEEAGGGEGAGRARRDGWGRWVRGQLARAPSSGPVASGGGAGAARRNDLRMLLGVMGAALAPVHVCAAEPLPHLSIKDTPIETSSAQYILQQYLAASGGQKLLSSVRNSYAMGKVRMVATECETAGRVVKNRMAARCAEPGRFVLWQMAPEMWYIELAVGGSKVHAGCNGKLVWRHTPWLGAHSAKGPVRPLRRSLQGLDPLTTASMFAGARCIGERKVNGDDCFILKLCADPETLRARSEGLAEIIRHVLFGYFSQKTGLLVHLEDSHLTRIQSTTGGDAVYWETTINSFIEDYRPVEGIMIAHAGRSAVTLFRFGEVAMSHTKTRMEEAWSIEEVAFNVPGLSMDCFIPPTDIKSGSISETMELPQSGKSKAGGLLPCHGAKVAALEKADDNVAWSGALQRDCK

SEQ ID NO: 3243 - protein, 471 aa, Oryza sativa
MDKKQGFFSALREEVARGLSPARARRRSQAAAAAEVAAALRYAGGGGGGEMLAPLMEGPDPESGDGGRSSSSAAAARREGWGRWVRGQLSRAPSTAGAAVVAAGGGGGAARRNDLRLLLGVMGAPLAPVHVAAGEPLPHLSIKDTPIETSSAQYILQQYLAASGGQKLLSSVRNSYAMGKVRMVATEFETGGRVVRNRMAARATESGRFVLWQMAPEMWYIELAVGGSKVHAGCNGKLVWRHTPWLGAHSAKGPVRPLRRALQGLDPLTAASMFAGARCIGERKVNGEDCFILKLCADPETLRARSEGLAEIIRHVLFGYFSQKTGLLVHLEDSHLTRIQSTTGGDAVYWETTINSFIEDYRPVEGIMVAHAGRSAVTLFRFGEVAMSHTKTRMEEAWSIEEVAFNVPGLSIDCFIPPTDIKSGSISETVELPHGEKSKVGLLQCHSAKVAALEKADDNVAWSGALQRDFK

SEQ ID NO: 3244 - protein, 467 aa, Sorghum bicolor
MERRHGFFAALREEVARGLSPARARRKSEAADLAAAALRFAGVVGGGEMLAPLMEGPDPEPSDGESGGACRGAARGRKEGWGHWVRGQFARAPSSAVAAAGAGALRNDLRMLLGVLGAPLAPVHVCATEPLPHLSVKDTPIETSSAQYILQQYLAASGGHKLLASLRNSYAMGKVRMVATEFETGGRLTKNRNAGRGGEPGRFVLWQMAPEMWYIELVVGGSKVHAGCNGKLVWRHTPWLGAHSATGPVRPLRRSLQGLDPLMTASMFARARCIGERKVNGEDCFILKLSTDTETLKARSEGHAEIIRHVTFGYFSQRTGLLAHIEDSHLTRIQSAAGGDAVYWETTISSFMEDYRPVDGIMIAHSGRSAVTLFRFGEVAMSHTKTRMEEVWSIEEVAFNVPGLSMDCFIPPTDIKSGSVGEAMELTHGERSRAGPPQGYCAKVAALEKAEEDKVAWGGGTVLESHN

SEQ ID NO: 3245 - protein, 442 aa, Oryza sativa
MRMSGGGGGGGEMLAPLMEGPDPESGDGEGGGGGGGGGGGGGGGGRGARGRRGEGWGQWVRGQLSRTPSSVAAAAAGAGAARNDLRLLLGVMGAPLAPVHVSAAEPLPHLSIKDTPIETSSAQYILQQYLAASGGQKLLASVRNAYTMGKVRMVATEFETAGRLVKNRNAARCAEPGRFVLWQMAPEMWYIELAVGGSKVHAGCNGKLVWRHTPWLGAHAAKGPVRPLRRALQGLDPLTTASMFAGARCIGERKVNGEDCFILKLCTEPETLKARSEGLAEIIRHVMFGYFSQRTGLLVHIEDSHLTRIQSTTGGDAVYWETTINSFIEDYRPVEGIMIAHSGRSAVTLFRFGEVAMSHTKTRMEEAWSIEEVAFNVPGLSMDCFIPPTDIKSGSISETVELSHGEKSKVGPPPGHRAKVAALEKAVDGKVAWSGTILEDHN

SEQ ID NO: 3246 - protein, 477 aa, Brachypodium distachyon
MDSSGGNRKQGFFSALRDEVARGLSPARARRRSAEAAAAAAALRYAGGGGGEVLAPLMEGPDPEESSGGGGGGGGDGGFGRGRKGDGWGRWVRGQLARAPSAGALAVGTGGGGGAARRSDLRMLLGVMGAALAPVHVCAAEPLPHLSIKDTPIETSSAQYILQQYLAASGGQKLLSSVRNAYAMGKVRMVATECETAGRVVKNRMAARCAEPGRFVLWQMAPEMWYIELALGGSKVHAGCNGKLVWRHTPWLGAHSAKGPVRPLRRALQGLDPLTTASMFAGARCIGERKVNGEDCFILKLCADPETLRARSEGLAEIIRHVLFGYFSQKTGLLVHLEDSHLTRIQSTTGGDAVYWETTISSFIEDYRPVEGIMIAHAGRSAVTLFRFGEVAMSHTKTRMEEAWSIEEVAFNVPGLSMDCFIPPTDIKSGSISETVELPHGGKSKVGLLTCHGVKVAALEKADDNVAWSGALQRDCK

SEQ ID NO: 3247 - protein, 591 aa, Triticum aestivum
MGKGDREKEAKRRRRGRSSKRSRNATPSSDSDSSPSPDSSPSRSPGPRSRSNSKPEKSSSSRRRRHHHKNSGRSRSSRDDDRHRHRQRRRDERARHSSDGSDLSGSGSDDSGWMEEAQEIVRGILSEFPAITSELRQLLQMIDSGEGIDISGISDKPLVKRLKKLFRSLKLKESANGAYLLSAKGVPTLDVVGPVLEASAKHGNDPNETVARNRQQVPLPNFDVQNKDDIPPEDGGKVDREEDTPIKRVIGPAMPSRELLAAAAEMTEALRCRDAELEADDGFLIGPPPPAMVAEAASANEAERFEEVTRILGADADALYDVLGINWKMSSDNIKKRYWKLSLLVHPDKCPHPSAQEAFVKLNNAFKDLQDPQKRGAIDEKIQKKEEMEQFEVELKAMREAAEWRRLQGISLEGDEELLAVPKQPEAPPTRDEWMTTLPPERKAGVPMHSTTAFSMNGKEGRGGTSAWTDSPLDRAQKAQQNYLEAYNKAKAIADGHEEQGKSANASLVDKYNSSKRSVSLVQKHRESKKEKKKQKQQRGKEEWEENHPWKPWDREKDLTAGRQNVALDPENTAQGLSSRFSSGAVQRNFL

SEQ ID NO: 3248 - protein, 591 aa, Triticum aestivum
  misc_feature (87)..(87): Xaa can be any naturally occurring amino acid
  misc_feature (203)..(203): Xaa can be any naturally occurring amino acid
MGKGDREKEAKRRRRGRSSKRSRNATPSSDSDSSPSPDSSPSRSPGPRSRSNSKPEKSSSSRRRRHHHKNSGRSRSSRDDDRHRHRXRRRDERARHSSDGSDLSGSGSDDSGWMEEAQEIVRGILSEFPAITSELRQLLQMIDSGEGIDISGISDKPLVKRLKKLFRSLKLKESANGAYLLSAKGVPTLDVVGPVLEASAKHXNDPNETVARNRQQVPLPNFDVQNKDDIPPEDGGKVDREEDTPIKRVIGPAMPSRELLAAAAEMTEALRCRDAELEADDGFLIGPPPPAMVAEAASANEAERFEEVTRILGADADALYDVLGINWKMSSDNIKKRYWKLSLLVHPDKCPHPSAQEAFVKLNNAFKDLQDPQKRGAIDEKIQKKEEMEQFEVELKAMREAAEWRRLQGISLEGDEELLAVPKQPEAPPTRDEWMTTLPPERKAGVPMHSTTAFSMNGKEGRGGTSAWTDSPLDRAQKAQQNYLEAYNKAKAIADGHEEQGKSANASLVDKYNSSKRSVSLVQKHRESKKEKKKQKQQRGKEEWEENHPWKPWDREKDLTAGRQNVALDPENTAQGLSSRFSSGAVQRNFL

SEQ ID NO: 3249 - protein, 591 aa, Brachypodium distachyon
MGRGDGEKEGKRRRGRSSKRSRDASPSSDSDSYPSSASSPGRSLEHRSHSGSKHRKSSNSSHRQHHHHKSSGRSHCSRDENRRRRRRRRRDEGRVQRHGDASDFSGSGSEDSDNEEARQIVRGILSEFPAVAGELCQLLQMIDGGEGIDISGISDKPLVKRLKKLFRSLKLKESSNGAYLLPPKRVPTLDIIGPILSGSAKCGDDQNENAMLQKRQQLLSSNFDVQNKDDFPPAHGGKVDREDDTPKKRVIGPAMPSRELLAAAAEMTEALRCRDAELEADNDSLIGPPPPAMVAEAASANEAERFEEVTRILGADADALYDVLGINWKMSSENIKKRYWKLSLLVHPDKCPHPSAQEAFVKLNNAFKDLQDPGKRGVIDEKIKKKEEMEQFEVELKAMREAAEWRRLQGISLEGDEELLAAPKQPQEPPTRDEWMTTLPPERKAGVPMHSTTSFSMNGKEGRGDTSVWTDSPLDRAQKAQQNYLEAYNKAKAIADGYEDKGKSSDASLVDKYNSSKRSVSLVQKHRESKKEKKKHKQRDKEGWEENHPWKPWDREKDLTAGRQNVALDPENMTQGLSSRFSSGAVQRNFL

SEQ ID NO: 3250 - protein, 603 aa, Oryza sativa
MGRGDEAEKEGKRRRGRGRSSRRSRDASSDPDPDSASSPSPSSASSPSRSPDRRSRSRSSGSKRRKASSSSRRHRHHHHKSSGRSRRSRDDDDERRRRRRRRDEERGRRGGDASESSGSGSEEPDRAEEAREIVRDILGDFPAVAGELRQLLQMIDNGEGIDISGISDKPLVKRLKKLFRSLKLRESSNGAYLLPPKSVPTLDVVGSALVASGELADNENKNPASPTRQEQPSSNFDVQNKNDSTPEEPAKNDADEQPPKRRVIGPAMPSRELLAAAAEMTEALRSRDAEVEADDGFLIGPPPPAMVAEAASANEAERFEEVTRILAADENSPYDVVGINWKMSSDNIKKRYWKLSLLVHPDKCPHPSAQEAFVKLNNAFKDLQDPEKRGVIDEKIKKKEEMEQFEVELKAMREAAEWRRLQGVSLEGDDELLAVPKQAQAPKRDEWMTTLPPERKPGVPMHSTTSFSMNGKEGRGDTSVWTDTPLERAQKAQQNYLEAYNKAKAIADADEEKIKTSDASLVDTYNSSKRSVSLVQKHRESKKEKKKQKQRDKEEWEGNHPWKPWDREKDLTAGRQNVNLDPENMAQGLSSRFSSGAVQRNFL

SEQ ID NO: 3251 - protein, 240 aa, Unknown
  Sequence found in Organisms: Solanum tuberosum, Solanum phureja
MRRGRAAAAARQVPATEVPVPAPVAGELNGSGGSKEIRFRGVRKRPWGKFAAEIRDPWKKTRVWLGTFDSAEDAARAYDTAARTLRGPKAKTNFPLPSSHHLPPYPHHHQFNQSINPNDPFVDSRLYSQDHPIVSQRPTSSSMSSTVESFSGPRPPPRQQTAASVPSRKYPRSPPVVPDDCHSDCDSSSSVVEDGECDNDNIASSSFRKPLPFDLNLPAPMDDFGADAYADDLHCTALCL

SEQ ID NO: 3252 - protein, 589 aa, Sorghum bicolor
MARDGKETRRRSRKRSRDASLSPSSDSDSPSSASSPSSSPERRSRSSKRSRSSSSHRHRHRHSRKDSGRSRSSRDEDRRRRHRRRRDQERKRHGGDGGGSSDSQSSEEDRAEEAREIVRDILRELPAVAGELRQLLQMIDSGEGIDISGISDKPLVKRLKKLFRSLRLKESASGAYLLPPKNVPTLDIVGSLLLAGSKLSDNKSEKSVSPYREELPQANFDVQNKDKDDSISEEPKIIGVEEEPPKRRVIGPAMPSRELLAAAAEMTEALRCRDAELEADDDLLIGPPPPAVVAEAASANEAERFEEVTRILAADTNSPYDVLGVNWKMSTDNMKKRYWKLSLLVHPDKCPHPLAQEAFVKLNNAFKDLQDPDKRGAIDEKIKKKEEMEQFEIELKAMREAAEWRRLQGVSLAGDDELLAGPKESQAPKRDEWMTTLPPERKAGVPMHSTKSFSMNGKEGRGDTSVWTDTPLDRAQKAQQSYLEAYNKTKAIAEGEDVKSKNPDASIVDKYNTSKRSVSLVQKHRESKKEKKKQKQHEKEEWEGNHPWKPWDREKDLTAGRQKVALDPENMSQGLTSRFASGSVQRNFL

SEQ ID NO: 3253 - protein, 137 aa, Panicum virgatum
MFSGDWTPPCGSCCTKKYASLVQIPWRVFCKKGCNADGDTWEECIGKCTEICYKDPVLEDRQWSAYIDRSPGQDSYSLECFNACVSGCGFRFEIPAEKVEEIKPNRPSKPPPPPEVKPTTGSDSAAGSREDAPCTSA

SEQ ID NO: 3254 - protein, 134 aa, Sorghum bicolor
MFSGDWTPPCGSCCTKKYASLVQIPWRVFCKKGCNADGDTWDECIGKCTEICYKDPVLEDRQWSAYIDRSPGQDSYSLECFNACVSGCGYRFDVPTEKVEEIKPNRPSKPPAPEPDVKRTKSPDCTEDVPCTSA

SEQ ID NO: 3255 - protein, 139 aa, Pennisetum glaucum
MFSGDWTPPCGSCCTKKYASLVQIPWRVFCKKGCNADGDTWEECIGKCTEICYKDPVLEDRQWSAYIDRSPGQDSYSLECFNACVSGCGFRFDVPTEKVEEIKPNRPSKPPPPPEVKRSTTSPPESTGGSREDVPCTSA

SEQ ID NO: 3256 - protein, 611 aa, Zea mays
MPPPPPQRPASSHVGRANLFSASPPPLSNRRYPHHRSLPLPPVSPRRRDPKKHSQQPSQEEPTDSGPTRTVTTNPAFRAAHLRTAYRKPVPPAAAAGEGEALLAADPTDAASGRAVVVGPSGLSFRLPGAPFDFQFSYSEAPRAPPLAIREPAFLPFAPPTMPRPWTGKAPLLTKEEKARRRGVRLHTPLGQETPQTVSAHGIMMEVRERRKMDLARVSPGDGRSREEVLGEPLTPSEVRALVKPHISHNRQLNIGRDGLTHNMLEMIHCHWRRQEICKVRCRGVPTVDMKNLCYHLEEKSGGKVIHRVGGVVFLYRGRHYDPKTRPRYPLMLWKPATPVYPKLIKEAPDGFTKEEADEMRRKGRDLLPICKLAKNGIYITLVKDVRDAFEGSDLVKIDCEGLNPSDYKKIGAKLRDLVPCVLLSFDDEQILMHRGKEWKSRYSKPLTLIPKVPKNNLAMTSVMNSSDEVSDANTQVAIREVLRPKMFKLWKSAVDSSLALLLDDAEANNLTPDSLLTLVEEFSVTSQAVEHSFPALLVTNGDASTDSLSAEYMNDEPETSVAGNEEGQLEQSPDLRDDEHFDVDMFERLESSVPLGSLPIDSMIERLNSE

SEQ ID NO: 3257 - protein, 406 aa, Setaria italica
PPHHFPPCRHRHRSGQLPPAPAASTSSPPRLLHSPTAGTPSTGPFPSRQSPLAADTPRTTPSSLPKTRSRQTAVQERPPPPTTPPSARPTSAPRTASPCPRSRPPARARPSSPPTLPMPPVVVGPSGLSFRLPGAPFDFQFSYSEAPRAPPLAIREPAFLPFAPPTMPRPWTGKAPLLTKEEKARRRGVRLHTPLGQEPAQTVSPHGIMMEVRGRRQMDLARVSPGDGRTRDEVLGEPLTPAEVRALVKPHISHNRQLNIGRDGLTHNMLEMIHCHWRRQEVCKVRCRGVPTVDMNNLCYHLEEKSGGKVIHRVGGVVFLYRGRHYDPRTRPRYPLMLWKPATPVYPKLIKEAPEGLTKEEADEMRSKGRNLPPICKLASYFVSCIMEYISLLSRMCEMLLKEMTW

SEQ ID NO: 3258 - protein, 498 aa, Saccharum officinarum
MAMALRRLAGVSGSPSASAAAAALLLRPALTRPISTGFREERDTFGPIQVPNDKLWGAQTQRSLQNFDIGGDRERMPVPIIRAFGVLKKCAAKVNMEYGLDPTIGKAIMQAAEEVAEGKLDDHFPLVIWQTGSGTQSNMNANEVIANRAAEILGHKRGEKFVHPNDHVNRSQSSNDTFPTVMHIAAAVEINSRFMPSLQQLHDSLHSKTCEFKDIIKIGRTHTQDATPLTLGQEFSGYTTQVKYGIDRINCTLPRMYQLAQGGTAVGTGLNTKKGFDVKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKIGYDNAAAVAKKAHKEGTTLKKAALDLGVLTEQEFHELVVPEKMIGPSD

SEQ ID NO: 3259 - protein, 496 aa, Setaria italica
MAMALRRLAGVSGSPSAAAAALLLRPALTRPISTGFREERDTFGPIQVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGGKFVHPNDHVNRSQSSNDTFPTVMHIAAAVEINSKFIPSLQQLHDSLHAKSVEFIDIIKIGRTHTQDATPLTLGQEFSGYTTQVKYGIDRINCTLPRMYQLAQGGTAVGTGLNTKKGFDVKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKIGYDNAAAVAKKAHKEGTTLKKAALDLGVLTEEEFHELVVPEKMIGPSD

SEQ ID NO: 3260 - protein, 496 aa, Panicum virgatum
MAMALRRLAGLPGSPSAAAAALLFRPALTRPISTGFREERDTFGPIQVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGEKFVHPNDHVNRSQSSNDTFPTVMHIAAAVEINSKFIPSLQQLHDSLHSKSVEFNDIIKIGRTHTQDATPLTLGQEFSGYTTQVKYGIDRINCTLPRMYQLAQGGTAVGTGLNTKKGFDVKIAAAVAEETSLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVFKPMIAAGLLRSLRLLGDASVSFEKNCVRGIQANHKRISQLLHESLMLVTSLNPKIGYDNAAAVAKKAHKEGTTLKKAALDLGVLTEDEFHELVVPEKMIGPSD

SEQ ID NO: 3261 - protein, 498 aa, Zea mays
MAMALRRLAGVSGSPSASSAAATVLLRSALTRPISTGFREERDTFGPIQVPNDKLWGAQTQRSLQNFDIGGERERMPVPIIRAFGVLKKCAAKVNMDYGLDPTIGKAIIQAAEEVAEGKLDDHFPLVIWQTGSGTQSNMNANEVIANRASEILGHKRGEKFVHPNDHVNRSQSSNDTFPTVMHIATAVEIHSRFIPSLQQLHDSLHSKTIEFKDIIKIGRTHTQDATPLTLGQEFSGYTTQVKYGIDRINCTLPRMYQLAQGGTAVGTGLNTKKGFDAKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTIGGANGHFELNVFKPMIAAGLLRSLRLLGDASVSFEKNCVRGIQANHKRISQLLHESLMLVTSLNPKIGYDNAAAVAKKAHKEGTTLKEAALDLGVLTEQEFHELVVPEKMIGPSD

SEQ ID NO: 3262 - protein, 497 aa, Pennisetum glaucum
MAMALRRLAGVPGSPSPAAAALLLRPVLTRPISTGFREERDTFGPIQVPNDKLWGAQTQRSLQNFDIGGERERMPVPIIRAFGVLKKCAAKVNMEYGLDPTIGKAIMQAAEEVAEGQLDDHFPLVIWQTGSGTQSNMNANEVIANRAAEILGHKRGGKFVHPNDHVNRSQSSNDTFPTVMHIAAAVEINSKFIPSLQQLHDSLHAKSVEFNDIIKIGRTHTQDATPLTLGQEFSGYTTQVKYGIDRISCTLPRMYQLAQGGTAVGTGLNTKKGFDVKIAAAVAEETNLPFVTAENKFEALAAHDAFVESSGAVNTISASLMKIANDIRLLGSGPRCGLGELILPENEPGSSIMPGKVNPTQCEALTMVCAQVMGNHVGVTVGGANGHFELNVYKPMIAAGLLRSLRLLGDASVSFEKNCVRGIQANRKRIEQLLHESLMLVTSLNPKIGYDNAAAVAKKAHKEGTTLKEAALDLGVLTEEEFHELVVPEKMICPCDD

SEQ ID NO: 3263 - protein, 494 aa, Triticum aestivum
MAMVLRRLAGASGSPSAAALLLRPALTRPISTGFREERDTFGPIRVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGDKFVHPNDHVNRSQSSNDTFPTVMHIAAAVEINSRFIPSLEQLHKSLHSKSDEFKDIIKIGRTHTQDATPLTLGQEFSGYATQVKYGIDRIACTLPRMYQLAQGGTAVGTGLNTKKGFDGKIAAAVAEETELPFVTAENKFEALAAHDAFVESSGAVNTISASLMKIANDIRLLGSGPRCGLGELILPENEPGSSIMPGKVNPTQCEALTMVCAQVMGNHVGVTIGGSNGHFELNVYKPMIAAGLLRSLRLLGDASVSFEKNCVRGIEANHKRISQLLHESLMLVTSLNPKIGYDNAAAVAKKAHKEGTTLKEAALSLGVLTEKEFHELVVPEKMIGPSD

SEQ ID NO: 3264 - protein, 494 aa, Hordeum vulgare
MAMVLRRLAGASGSPSAAALLLRPALTRPISTDFREERDTFGPIRVPNDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGDKFVHPNDHVNRSQSSNDTFPTVMHIAAAVEINSRFIPSLEQLHKSLHSKSDEFKDIIKIGRTHTQDATPLTLGQEFSGYATQVKYGIDRIACTLPRMYQLAQGGTAVGTGLNTKKGFDGKIAAAVAEETELPFVTAENKFEALAAHDAFVESSGAVNTISASLMKIANDIRLLGSGPRCGLGELILPENEPGSSIMPGKVNPTQCEALTMVCAQVMGNHVGVTIGGSNGHFELNVYKPMIAAGLLRSLRLLGDASVSFEKNCVRGIEANHKRISQLLHESLMLVTSLNPKIGYDNAAAVAKKAHKEGTTLKEAALSLRVLTEKEFHELVVPEKMIGPSD

SEQ ID NO: 3265 - protein, 494 aa, Brachypodium distachyon
MAMVLRRLAGASGSPSAAALLFRPALTRPISTGFREERDTFGPIRVPSDKLWGAQTQRSLQNFDIGGERERMPVPIIRAFGVLKKCAAKVNMEYGLDPTIGKAIMQAAEEVAEGKLDDHFPLVIWQTGSGTQSNMNANEVIANRAAEILGHKRGDKFVHPNDHVNRSQSSNDTFPTVMHIAAAVEINSRFIPSLEQLHKSLHSKSDEFKDIIKIGRTHTQDATPLTLGQEFSGYATQVKYGIDRIACTLPRMYQLAQGGTAVGTGLNTKKGFDCKIAAAVAEETDLPFVTAENKFEALAAHDAFVESSGAVNTISASLMKIANDIRLLGSGPRCGLGELSLPENEPGSSIMPGKVNPTQCEALTMVCAQVMGNHVGVTIGGSNGHFELNVFKPMIAAGLLRSLRLLGDASVSFEKNCVRGIEANHKRISQLLHESLMLVTSLNPKIGYDNAAAVAKKAHKEGTTLKEAALSLGVLTEKEFHELVVPEKMIGPSD

SEQ ID NO: 3266 - protein, 502 aa, Oryza sativa
MAMVLRRLAGASAGGAPSPAAAAAAAALLLRPALARPISTGFREERDTFGPIRVPNDKLWGAQTQRSLQNFDIGGERERMPVPIIRAFGVLKKCAAKVNMEYGLDPTIGKAIMQAAQEVAEGQLDDHFPLVIWQTGSGTQSNMNANEVIANRAAEILGHKRGEKFVHPNDHVNRSQSSNDTFPTVMHIAAATEINSRFVPSLQQLHKSLDSKSVEFQDIIKIGRTHTQDATPLTLGQEFSGYATQVKYGIDRIVCTLPRMYQLAQGGTAVGTGLNTKKGFDVKIAAAVAEETELPFVTAENKFEALAAHDAFVESSGAVNTISASLMKIANDIRLLGSGPRCGLGELILPENEPGSSIMPGKVNPTQCEALTMVCAQVMGNHVGVTVGGSNGHFELNVFKPMIAAGLLRSLRLLGDASVSFEKNCVRGIQANHKRISQLLHESLMLVTSLNPKIGYDNAAAVAKKAHKEGSTLKEAALDLGVLTESEFHELVVPEKMIGPSD

SEQ ID NO: 3267 - protein, 488 aa, Aristolochia fimbriata
MAMFIASRRLSGFSTFRTTGVRWMSTSFREERDTFGPIQVPSDKLWGAQTQRSLQNFDIGGEREQMPEPIIRAFGILKKCAAKVNMEYGLDPSIGKAIMQAAQEVAEGKLNDHFPLVIWQTGSGTQSNMNANEVIANRAAEILGHKRGEKLVHPNDHVNRGQSSNDTFPTVMHIAAGVEINSRFIPSLKQLHTSLHSKSIEFKDIIKIGRTHTQDATPLTLGQEFSGYTTQVKYGIDRVMVTLPRMYQLAQGGTAVGTGLNTKKGFDVKIAAAVAEETNLPFVTAENKFEALAAHDAFIETSGALNTISASLMKIANDIRLLGSGPRCGLGELILPENEPGSSIMPGKVNPTQCEALTMVCAQVMGNHVAITVGGSNGHFELNVFKPMIASGLLRSLRLLGDASASFEKNCVRGIKANTERISKLLHESLMLVTSLNPKIGYDKAAAVAKKAHKEGSNLKEAALNLGVLTAQEFDELVVPEKMIGPSD

SEQ ID NO: 3268 - protein, 491 aa, Aquilegia formosa
MALLTASRRISSSTLATTLRYACFRSFSTVFREERDTFGPIQVPSDKLWGAQTQRSLQNFDIGGEREQMPEPIIRAFGVLKKCAAKVNMDYGLDPTIGKAIMQAAQEVSEGKLNDQFPLVIWQTGSGTQSNMNANEVIANRASEILGHKRGEKFVHPNDHVNRSQSSNDTFPTVMHIASAVEINSSFIPKLKQLHTSLESKSFEFKDIIKIGRTHTQDATPLTLGQEFSGYTTQVKYGLDRVMCTLPRMYQLAQGGTAVGTGLNTKKGFDVKIANAVAEETNLPFITAENKFEALAAHDAFVETSGALNTVSVSLMKIANDIRLLGSGPRCGLGELILPENEPGSSIMPGKVNPTQCEALTMVCAQVMGNHVAITVGGSNGHFELNVYKPMIASGLLRSLRLLGDASASFEKNCVRGIQANRDRISKLLHESLMLVTSLNPKIGYDNAAAVAKKAHKEGSTLKDAALMLGVLTSEEFDQLVVPEKMIGPSD

SEQ ID NO: 3269 - protein, 497 aa, Eucalyptus grandis
MAAYVVSRRLSSGSAAPSHLAGALRYAACWRSYSTGFREERDTFGPILVPSDRLWGAQTQRSLQNFDIGGERERMPEPIVRAFGVLKKCAAKVNLEYGLDPSIGEAIMQAAQEVAEGKLNDHFPLVIWQTGSGTQSNMNANEVIANRAAEILGRKRGEKFVHPNDHVNRSQSSNDTFPTVMHIAAAMEINSRLLPSLGNLHSSLHSKSIEFKDIVKIGRTHTQDATPLTLGQEFSGYSTQVKYGIDRVNCTLPRMYQLAQGGTAVGTGLNTKKGFDVKIAAAVAEETSLPFITAENKFEALAAHDAFVETSGALNTVATSLMKIANDIRFLGSGPRCGLGELILPENEPGSSIMPGKVNPTQCEALTMVCARVMGNHVAVTVGGSNGHFELNVFKPMIASGLLQSLRLLGDASSSFDKNCVHGIQANRERISKLLHESLMLVTSLNPKIGYDNAAAVAKKAHKEGSTLKEAALKLGVLTSEEFDNLVVPEKMIGPSD

SEQ ID NO: 3270 - protein, 493 aa, Prunus persica
MAMYIISRRVVGGSTPSTAFRYATCWRPYSTSFREERDTFGPILVPSDKLWGAQTQRSLQNFDIGGERERMPEPIVRAFGVLKKCAAKVNMEYGLDPTIGKAIMQAAQEVAEGKLNQHFPLVVWQTGSGTQSNMNANEVIANRAAEILGHKRGEKIVHPNDHVNRSQSSNDTFPTVMHIASAVEINSRLIPNLRTLHTSLHSKSDEFKDIVKIGRTHTQDATPLTLGQEFSGYSTQVKYGIDRVLCTLPRMYQLAQGGTAVGTGLNTKKGFDVKIAAAVAEETNLPFVTAENKFEALAAHDAFVETSGALNTVATSLMKIANDIRLLGSGPRCGLGELILPENEPGSSIMPGKVNPTQCEALTMVCAQVFGNHVAITVGGSNGHFELNVFKPMIASGLLHSVRLLGDASASFEKNCVRGIKANRERISKLLHESLMLVTSLNPKIGYDNAASVAKKAHKEGSTLKEAALKLGVLTSEEFDTLVVPEKMIGPSD

SEQ ID NO: 3271 - protein, 496 aa, Gossypium hirsutum
MAMYIVSRRLSAGSTTSQLVTSLRYATCWRSFSTSFREERDTFGPINVPSDKLWGAQTQRSLQNFEIGGERERMPEPIIRAFGVLKKCAAKVNMEYGLDPTIGKAIMQAAEEVAEGKLNDHFPLVVWQTGSGTQSNMNANEVIANRAAEILGHQRGEKFVHPNDHVNRSQSSNDTFPTVMHIAAAMEINSRLIPKLKILHSTLHSKSIEFKDIVKIGRTHTQDATPLTLGQEFSGYTTQVKYGIDRVLCTLPRMYQLAQGGTAVGTGLNTKKGFDAKIAAAVADETNLPFVTAENKFEALAAHDAFVETSGALNTVATSLMKVANDIRLLGSGPRCGLGELILPENEPGSSIMPGKVNPTQCEAITMVCAQVMGNHVAITVGGSNGHFELNVFKPMIANALLHSLRLLGDASASFEKNCVRGIQANRERISKLLHESLMLVTSLNPKIGYDNAAAVAKKAHKEGSTLKEAALSLGVLTSEEFDTLVVPEKMIGPSD

SEQ ID NO: 3272 - protein, 491 aa, Aquilegia formosa
MALLTASRRISSSTSATTLRYAYFRSFLTAFREERDTFGPIQVPSDKLWGAQTQRSLQNFDIGGEREQMPEPIIRAFGVLKKCAAKVNMDYGLDPTIGKAIMQAAQEVSEGKLNDQFPLVIWQTGSGTQSNMNANEVIANRASEILGHKRGEKFVHPNDHVNRSQSSNDTFPTVMHIASAVEINSSFIPKLKQLQTSLESKSFEFKDIIKIGRTHTQDATPLTLGQEFSGYTTQVKYGLDRVMCTLPRMYQLAQGGTAVGTGLNTKKGFDVKIANAVAEETNLPFITAENKFEALAAHDAFVETSGALNTVSVSLMKIANDIRLLGSGPRCGLGELILPENEPGSSIMPGKVNPTQCEALTMVCAQVMGNHVAITVGGSNGHFELNVYKPMIASGLLRSLRLLGDASASFEKNCVRGIQANRERISKLLHESLMLVTSLNPKIGYDNAAAVAKKAHKEGSTLKDAALMLGVLTSEEFDQLVVPEKMIGPSD

SEQ ID NO: 3273 - protein, 497 aa, Unknown
  Sequence found in Organisms: Citrus sinensis, Citrus clementina, Citrus sinensis
MAVYVISRRLLGGGSTTSQLAGTLRYGACWRSYSTSFREEKDTFGPILVPSDKLWGAQTQRSLQNFDIGGERERMPEPIVRAFGILKKCAAKVNMEYGLDPAIGKAIMQAAQEVAEGKLNDHFPLVVWQTGSGTQSNMNANEVIANRAAEILGHKRGEKIVHPNDHVNRSQSSNDTFPTVMHIAAAMETNSRLIPNLKVLHNSLHSKSVEFKDIVKIGRTHTQDATPLTLGQEFSGYTTQVKYGIDRVICCLPRMYQLAQGGTAVGTGLNTKKGFDVKIASAVAEETSLPFVTAENKFEALAAHDAFVETSGALNTVAASLMKIANDVRLLGSGPRCGLGELILPENEPGSSIMPGKVNPTQCEALTMVCAQVIGNHVAITVGGSNGHFELNVFKPMIASGLLHSLRLLGDASASFEKNCVRGIQANRERISKLLHESLMLVTSLNPKIGYDNAAAVAKKAHKEGTTLKDAALKLGVLNSEEFDNLVVPEKMIGPSD

SEQ ID NO: 3274 - protein, 496 aa, Gossypium hirsutum
MAMYIVSRRLSAGSTTSQLVTSLRYATCWRSFFTSFREERDTFGPINVPSDKLWGAQTQRSLQNFEIGGERERMPEPIIRAFGVLKKCAAKVNMEYGLDPTIGKAIMQAAEEVAEGKLNDHFPLVVWQTGSGTQSNMNANEVIANRAAEILGHQRGEKFVHPNDHVNRSQSSNDTFPTVMHIAAAMEINSRLIPKLKILHSTLHSKSIEFKDIVKIGRTHTQDATPLTLGQEFSGYTTQVKYGIDRVLCTLPRMYQLAQGGTAVGTGLNTKKGFDAKIAAAVADETNLPFVTAENKFEALAAHDAFVETSGALNTVATSLMKVANDIRLLGSGPRCGLGELILPENEPGSSIMPGKVNPTQCEAITMVCAQVMGNHVAITVGGSNGHFELNVFKPMIANALLHSLRLLGDASASFEKNCVRGIQANRERISKLLHESLMLVTSLNPKIGYDNAAAVAKKAHKEGSTLKEAALSLGVLTSEEFDTLVVPEKMIGPSD

SEQ ID NO: 3275 - protein, 496 aa, Quercus alba
MAMYALPRRLSISGGSAIGALRYITTTVLKPLPTSFREERDTFGPILVPSDKLWGAQTQRSLQNFDIGGDRERMPEPIIRAFGILKRCAAKVNMEYGLDPMVAKAIMQAAQEVAEGKLNDHFPLVVWQTGSGTQSNMNANEVIANRAAEILGHKRGEKVVHPNDHVNRSQSSNDTFPTVMHIAAAMEINSRLIPNLKHLHTSLNSKSVEFKDIVKIGRTHTQDATPLTLGQEFSGYSTQVKYGIDRVFCTLPRMYQLAQGGTAVGTGLNTKKGFDVKIAAAVAEETNLPFVTAENKFEALAAHDAFVETSGALNTIAASLMKIANDIRLLGSGPRCGLGELILPENEPGSSIMPGKVNPTQCEALTMVCAQVMGNHVAITVGGSNGHFELNVYKPLIASGLLHSVRLLGDASASFEKNCVRGIQANRERISKLLHESLMLVTSLNPKIGYDNAAAVAKKAHKEGSTLKEAALNLGVLTSEEFDTLVVPEKMIGPSD

SEQ ID NO: 3276 - protein, 496 aa, Gossypium hirsutum
MAMYIVSRRLSAGSTTSQLVTSLRYATCWRSFSTSFREERDTFGPINVPSDKLWGAQTQRSLQNFEIGGERERMPEPIIRAFGVLKKCAAKVNMEYGLDPTIGKAIMQAAQEVAEGKLNDHFPLVVWQTGSGTQSNMNANEVIANRAAEILGHQRGEKFVHPNDHVNRSQSSNDTFPTVMHIAAAMEINSRLIPKLKILHSTLHSKSIEFKDIVKIGRTHTQDATPLTLGQEFSGYTTQVKYGIDRVLCTLPRMYQLAQGGTAVGTGLNTKKGFDAKIAAAVADETNLPFVTAENKFEALAAHDAFVETSGALNTVATSLMKVANDIRLLGSGPRCGLGELILPENEPGSSIMPGKVNPTQCEAITMVCAQVMGNHVAITVGGSNGHFELNVFKPMIANALLHSLRLLGDASASFEKNCVRGIQANRERISKLLHESLMLVTSLNPKIGYDNAAAVAKKAHKEGSTLKEAALSLGVLTSEEFDTLVVPEKMIGPSD

SEQ ID NO: 3277 - protein, 165 aa, Gossypium hirsutum
MAMYIVSRRLSAGSTTSQLVTSLRYATCWRSFSTSFREERDTFGPINVPSDKLWGAQTQRSLQNFEIGGERERMPEPIIRAFGVLKKCAAKVNMEYGLDPTIGKAIMQAAQEVAEGKLNDHFPLVVWQTGSGTQSNMNANEVIANRAAEILGHQRGESLCTQMIM

SEQ ID NO: 3278 - protein, 494 aa, Cucumis melo
MAAVYVLSRRSSPSHLFGMARYATTSLRSYSTSFREERDTFGPINVPSDRLWGAQTQRSLQNFEIGGDRERMPEPIIRAFGVLKKCAAKVNMEYGLDPTIGKAIMQAAQEVAEGKLNDHFPLVVWQTGSGTQSNMNANEVIANRASEILGHKRGEKFVHPNDHVNRSQSSNDTFPTVMHIAAATEINSKFIPKLKTLHSSLYSKSIEFKDIVKIGRTHTQDATPLTLGQEFSGYTTQVKYGIDRVLCTLPRMYQLAQGGTAVGTGLNTKKGFDVKIAAAVAEETNLPFVTAENKFEALAAHDAFVETSGSLNTVAASLMKIANDIRLLGSGPRCGLGELILPENEPGSSIMPGKVNPTQCEALTMVCAQVMGNHVAITVGGSNGHFELNVYKPMIANALLHSLRLLGDASASFEKNCVRGIQANRERISKLLHESLMLVTALNPKIGYDNAAAVAKKAHKEGCTLKEAALKLGVLCEEEFDKHVVPEKMIGPSG

SEQ ID NO: 3279 - protein, 493 aa, Malus domestica
MAMYIVSRRAAGGSTPMAALRYATSLRPYSTKFREERDTFGPINVPSDKLWGAQTQRSLQNFDIGGERERMPEPIVRAFGVLKKCAAKVNMEYGLDPTIGKAVMQAAQEVAEGKLNEHFPLVIWQTGSGTQSNMNANEVIANRAAEILGHQRGEKFVHPNDHVNRSQSSNDTFPTVMHIASAMEINSRLIPNLKTLHAALHSKSEEFKDIVKIGRTHTQDATPLTLGQEFSGYSTQVKYGIERVLLTLPRMYQLAQGGTAVGTGLNTKKGFDVKIAAAVAEETKLPFVTAENKFEALAAHDAFVETSGALNTVATSLMKIANDIRLLGSGPRCGLGELILPENEPGSSIMPGKVNPTQCEALTMVCAQVMGNNVAITVGGSNGHFELNVFKPMIASGLLHSVRLLGDASASFEKNCVRGIQANRERISKLLHESLMLVTSLNPKIGYDNAAAVAKTAHKEGSTLKEAALKLGMLSSEEFDTLVVPEKMIGPTD

SEQ ID NO: 3280 - protein, 490 aa, Populus trichocarpa
MAMYIVSRRLSTGSTTWRYGNWLRSYSTAFREERDTFGPISVPADKLWGAQTQRSLQNFDIGGDRERMPEPIIRAFGILKKCAAKVNMQYGLDPSIGKAIMQAAHEVAEGKLSDHFPLVVWQTGSGTQSNMNANEVIANRAAEILGHKRGEKFVHPNDHVNRSQSSNDTFPTVMHIAAATEINSRLIPKLKTLHLTLHSKSVEFKDIVKIGRTHTQDATPLTLGQEFSGYTTQVKYGIDRVMCTLPHMYQLAQGGTAVGTGLNTKKGFDVKIASAVAEETNLPFVTAENKFEALAAHDAFVETSGALNTVATSLMKIANDIRLLGSGPRCGLGELILPENEPGSSIMPGKVNPTQCEALTMVCAQVMGNHVAITVGGSNGHFELNVFKPMIASGLLHSIRLLGDASASFEKNCVRGIQANRERISKLLHESLMLVTSLNPKIGYDNAAAVAKLAHKEGSTLKEAALKLGMLTSEEFDTLVVPEKMIGPTD

SEQ ID NO: 3281 - protein, 496 aa, Theobroma cacao
MAMYIVSRRLSAGSTTSQLVTSLRYATCWRSYSTSFREERDTFGPINVPSDKLWGAQTQRSLQNFEIGGERERMPEPIIRAFGILKKCAAKVNMDYGLDPTIGKAIMQAAQEVAEGKLNDHFPLVVWQTGSGTQSNMNANEVIANRAAEILGHKRGDKFVHPNDHVNRSQSSNDTFPTVMHIAAAMEINSRLTPKLKILRSTLHSKSIEFKDIVKIGRTHTQDATPLTLGQEFSGYTTQVKYGIDRVLCTLPRMYQLAQGGTAVGTGLNTKKGFDEKMAAAVADETQLPFVTAENKFEALAAHDAFVETSGALNTIATSLMKVANDIRLLGSGPRCGLGELILPENEPGSSIMPGKVNPTQCEALTMVCAQVMGNHVAITVGGSNGHFELNVFKPMIASALLHSVRLLGDASASFEKNCVRGIQANRERISKLLHESLMLVTSLNPKIGYDNAAAVAKKAHKEGSTLKEAALKLGVLTSEEFDNLVVPEKMIGPSD

SEQ ID NO: 3282 - protein, 495 aa, Phaseolus coccineus
MALYAASRRLSTGSNSTTLLALRFASSSRSYSSSFREERDTFGPIQVPSDKLWGAQTQRSLQNFDIGGPRERMPEPIVRAFGVLKKCAAKVNMEYGLDPNVGKAIMQAAQEVAEGKLNDHFPLVVWQTGSGTQSNMNANEVIANRAAEILGHKRGEKVVHPNDHVNRSQSSNDTFPTVMHIAAAMEINSRLIPSLKTLHGTLNSKSIEFKDIVKIGRTHTQDATPLTLGQEFSGYSTQVKYGIDRVISTLPHMYQLAQGGTAVGTGLNTKKGFDAKIAAAVADETNLPFVTAENKFEALAAHDAFVETSGALNTIAASLMKIGNDIRLLGSGPRCGLGELILPENEPGSSIMPGKVNPTQCEALTMVCAQVMGNHVAVTVGGSNGHFELNVFKPMIASCLLHSLRLLGDSSASFEKNCVRGIQANRERISKLLHESLMLVTSLNPKIGYDKAAAVAKTAHKEGTTLKEAALKLGVLSSEEFDKLVVPEKMLGPSD

SEQ ID NO: 3283 - protein, 495 aa, Vigna unguiculata
MALYAVSRRLSAGSNSTTLLALRFASSSRSYSSSFREERDTFGPIQVPSDKLWGAQTQRSLQNFDIGGPRERMPEPIIRAFGVLKKCAAKVNMDYGLDPNVGKAIMQAAQEVAEGKLNDHFPLVVWQTGSGTQSNMNANEVIANRAAEILGHKRGDKFVHPNDHVNRSQSSNDTFPTVMHIAAAMEINSRLIPSLKTLHGTLNSKSIEFKDIVKIGRTHTQDATPLTLGQEFSGYTTQVKYGIDRVIGTLPRMYQLAQGGTAVGTGLNTKKGFDAKIAAAVADETNLPFVTAENKFEALAAHDAFVETSGALNTIAASLMKIANDIRLLGSGPRCGLGELILPENEPGSSIMPGKVNPTQCEALTMVCAQVMGNHVAVTVGGSNGHFELNVFKPMIASCLLHSLRLLGDSSASFEKNCVRGIQANRERISKLLHESLMLVTSLNPKIGYDKAAAVAKTAHKEGTTLKEAALKLGVLSSEDFDKLVVPEKMLGPSD

SEQ ID NO: 3284 - protein, 491 aa, Mimulus guttatus
MAMLIISRRLSGRSPMTSSIAANLRWYSTSFREERDTFGPIQVPSDKLWGAQTQRSLQNFEIGGDRERMPEPIVRAFGILKKCAAKVNMEYGLDPSIGKAIMQAAQEVADGKLNDHFPLVVWQTGSGTQSNMNANEVIANRAAEILGHKRGEKVVHPNDHVNRSQSSNDTFPTVMHIAAAMEINSLLIPKLKQLHTTLHSKSVEFKDIVKIGRTHTQDATPLTLGQEFSGYTTQVKYGIDRVSCTLPRMYQLAQGGTAVGTGLNTRKGFDVKIAAAVAEETNLPFVTAENKFEALAAHDAFAETSGALNTIAVSLMKIANDIRFLGSGPRCGLGELILPENEPGSSIMPGKVNPTQCEAITMVCAQVMGNNVAITVGASNGHFELNVFKPVIASNLLHSLRLLGDASASFEKNCVRGIQANKERIAKLLHESLMLVTSLNPKIGYDNAALVAKTAHKEGSTLKDAALKLGVLSSEEFDTLVVPEKMIGPSD

SEQ ID NO: 3285 - protein, 491 aa, Triphysaria pusilla
MAMLVIRRRLTSRSQTSSYLSATFRCYSTSFREERDTFGPIQVPSDKLWGAQTQRSLQNFEIGGERERMPEPIIRAFGILKKCAAKVNMEYGLDPSIGKAVMQAAQEVAEGKLNDHFPLVVWQTGSGTQSNMNANEVIANRAAEILGHKRGAKVVHPNDHVNRSQSSNDTFPTVMHIAAAMEINSSLIPKLKQLHTTLHSKTAEFEDIVKIGRTHTQDATPLTLGQEFSGYTTQVKYGIDRVSRTLPSMYQLAQGGTAVGTGLNTKKGFDVKIAAAVAEETNLPFVTAENKFEALAAHDAFVETSGSLNTIAVSLMKIANDIRFLGSGPRCGLGELILPENEPGSSIMPGKVNPTQCEALTMVCAQVMGNHVAITVGGSNGHFELNVFKPVIASNLLHSLRLLGDASASFEKNCVRGIQANRERISKLLHESLMLVTSLNPKIGYDNAALVAKTAHKEGSTLKDAALKLGVLSSEEFDTLVVPEKMIGPSD

SEQ ID NO: 3286 - protein, 497 aa, Lotus japonicus
MALYVLSRRLSSGSTSTTALALRFVSASRSYSSSSFREERDTFGPIQVPSDKLWGAQTQRSLQNFDIGGPRERMPEPIIRAFGILKKCAAKVNMEYGLDPTIAKAVMQAAQEVAEGKLNDHFPLVVWQTGSGTQSNMNANEVIANRAAEILGHKRGEKHVHPNDHVNRSQSSNDTFPTVMHIAAAMEINSRVIPSLKTLHSTLNSKSIEFKDIVKIGRTHTQDATPLTLGQEFSGYTTQVKYGIDRVISTLPHMYQLAQGGTAVGTGLNTKKGFDVKIANAVADETHLPFVTAENKFEALAAHDAFVETSGALNTVATSLMKVANDIRLLGSGPRCGLGELILPENEPGSSIMPGKVNPTQCEALTMVCAQVMGNHVAITVGGSNGHFELNVFKPMMASCLLHSLRLLGDASASFEKNCVRGIQANRERISKLLHESLMLVTSLNPKIGYDNAAAVAKKAHKEGTTLKEAALKLGVLSSEDFDNLVVPEKMIGPSEI

SEQ ID NO: 3287 - protein, 494 aa, Helianthus annuus
MAMVQAYRRISGGSVVCADSLRLTTCWRYFSTGFREERDTFGPIQVPSDKLWGAQTQRSLQNFEIGGDRERMPEPIIRSFGILKKCAAKVNMEYGLDPSIGKAIMEAAQEVAEGKLNDHFPLVVWQTGSGTQSNMNANEVIANRAAEILGHKRGDKFVHPNDHVNRSQSSNDTFPTVMHIAAATEINSRLIPKLKQLHTSLQAKTNEFSDIVKIGRTHTQDATPLTLGQEFSGYTTQVKYGIDRVICTLPRMYQLAQGGTAVGTGLNTKKGFDVKIAAAVADETRLPFVTAENKFEALAAHDAFVEASGALNTIAASLMKIANDIRFLGSGPRCGLGELILPENEPGSSIMPGKVNPTQCEALTMVCAQAIGNHVALTVGGSNGHFELNVFKPMIASSLLHSIRLLADASASFEKNCVRGIQANKDRISKLLHESLMLVTSLNPKIGYDNAAAVAKTAHKQGCTLKEAALQLGVLTSEEFEQLVVPEKMIGPTD

SEQ ID NO: 3288 - protein, 492 aa, Fragaria vesca
MAMYVISRRVTAGSTPFRYAATTCWRNYSTSFREERDTFGPILVPSDKLWGAQTQRSLQNFDIGGERERMPEPIIRAFGVLKKCAAKVNMEYGLDQSIGKAIMQAAQEVAEGKLNQHFPLVVWQTGSGTQSNMNANEVIANRAAEILGHKRGDKFVHPNDHVNRSQSSNDTFPTVMHIASAMEINSRLIPNLKALHSSLHSKSDEFKDIVKIGRTHTQDATPLTLGQEFSGYSTQVKYGIERVLCTLPRMYQLAQGGTAVGTGLNTKKGFDVKIAAAVADETNLPFVTAENKFEALAAHDAFVETSGALNTVATSLMKIANDIRLLGSGPRCGLGELILPENEPGSSIMPGKVNPTQCEAITMVCAQVMGNNVAITVGGSNGHFELNVFKPMIASALLHSVRLLGDASASFEKNCVRGIEANRERISKLLHESLMLVTSLNPKIGYDNAAAVAKKAHKEGSTLKEAALKLGVLTSEEFDTLVVPEKMIGPTD

SEQ ID NO: 3289 - protein, 491 aa, Orobanche aegyptiaca
MAMLVIGRRLTTRLQTTSYFPASFRWYSTSFREERDTFGPIQVPSDRLWGAQTQRSLQNFEIGGERERMPEPIIRAFGILKKCAAKVNMEYGLDPSIGKAIMQAAQEVAEGKLNDHFPLVVWQTGSGTQSNMNANEVIANRAAEILGHKRGEKIVHPNDHVNRSQSSNDTFPTVMHIAAAMEINRGLIPKLKQLHTTLHSKSVEFKDIVKIGRTHTQDATPLTLGQEFSGYTTQVKYGIDRVSCTLPRMYQLAQGGTAVGTGLNTKKGFDVKIATAVAEETNLPFITAENKFEALAAHDAFVETSGALNTIAVSLMKIANDVRFLGSGPRCGLGELILPENEPGSSIMPGKVNPTQCEALTMVCAQVMGNHVAITVGGSNGHFELNVFKPVIASNLLQSLRLLGDASASFEKNCVRGIQANRERISKLLHESLMLVTSLNPKIGYDNAALVAKTAHKEGSTLKDAALKLGVLNSEEFDTLVVPHKMIGPSD

SEQ ID NO: 3290 - protein, 496 aa, Zostera marina
MTMMLAALRGLSSRSTGSVMDVLLRSCSSRYLSTGFREEKDTFGPILVPLEKYWGAQTQRSLQNFDIGGEREKMPEPVIRAFGVLKKCAAKVNMEYGLDKTIGKAIMQASQEVADGKLNDHFPLVIWQTGSGTQSNMNANEVIANRAGEILGHQRGDKFVHPNDHVNRAQSSNDTFPTVMHIASATEINSSFIPSMEKLHSSLHSKSVEFKDIIKIGRTHTQDATPLTLGQEFSGYTTQVKYGINRIKDTLPRMYQLAQGGTAVGTGLNSKKGFDVKIAAAVAEETGLPFVTAENKFEALAAHDAFIETSGALNTISASLMKVGNDIRLLGSGPRCGLGELILPENEPGSSIMPGKVNPTQCEALTMVCAQVMGNHVAITIGGSNGHFELNVYKPMIASGLLRSLRLLGDVSLSFEKNCIRGIEANHGRISKLLYESLMLVTSLNPKIGYDKAAAVAKKAHKEGTTLKESAMQLGVLTAQEFDDLVVPGKMIGPSD

SEQ ID NO: 3291 - protein, 492 aa, Arabidopsis lyrata
MAIYVASRRLSGGTTATALRYATSLRSYSTSFREERDTFGPIQVPSDKLWGAQTQRSLQNFEIGGERERMPEPIVRAFGVLKKCAAKVNMEYGLDPTIGKAIMQAAQEVAEGQLNDHFPLVVWQTGSGTQSNMNANEVIANRAAEILGRKRGEKCVHPNDHVNRSQSSNDTFPTVMHIAAATEINSRLIPSLKTLHSTLESKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIAASLMKIANDIRFLGSGPRCGLGELVLPENEPGSSIMPGKVNPTQCEALTMVCAQVMGNHVAVTVGGSNGHFELNVFKPVIASALLHSVRLIADASASFEKNCVRGIEANRERISKLLHESLMLVTSLNPKIGYDNAAAVAKKAHKEGCTLKDAALKLGVLTAEEFDTLVVPEKMIGPSD

SEQ ID NO: 3292 - protein, 495 aa, Glycine max
MAFYVLSRRLSAGSNSTTLLALRFASSSRSFSSSFREERDTFGPIQVPSDKLWGAQTQRSLQNFDIGGPRERMPEPIIRAFGVLKKCAAKVNMEYGLDPIVGEAIMQAAQEVAEGKLNEHFPLVVWQTGSGTQSNMNANEVIANRAAEILGHKRGGKFVHPNDHVNRSQSSNDTFPTVMHIAATMEINSRLIPSLKTLHGTLNSKSIEFKDIVKIGRTHTQDATPLTLGQEFSGYTTQVKYGIDRVIGTLPHLYQLAQGGTAVGTGLNTKKGFDAKIAAAVAEETNLPFVTAENKFEALAAHDAFVETSGALNTIAASLMKIANDIRLLGSGPRCGLGELILPENEPGSSIMPGKVNPTQCEALTMVCAQVIGNHVAVTVGGSNGHFELNVFKPMIASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 3293 - protein, 495 aa, Glycine max
MAFYVLSRRLSAGSNSTTLLALRFASSSRSFSSSFREERDTFGPIQVPSDKLWGAQTQRSLQNFDIGGPRERMPEPIIRAFGVLKKCAAKVNMEYGLDPIVGEAIMQAAQEVAEGKLNEHFPLVVWQTGSGTQSNMNANEVIANRAAEILGHKRGGKFVHPNDHVNRSQSSNDTFPTVMHIAATMEINSRLIPSLKTLHGTLNSKSIEFKDIVKIGRTHTQDATPLTLGQEFSGYTTQVKYGIDRVIGTLPHLYQLAQGGTAVGTGLNTKKGFDAKIAAAVADETNLPFVTAENKFEALAAHDAFVETSGALNTIAASLMKIANDIRLLGSGPRCGLGELILPENEPGSSIMPGKVNPTQCEALTMVCAQVMGNHVAVTVGGSNGHFELNVFKPMIASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 3294 - protein, 494 aa, Helianthus annuus
  misc_feature (445)..(445): Xaa can be any naturally occurring amino acid
MAMVQAYRRISGGSVVCADSLRLTTCWRYFSTGFREERDTFGPIQVPSDKLWGAQTQRSLQNFEIGGDRERMPEPIIRSFGILKKCAAKVNMEYGLDPSIGKAIMEAAQEVAEGKLNDHFPLVVWQTGSGTQSNMNANEVIANRAAEILGHKRGDKFVHPNDHVNRSQSSNDTFPTVMHIAAATEINSRLIPKLKQLHTSLQAKTNEFSDIVKIGRTHTQDATPLTLGQEFSGYTTQVKYGIDRVICTLPRMYQLAQGGTAVGTGLNTKKGFDVKIAAAVADETRLPFVTAENKFEALAAHDAFVEASGALNTIAASLMKIANDIRFLGSGPRCGLGELILPENEPGSSIMPGKVNPTQCEALTMVCAQAIGNHVALTVGGSNGHFELNVFKPMIASSLLHSIRLLADASASFEKNCVRGIQANRDRISKLLHESLMLVTSLNPXNGYDNAAAVAKTAHKQGCTLKEAALQLGVLTSEEFEQLVVPEKMIGPTD

SEQ ID NO: 3295 - protein, 495 aa, Glycine max
MALYVLSRRLSAGSNSTTLLALRFVSSTRSYSSSFREERDTFGAIQVPSEKLWGAQTQRSLQNFDIGGPRERMPEPIIRAFGVLKKCAAKVNMEYGLDPAVGKAIMQAAQEVAEGKLNDHFPLVVWQTGSGTQSNMNANEVIANRAAEILWHKRGGKLVHPNDHVNRSQSSNDTFPTVMHIAAAMEINSRLIPSLKTLHGTLNSKSIEFKDIVKIGRTHTQDATPLTLGQEFSGYTTQVKYGIDRVIGTLPHMYQLAQGGTAVGTGLNTKKGFDAKIAAAVAEETNLPFVTAENKFEALAAHDAFVETSGALNTIAASLMKIANDIRLLGSGPRCGLGELILPENEPGSSIMPGKVNPTQCEALTMVCAQVIGNHVAVTVGGSNGHFELNVFKPMIASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 3296 - protein, 404 aa, Taraxacum officinale
MAMVHAYRRGGSVIVADSLRFTTSWRHFSTGFREERDTFGPIQVPSDKLWGAQTQRSLQNFEIGGDRERMPEPIIRSFGILKKCAAKVNMEYGLDPSIGKAIMEAAQEVAEGKLNDHFPLVVWQTGSGTQSNMNANEVIANRAAEILGHKRGDKFVHPNDHVNRSQSSNDTFPTVMHIAAATEINSRLIPKLKQLHTSLQSKTNEFSDIVKIGRTHTQDATPLTLGQEFSGYTTQVKYGIERVLCTLPRMYQLAQGGTAVGTGLNTKKGFDVKIAAAVADETRLPFVTAENKFEALAAHDAFVEASGALNTIATSLMKIANDIRFLGSGPRCGLGELILPENEPGSSIMPGKVNPTQCEAMTMVCAQAIGNHVALTVGGSNGHFELNVFKPMMPALFYIHKASC

SEQ ID NO: 3297 - protein, 492 aa, Arabidopsis thaliana
MSIYVASRRLSGGTTVTALRYATSLRSYSTSFREERDTFGPIQVPSDKLWGAQTQRSLQNFEIGGERERMPEPIVRAFGVLKKCAAKVNMEYGLDPTIGKAIMQAAQEVAEGKLNDHFPLVVWQTGSGTQSNMNANEVIANRAAEILGRKRGEKCVHPNDHVNRSQSSNDTFPTVMHIAAATEINSRLIPSLKTLHSTLESKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVIASALLHSVRLIADASASFEKNCVRGIEANRERISKLLHESLMLVTSLNPKIGYDNAAAVAKKAHKEGCTLKEAALNLGVLTAEEFDTLVVPEKMIGPSD

SEQ ID NO: 3298 - protein, 493 aa, Raphanus sativus
  misc_feature (17)..(17): Xaa can be any naturally occurring amino acid
  misc_feature (22)..(23): Xaa can be any naturally occurring amino acid
MSIYVASRRLSARTTAXTLRYXXALRSYSTSSFREERDTFGPIQVPSDKLWGAQTQRSLQNFEIGGERERMPEPIVRAFGVLKKCAAKVNMEYGLDPTIGKAIMEAAQEVAEGKLNDHFPLVVWQTGSGTQSNMNANEVIANRAAEILGRKRGEKCVHPNDHVNRSQSSNDTFPTVMHIAAATEINSRLIPSLKTLHSTLDSKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVIASSLLHSVRLIADASASFEKNCVRGIEANRERISKLLHESLMLVTSLNPKIGYDNAAAVAKKAHKEGSTLKEAALKLGVLTSEEFDTLVVPEKMIGPSD

SEQ ID NO: 3299 - protein, 495 aa, Glycine max
MALYVLSRRLSAGSNSTTLLALRFVSSTRSYSSSFREERDTFGAIQVPSEKLWGAQTQRSLQNFDIGGPRERMPEPIIRAFGVLKKCAAKVNMEYGLDPAVGKAIMQAAQEVAEGKLNDHFPLVVWQTGSGTQSNMNANEVIANRAAEILWHKRGGKLVHPNDHVNRSQSSNDTFPTVMHIAAAMEINSRLIPSLKTLHGTLNSKSIEFKDIVKIGRTHTQDATPLTLGQEFSGYTTQVKYGIDRVIGTLPHMYQLAQGGTAVGTGLNTKKGFDAKIAAAVAEETNLPFVTAENKFEALAAHDAFVETSGALNTVVASLMKIANDIRLLGSGPRCGLGELILPENEPGSSIMPGKVNPTQCEALTMVCAQVMGNHVAITVGGSNGHFELNVFKPMIANCLLHSLRLLGDSSASFEKNCLRGIQANRERISKLLHESLMLVTSLNPKIGYDKAATVAKTAHKEGTTLKEAALKLGVLCSEDFDKLVVPEKMLGPSD

SEQ ID NO: 3300 - protein, 354 aa, Centaurea maculosa
  misc_feature (24)..(24): Xaa can be any naturally occurring amino acid
  misc_feature (26)..(26): Xaa can be any naturally occurring amino acid
  misc_feature (33)..(33): Xaa can be any naturally occurring amino acid
  misc_feature (258)..(258): Xaa can be any naturally occurring amino acid
  misc_feature (263)..(263): Xaa can be any naturally occurring amino acid
  misc_feature (270)..(270): Xaa can be any naturally occurring amino acid
  misc_feature (282)..(282): Xaa can be any naturally occurring amino acid
MAMVQAYRRIYGGSTIVSDSIRFXTXWRHFSTXFREERDTFGPIQVPNDKLWGAQTQRSLQNFEIGGDRERMPEPIIRSFGILKKCAAKVNMEYGLDPSIGKAIMQAAQEVAEGKLNDHFPLVIWQTGSGTQSNMNANEVIANRAAEILGHKRGGKFVHPNDHVNRSQSSNDTFPTVMHIAAATEINSRLIPKLKQLHTSLQAKTTEFSDIVKIGRTHTQDATPLTLGQEFSGYTTQVKYGIDRVMCTLPRMYQLAQXGTAVXTGLNTKXGFDAKIAAAVAXETRLPFVTAENKFEALAAHDAFVEASGALNTLATSLMKIANDIRFLGSGPRCGLGELILPENEPGSSIMPGK

SEQ ID NO: 3301 - protein, 417 aa, Lactuca sativa
MTIVQAYRRISGGSVIVADSLRFTTCWRHFSTAFREERDTFGPIQVPSDKLWGAQTQRSLQNFEIGGDRERMPEPIIRSFGILKKCAAKVNMEYGLDPSIGKAIMQAAQEVAEGKLNDHFPLVVWQTGSGTQSNMNANEVIANRAAEILGHKRGDKFVHPNDHVNRSQSSNDTFPTVMHIAAATEINSRLIPKLKQLHTSLQAKTNEFSDIVKIGRTHTQDATPLTLGQEFSGYTTQVKYGIERIICTLPRMYQLAQGGTAVGTGLNTKKGFDVKIAAAVADETKLPFVTAENKFEALAAHDAFVEASGALNTIATSLMKIANDIRFLGSGPRCGLGELILPENEPGSSIMAGKVNPTQCEAMTMVCAQAYGNHVALTVGGSNGHFELNVFKPMIASNLLHSIRLIADASASFEKTV

SEQ ID NO: 3302 - protein, 179 aa, Podocarpus macrophillus
MALLLASRRYLSAVFPSSAYSLVHSISFISSRSLSVLREERDTFGPINVPADKLWGAQTQRSLQNFDIGGEREQMPEPIIRAFGVLKKCAAKVNMEYGLDPTIGKAIMQAAQEVAEGKLNDHFPLVIWQTGSGTQSNMNANEVIANRASEILGKKREKILYIQMIMSIGHNPQMIRFLR

SEQ ID NO: 3303 - protein, 494 aa, Helianthus annuus
MAMVQAFRRTPGGSAIVADSVRFITCWRHFSTAFREERDTFGPIQVPSDKLWGAQTQRSLQNFEIGGDRERMPEPIIRSFGILKKCAAKVNMEYGLDPSIGKAIMEAAQEVAEGKLNDHFPLVIWQTGSGTQSNMNANEVIANRAAEILGHKRGDKFVHPNDHVNRSQSSNDTFPTVMHIAAATEINSRLIPKLKQLHTALQAKTNEFSDIVKIGRTHTQDATPLTLGQEFSGYTTQVKYGIDRVMCTLPRMYQLAQGGTAVGTGLNTKKGFDVKIAAAVADETRLPFVTAENKFEALAAHDAFVEASGALNTIATSLMKIANDIRFLGSGPRCSLGELILPENEPGSSIMPGKVNPTQCEALTMVCAQAIGNHVALTVGGSNGHFELNVFKPMIASTLLHSIRLLADASASFEKNCVSGIQANRERISKLLHESLMLVTSLNPKIGYDNAAAVAKTAHKQGCTLKEAALKLGVLNSEEFDQLVVPEKMIGPSD

SEQ ID NO: 3304 - protein, 490 aa, Capsicum annuum
MAMLVAARRLSAVSDSLRYSYSWRFFSTSFREERDTFGPILVPSDKLWGAQTQRSLQNFEIGGDRERMPEPIIRAFGILKKCAAKVNMDYGLDQSIGKAIMQAAEEVAEGKLTDHFPLVVWQTGSGTQSNMNANEVIANRAAEILGHKPGDKHVHPNDHVNRSQSSNDTFPTVMHIAAAMELNKRLVPNLKQLHTSLNSKSVEFKDIIKIGRTHTQDATPLTLGQEFSGYATQVKYGIDRVLCTLPRMYQLAQGGTAVGTGLNTKKGFDIKIAAAVAEETNLPFVTAENKFEALAAHDAFAETSGALNTVAASLMKIGNDIRFLGSGPRCGLGELILPENEPGSSIMPGKVNPTQCEALTMVCAQVMGNHVAVTVGASNGHFELNVFKPMIANALLQSVRLLGDASASFEKNCVRGIQANRERIAKLLHESLMLVTCLNPKIGYDNAAAVAKKAHKEGTSLKDAALNLAVLNCEEFDQLVVPEKMIGPTD

SEQ ID NO: 3305 - protein, 482 aa, Cajanus cajan
MALYALSRRLSAGSNSTTLLALRFASSSRSYSSSFREERDTFGPIQVPSDKLWGAQTQRSLQNFDIGGPRERMPEPIIRAFGILKKCAAKVNMEYGLDPDVGKAIMQAAQEVAEGKLNEHFPLVVWQTGSGTQSNMNANEVIANRAAEILGHKRGEKFVHPNDHVNRSQSSNDTFPTVMHIAAAMEINSRLIPSLKILHGTLNSKSIEFKDIVKIGRTHTQDATPLTLGQEFSGYTIQVKYGIDRVIGTLPRMYQLAQGGTAVGTGLNTKRGFDAKIAAAVADETNLPFVTAENKFEALAAHDAFVETSGALNTIAASLMKIANDIRLLGSGPRCGLGELILPENEPGSSIMPGKVNPTQCEALTMVCAQVMGNHVAVTVGGSNGHFELNVFKPMIASSLLHSLRLLGDSSASFEKNCVRGIQANRERISKLLHESLMLVTSLNPKIGYDKAAAVAKTAHKEGTTLKEAALKLGVLSSEEFD

SEQ ID NO: 3306 - protein, 493 aa, Unknown
  Sequence found in Organisms: Solanum tuberosum, Solanum phureja
MAMLNAARRLSAGSALSDSLRYTSSWRFFSTSFREERDTFGPILVPSDKLWGAQTQRSLQNFEIGGDRERMPEPIIRAFGIIKKCAAKVNMDYGLDQSIGKAIMQAAEEVAEGNLNDHFPLVVWQTGSGTQSNMNANEVIANRAAEILGHNRGDKHVHPNDHVNKSQSSNDTFPTVMHIAGAMELNKRLVPNLKQLHTSLNSKSVEFKDIIKIGRTHTQDATPLTLGQEFSGYATQVKYGIDRVLCTLPRMYQLAQGGTAVGTGLNTKKGFDIKIAAAVAEETNLPFVTAENKFEALAAHDAFAETSGALNTLAASLMKIGNDIRFLGSGPRCGLGELSLPENEPGSSIMPGKVNPTQCEALTMVCAQVMGNHVAVTVGASNGHFELNVFKPMIANALLHSVRLLGDASASFEKNCVRDIQANRDRIAKLLHESLMLVTCLNPKIGYDNAAAVAKKAHKEGTSLKEAALNLGVLTSEEFDQLVVPEKMIGPTD

SEQ ID NO: 3307 - protein, 488 aa, Solanum lycopersicum
MAMLVASRRLSTIIVRYSSSSRFCSTSFREERDTFGPILVPDDKLWGAQTQRSLQNFEIGGERERMPEPIIRAFGILKKCAAKVNMEYGLDPSIGKAVMQAAQEVAEGKLNDHFPLVVWQTGSGTQSNMNANEVIANRASEILGHKRGEKHVHPNDHVNRSQSSNDTFPTVMHIAAAMEINKRLVPNLKQLHTSLHSKSAEFKDIIKIGRTHTQDATPLTLAQEFSGYVTQVKYGINRVLCTLPRMYQLAQGGTAVGTGLNTKKGFDIKIAAAVAEETNLPFVTAENKFEALAAHDAFVETSGALNTVAVSLMKIGNDIRFLGSGPRCGLGELILPENEPGSSIMPGKVNPTQCEALTMVCAQVMGNHVAVTVGGSNGHFELNVFKPMIANALLHSVRLLGDASASFEKNCVRGIQANRERIAKLLHESLMLVTCLNPKIGYDSAAAVAKKAHKEGTSLKEAALNLNVLTGDEFDKLVVPEKMIGPTD

SEQ ID NO: 3308 - protein, 494 aa, Solanum lycopersicum
MAMLNAARRLSAGSALSDSLRYTSSSWRFFSTSFREERDTFGPILVPSDKLWGAQTQRSLQNFEIGGDRERMPEPIIRAFGIIKKCAAKVNMDYGLDQSIGKAIMQAAEEVAEGKLNDHFPLVVWQTGSGTQSNMNANEVIANRAAEILGYNRGDKHVHPNDHVNKSQSSNDTFPTVMHIAAAMELNKRLVPNLKQLHTSLNSKSVEFKDIIKIGRTHTQDATPLTLGQEFSGYATQVKYGIDRVLGTLPRMYQLAQGGTAVGTGLNTKKGFDIKIAAAVAEETNLPFVTAENKFEALAAHDAFAETSGALNTVAASLMKIGNDIRFLGSGPRCGLGELSLPENEPGSSIMPGKVNPTQCEALTMVCAQVMGNHVAVTVGASNGHFELNVFKPMIANALLHSVRLLGDASASFEKNCVRDIQANRDRIAKLLHESLMLVTCLNPKIGYDNAAAVAKKAHKEGTSLKEAALNLAVLTSEEFDQLVVPEKMIGPTD

SEQ ID NO: 3309 - protein, 491 aa, Taraxacum officinale
  misc_feature (390)..(390): Xaa can be any naturally occurring amino acid
MAMVHAYRRGGSVIVADSLRFTTSWRHFSTGFREERDTFGPIQVPSDKLWGAQTQRSLQNFEIGGDRERMPEPIIRSFGILKKCAAKVNMEYGLDPSIGKAIMEAAQEVAEGKLNDHFPLVVWQTGSGTQSNMNANEVIANRAAEILGHKRGDKFVHPNDHVNRSQSSNDTFPTVMHIAAATEINSRLIPKLKQLHTSLQSKTNEFSDIVKIGRTHTQDATPLTLGQEFSGYTTQVKYGIERVLCTLPRMYQLAQGGTAVGTGLNTKKGFDVKIAAAVADETRLPFVTAENKFEALAAHDAFVEASGALNTIATSLMKIANDIRFLGSGPRCGLGELILPENEPGSSIMPGKVNPTQCEAMTMVCAQAIGNHVALTVGGSNGHFELNVFXPMMPALFYIHKASADASASFEKNCVRGIQANRDRISKLLHESLMLVTSLNPKIGYDNAAAVAKTAHKEGSTLKEAALKLGVLTSEEFDQLVVPEKMIGPSD

SEQ ID NO: 3310 - protein, 53 aa, Prunus persica
GKNTFGPILVPSDKLWGAQTQRSLQNFDIGGERERMPEPIVRAFGVLKNVLPR

SEQ ID NO: 3311 - protein, 467 aa, Manihot esculenta
IMVSMAFREEKDTFGPIQVPADKLWGAQTQRSLQNFEIGGEREQMPEPIVRAFGILKKCAAKVNMEYGLDPSIGKAIMQAAQEVAEGKLNDHFPLVIWQTGSGTQSNMNANEVIANRAAEILGHKRGEKFVHPNDHVNKSQSSNDTFPTVMHIAAATEINSRLIPNLKNLHSTLHSKSIEFKDIVKIGRTHTQDATPLTLGQEFSGYALQVKYGLDRITCTLPRMYQLAQGGTAVGTGLNTKKGFDAKIAAAVAEETKLPFVTAENKFEALAAHDAFVESSGALNTIATSLMKIANDMRFLGSGPRCGLGELVLPENEPGSSIMPGKVNPTQCEALTMACAQVMGNHVAITVGGSNGHFELNVFKPMIASNLLHSTRLLGDASASFEKNCVKGIQANKERISKLLHESLMLVTALNPKIGYDNAAAVAKLAHKEGTTLKEAALKLGVLTSEEFDALVVPEKMIGPSD

SEQ ID NO: 3312 - protein, 491 aa, Medicago truncatula
MALYVLSRRLSTKSTSPTLFTFRYFSSTTTFREERDTFGPIQVPSDKLWGAQTQRSLQNFDIGGPRERMPEPIIRSFGILKKCAAKVNMEYGLDPTIGKAIMKAAQEVADGKHNDHFPLVVWQTGSGTQSNMNANEVIANRASEILGHKRGEKFVHPNDHVNMSQSSNDTFPTVMHIAAGTEINSRLIPSLKTLHATLDAKSIEFKDIVKIGRTHTQDATPLTLGQEFSGYTTQLKYSLDRVITILPRMYQLAQGGTAVGTGLNTKKGFDVKVSLAVATETNLPFVTAENKFEALAAHDSFVETSGALNTISASLMKIANDIRLLGSGPRCGLGELILPENEPGSSIMPGKVNPTQCEALTMVCAQVMGNHVAITVGGSNGHFELNVFKPVIASNLLQSVRLLGDSCASFEKNCVRGIQANRERISKLLHESLMLVTSLNPKIGYDKAAAVAKKAHKEGSTLKEAALKLGVLTSEEFDSLVVPEKMLGPSD

SEQ ID NO: 3313 - protein, 495 aa, Picea glauca
MAIISAYRRHLSISTASSLMHNISFTYSRSLSTAFREERDTFGPINVPADKLWGAQTQRSLQNFEIGGEREQMPEQIIQSFGVLKKCAAKVNMDYGLDPTIGKAIMQAAQEVAEGKLNSHFPLVIWQTGSGTQSNMNANEVIANRAAEILGRKRGEKCVHPNDHVNMSQSSNDTFPTVMHIAAAVEMNSKFIPSLRQLHSTLEAKSNEFKDIVKIGRTHTQDATPLTLGQEFSGYATQVKYGIERVTNTLPHIYQLAQGGTAVGTGLNTKKGFDIKIAAAVAEETQLPFLTAENKFEALAAHDAYVETSGAVNTVSVSLMKIANDIRFLGSGPRCGLGELLLPENEPGSSIMPGKVNPTQCEALTMVCAQVMGNHVAITVGGSNGHFELNVFKPLIASALLRSLTLLGDAAASFEKNCVRGIQANHRRIGQLVRESLMLVTALNPKIGYDKAAATAKKAHKEGSTLKEAALQLGVLTSEEFDELVVPEKMIGPSD

SEQ ID NO: 3314 - protein, 405 aa, Antirrhinum majus
  misc_feature (186)..(186): Xaa can be any naturally occurring amino acid
MPEPIVRAFGVLKKCAAKVNMEYGLDPSIGKAIMQAAQEVAEGKLNDHFPLVVWQTGSGTQSNMNANEVIANRAAEILGHKRGGKFVHPNDHVNRSQSSNDTFPTVMHIAAAMEINSGLIPKLKQLHYTLHSKTVEFNDIVKIGRTHTQDATPLTLGQEFSGYTTQVKYGIDRVSRTLPQIYQLAXGGTAVGTGLNTKKGFDVKIAAAVAEETKLPFVTAENKFEALAAHDAFVETSGALNTIAVSLMKIANDIRFLGSGPRCGLGELILPENEPGSSIMPGKVNPTQCEALTMVCAQVMGNHVAVSVGGSNGHFELNVFKPVIASNLLHSLRLLGDASASFEKNCVRGIQANRERISKLLHESLMLVTSLNPKIGYDNAAAVAKTAHKEGSTLKEAALKLGVLS

SEQ ID NO: 3315 - protein, 488 aa, Artemisia annua
MAMVGVYRRGSGVSLRFTMRYCSTTGGFREERDTFGPIQVPNDKLWGAQTQRSLQNFEIGGDRERMPEPIIRSFGILKKCAAKVNIEYGLDPSIGKAIMEAAQEVADGKLNDHFPLVIWQTGSGTQSNMNANEVIANRAAEILGHKRGGKLVHPNDHVNRSQSSNDTFPTVMHIAAATEINSRLIPKLKQLHTTLQAKTSEFSDIVKIGRTHTQDATPLTLGQEFSGYTTQVKYGIDRVLCTLPRMYQLAQGGTAVGTGLNTKKGFDAKIAAAVADETRLPFVTAENKFEALAAHDAFVETSGALNTIAVSLMKIANDIRFLGSGPRCGFGELILPENEPGSSIMPGKVNPTQCEALTMVCAQTIGNHVGLTVGGSNGHFELNVFKPMIASSLLHSIRLIADASASFEKNCVRGIQANRDRINKLLYESLMLVTSLNPKIGYDNAAAVAKTAHKQGCTLKEAALQLGVLTSEEFDQLVVPEKMIGPSD

SEQ ID NO: 3316 - protein, 472 aa, Brassica rapa
  misc_feature (177)..(177): Xaa can be any naturally occurring amino acid
  misc_feature (180)..(180): Xaa can be any naturally occurring amino acid
  misc_feature (185)..(185): Xaa can be any naturally occurring amino acid
  misc_feature (222)..(222): Xaa can be any naturally occurring amino acid
SGTALRRAMRSYSTFREERDTFGPIQVPSDKLWGAQTQRSLQNFEIGGERERMPEPIVRAFGVLKKCAAKVNMEYGLDPTIGKAIMQAAQEVAEGKLNDHFPLVVWQTGSGTQSNMNANEVIANRAAEILGGDKCVHPNDHVNRSQSSNDTFPTVMHIAAATEINSRLIPSLKTLHXTLXSKSFXFKDIVKIGRTHTQDATPLTLGQEFGGYATQVKYGLNXVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVIASALLHSVRLIADASASFEKNCVRGIEANRERISKLLHESLMLVTSLNPKIGYDNAAAVAKKAHKEGSTLKEAALKLGVLTSEEFDTLVVPEKMIGPSD

SEQ ID NO: 3317 - protein, 495 aa, Pinus taeda
MAFISAYRRHLSISTASSLMHGISFTYSRSLWTAFREERDTFGPINVPADKLWGAQTQRSLQNFEIGGEREQMPEQIIQSFGVLKKCAAKVNMEYGLDPTIGKAIMQAAQEVAEGKLNSHFPLVIWQTGSGTQSNMNANEVIANRAAEILGKKRGEKCVHPNDHVNMSQSSNDTFPTVMHIAAAVEMNSKFIPSLRQLLSTLEAKSNEFKDIVKIGRTHTQDATPLTLGQEFSGYATQVKYGIERVTNSLPRIYQLAQGGTAVGTGLNTKKGFDIKIAAAVAEETQLPFITAENKFEALAAHDAFVETSGAANTVSVSLMKIANDIRFLGSGPRCGLGELLLPENEPGSSIMPGKVNPTQCEALTMVCAQVMGNHVAITVGGSNGHFELNVFKPLIASALLRSLTLLGDAAASFEKNCVRGIQANHRRIGQLVRESLMLVTALNPKIGYDKAAATAKKAHKEGSTLKEAALQLGVLTSEEFDELVVPEKMIGPSD

SEQ ID NO: 3318 - protein, 499 aa, Arabidopsis thaliana
MAALTMQFEGEKKNVSEVADVTLKQEDEQQERRSYSTPFREERDTFGPIQVPSDKLWGAQTQRSLQNFEIGGDRERMPEPIVRAFGVLKKCAAKVNMEYGLDPMIGEAIMEAAQEVAEGKLNDHFPLVVWQTGSGTQSNMNANEVIANRAAEILGHKRGEKIVHPNDHVNRSQSSNDTFPTVMHIAAATEITSRLIPSLKNLHSSLESKSFEFKDIVKIGRTHTQDATPLTLGQEFGGYATQVEYGLNRVACTLPRIYQLAQGGTAVGTGLNTKKGFDVKIAAAVAEETNLPFVTAENKFEALAAHDACVETSGSLNTIATSLMKIANDIRFLGSGPRCGLGELSLPENEPGSSIMPGKVNPTQCEALTMVCAQVMGNHVAVTIGGSNGHFELNVFKPVIASALLHSIRLIADASASFEKNCVRGIEANRERISKLLHESLMLVTSLNPKIGYDNAAAVAKRAHKEGCTLKHAAMKLGVLTSEEFDTLVVPEKMIGPSD

SEQ ID NO: 3319 - protein, 495 aa, Pseudotsuga menziesii
MAIISAYRRHLSISTASSLMHRISFTYSRSLWTAFREERDTFGPINVPADKLWGAQTQRSLQNFEIGGEREQMPEQIIQSFGVLKKCAAKVNMDYGLDPTIGKAIMQAAQEVAEGKLNSHFPLVIWQTGSGTQSNMNANEVIANRAAEILGRKRGEKCVHPNDHVNMSQSSNDTFPTVMHIAAAVEMNSKFIPSLRQLHSALEAKSNEFKDIVKIGRTHTQDATPLTLGQEFSGYATQVKYGIERVTNTLPHIYQLAQGGTAVGTGLNTKRGFDIKIAAAVAEETQLPFLTAENKFEALAAHDAFVETSGAVNTVSVSLMKIANDIRFLGSGPRCGLGELLLPENEPGSSIMPGKVNPTQCEALTMVCAQVMGNHVAITIGGSNGHFELNVFKPLIASALLRSLTLLGDAAASFEKNCVRGIQANHRRIGQLVQESLMLVTALNPKIGYDKAAATAKKAHKEGTTLKEAALQLGVLTSEEFDELVVPGKMIGPSD

SEQ ID NO: 3320 - protein, 469 aa, Ricinus communis
MAMGTIARRISRESTTTRAVGSLRYASWRLYSTAFREERDTFGPIQVPNDKLWGAQTQRSLQNFEIGGERERMPEPIIRAFGILKKCAAKVNMEYGLDPSIGKAIMQAAQEVAEGKLNDHFPLVVWQTGSGTQSNMNANEVIANRAAEILGHKRGEKYVHPNDHVNRSQSSNDTFPTVMHIAAATEINKRLIPNLRNLQTTLHAKSVEFKDIVKIGRTHTQDATPLTLGQEFSGYTTQVKYGIDRIMVTLPRMYQLAQGGTAVGTGLNTKKGFDVKIAAAVAEETNLPFVTAENKFEALAAHDAFVESSGALNTIATSLMKIANDVRLLGSGPRCGLGELILPENEPGSSIMPGKVNPTQCEALTMVCAQVMGNHVAVTVGGSNGHFELNVFKPMIASNLLHSVRLLGDASASFEKNCVRGIQANRERISKLLHESLMLVTSLNPKIGYDNAAAVAKLAHKEGSTLKVI

SEQ ID NO: 3321 - protein, 499 aa, Arabidopsis lyrata
MAALIMQFEGEKKNLSEVADVTLKQDQDEQQRRSYSTSFREERDTFGPIQVPSDKLWGAQTQRSLQNFKIGGDRERMPEPIVRAFGVLKKCAAKVNMEYGLDPMIGEAIMEAAQEVAEGKLNDHFPLVVWQTGSGTQSNMNANEVIANRAAEILGHKRGEKIVHPNDHVNRSQSSNDTFPTVMHIAVATEITSRLIPSLKNLHSSLESKSFEFKDIVKIGRTHTQDATPLTLGQEFGGYATQVKYGLSRVACTLPRIYQLAQGGTAVGTGLNTKKGFDVKIAAAVAEETNLPFVTAENKFEALAAHDACVETSGSLNTIATSLMKIANDIRFLGSGPRCGLGELSLPENEPGSSIMPGKVNPTQCEALTMVCAQAMGNHVAVTIGGSNGHFELNVFKPVIASALLHSIRLIADASASFDKNCVRGSEANRERISKLLHESLMLVTSLNPKIGYDNAAAVAKKAHKEGCTLKHAAMKLGVLTSEEFDTLVVPEKMIGPSD

SEQ ID NO: 3322 - protein, 472 aa, Brassica napus
MAIYVASRRLSARTTAAALRYATALRSYSTSFREERDTFGPIQVPSDKLWGAQTQRSLQNFEIGGERERMPEPIVRAFGVLKKCAAKVNMEYGLDPTIGKAIMEAAQEVAEGKLNDHFPLVVWQTGSGTQSNMNANEVIANRAAEILGRKRGEKCVHPNDHVNRSQSSNDTFPTVMHIAAATEINSRLIPSLKTLHTTLDSKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVIASALLHSVRLIADASASFEKNCVRGIEANRERISKLLHESLMLVTSLNPKIGYDNAAAVAKKAHKEGSTLKEAALKLGV

SEQ ID NO: 3323 - protein, 466 aa, Cucumis sativus
MAAVYVLSRRSSASHLFGMARYATTSLRSYSTSFREERDTFGPINVPSDRLWGAQTQRSLQNFEIGGDRERMPEPIIRAFGVLKKCAAKVNMDYGLDPTIGKAIMQAAQEVAEGKLNDHFPLVVWQTGSGTQSNMNANEVIANRASEILGHKRGDKFVHPNDHVNRSQSSNDTFPTVMHIAAATEINSKFIPKLKTLHSSLYSKSIEFKDIVKIGRTHTQDATPLTLGQEFSGYTTQVKYGIDRVLCTLPRMYQLAQGGTAVGTGLNTKKGFDVKIAAAVAEETNLPFVTAENKFEALAAHDAFVETSGSLNTVAASLMKIANDIRLLGSGPRCGLGELILPENEPGSSIMPGKVNPTQCEALTMVCAQVMGNHVAITVGGSNGHFELNVYKPMIANALLHSLRLLGDASASFEKNCVRGIQANRERISKLLHESLMLVTALNPKIGYDNAAAVAKKAHKEGSTLK

SEQ ID NO: 3324 - protein, 446 aa, Saccharum officinarum
MATSPAASSSSAPTASAAAAATMAAEATDGPVLSVVSKRLRALRKKYNRITQMEESLAAGKTLNREQEEVLRSKPVVAALIDELERLRPPLASAIAEEFSSRPAPAPAPGAASSSDSDSSVQDLLALIYFGSLFDVKQQSDFVSLVYASELERSNCLTYDYVGDDPEDSLAETDLNAVSALASLAASRPPAAAGVSHRDALQACAHHARLWLRRADEPIHPDSTITYAGVRAKLDRIMASGYYTAQLEMRPPLDLAAAVASFGAGGVQVQESMVVSPQAPEAVEENLAVEGHKDEKEDSQATEIYSDHQAPPVVDAEHVEDEGLVNPTDEVPSAEAEQETFDADVEDQEQKDQQFTQRRSYQNQRGGGGGRGGGRRGYPNGRGGRGGRGGGGGYYYESGYYQPRNYNNRGRGGRSGGGNSYYNNHGGGAHGGGHGHSWEVELGANA

SEQ ID NO: 3325 - protein, 452 aa, Zea mays
MATSPAASSSSAPTASAVAAATMAVEATDGPVLSVVSKRLRALRKKYNRITQMEESLAAGKTLNREQEEVLRSKPVVAALIDELERLRPPLASALAEELSSRPAPAPSAASSSDSDSSVQDLLALVYFGSLFDVKQQSDFVSLVYTRELERSSCLTYDYVGDDPEDSLAETDLNAVSALASLAALRPPAAAGVSHRDALQACAHHARLWLCRADEPIHPDSTITYAGVRAKLDRIMASGYFTAQLEMRTPLDLAAAVASFGAGGVQVQESMVVSPQAPEAVEESQAVEGHKNEKEDSQATEIYNDHPVVDSEHVEDEVLVHPTDEVPPAETEQEQETFDADVKDQEQKDQQFIQRRSYQNQRGGGRGGSRRGYPNGRGGRGGRGGGYQNGRGGYQNGRGGAGGYYYESGYYQPRNYNRGRGGRSGGGNSYYNSHGGGAQGHHPGSVELGANA

SEQ ID NO: 3326 - protein, 457 aa, Zea mays
MSTSPAASSSAPTAFAASAVTMAAEAADGPVLSVVSKRLRALRKKYNRITQMEESLAAGKSLNREQEEVLRSKPVVAALIDELERLRPPLASALAEELSSRSAPAPAATASSSDSDSSVQDLLALVYFGSLFDVKQQSDFVSLVYTRELERSSCLTYDYVGDDPEDSLVETDLNAVSALATLAASRPPAAAGVSHRDALQACAHHARLWLSRADEPIHPDSTITYAGVRAKLDRIMASGYYTAQLEMRTPMDLAAAVANFGAGGVQVQESMVVSPQALEAVEESQDVEEHKDEKEDSEATEIYSEHQAPVVDAEHVDDEGLVNPADEVPSAEAEQETLDDYVDDQEQKDQQFTQRRSYQNQRSGGGRGGGRRGYPNGRGVRGYQNGRGGGYQNGRGGGGYQNGRGGGGGYYESGYYQPRNYNNRGRGGRNSYYNNHGGGAQAGGHGHPGRVELGANA

SEQ ID NO: 3327 - protein, 460 aa, Setaria italica
MAASSSSAPTAAAAAAAAEATDGPVLSVVSKRLRALRKKYNRITQMEESLAAGKKLNPEQEEVLRSKTVVVAQIEELERLRAPLASALAEELSSRPAPAPAPAPAAAAAASSSDSDSSVLDFLPLVYFGSLFDVKQQGDFVATMVARTHERNCCITYDYVTDDAADLLAETDLDAVSALASLAASRPASAAGVSHRDALQACAHHARLWLRRADEPIHPDSTVTYAGVREKLEKIMSLDYYTAQPDIRAAEAVAAAVGNYGAGGVQAQESMVVSPQASEEAEESLAVEGHKGEKEEPQATEIYIDHQAPAVDAQHVDDDALVNPTDEAPSAEAEQERFDADVEDQEQKDQQFIQRRSYQNQRGGGRGGRRGYPNGRGGRGGRGGGYQNGRGGGGGYQNGRGGGGGGGGYYYEQGYYPPRNYSNNNRGRGGRSGGGNSYYNNHGGSGQGGGHGRVELGANA

SEQ ID NO: 3328 - protein, 611 aa, Zea mays
MAPVDPHSYTDGAHPVVSRAALAFYLDFAASTIHASAVLTLSAPHSGDLLLDTRALAVHSASTDADPPEPIPFSLAAAPDPVLGTALTLALPRDTASFRLTFSTSPAASALQWLAPPQTASAQPFVFSQCQSIHARSVFPCHDTPAARITFSLLLNVPEQLSAVAAARHVARRDPLPSDHRGACDDGLWCAPGRIVEEFQMDQSVPPYLFAFAAGSIGFRDLGPRTRVYAEGGDTVLDEAAREFAGVEEMVKVGEGLFGPYEWERFDLLVLPPSFPYGGMENPRMVFLTPTVIKGDAAGAQVVAHELAHSWTGNLITNKTNEDFWLNEGFTTYAERRIVEVVQGEERAALNMGIGWRGLNRMMERFKDNMEFTKLKPKMAGIDPDDVYSEVPYEKGFQFLWRIEREIGRPAFDEFLKKYIATFKFQSIDTETFLEFLKTNVPGIENKIDLHLWVEGTGIPPDAMEPDSATYKKICSLAAEFKSGKLPSEDEVAKWSGQEWELYLENLPADVEASQVTALDERYKLSESRDYEVKVAFLQLAIPTGCKCYFNEVEKCLKQVGRMKYLRPLYSSLAKCSSEEKMLAQRIFSEAQEFYHPIARSVAEAILSKHS

SEQ ID NO: 3329 - protein, 611 aa, Oryza sativa
MPPVDPHSYTDGDHPVTAKAALAFYLDFAASTIHASALLTLSAPHSGDLLLDTRALAVHSASTASGPPSPIPFSLADAADPVLGSALTLTLPPDTTSFLLTFSTSPSASALQWLSPPQTASSLPFVFSQCQSIHARSVFPCHDTPAARITFDLLLNVPTQLSAVAAARHVSRRDPLPSDHRGACDDALWCAPGRIVEEFQMEQSVPPYLFAFAAGGIGFRDLGPRTRVYAEGGDKVLDEAAREFAGVEEMVKVGESLFGPYEWERFDLLVLPPSFPYGGMENPRMVFLTPTVIKGDAAGAQVVAHELAHSWTGNLITNKTNEDFWLNEGFTTYAERRIVEVVQGEERAALNMGIGWRGLNRMMERFKDNMEYTKLKPKMAGIDPDDVYSEVPYEKGFQFLWRIERQIGRPAFDEFLKNYISTFKFKSIDTETFLEFLKTNVPGIENQIDLQLWIEGTGIPPDAMEPESAIYKKICSLAAEFKSGKLPSEDEVADWSGQEWELYLENLPTDVEASQVTALDERYKLSESCDYEVKVAFLQLAIPTGCRCYFNEVEKCLKQVGRMKYLRPLYSSLARCSGEEKMLAHRIFSEAHEFYHPIARSVAESILSKHG

SEQ ID NO: 3330 - protein, 611 aa, Brachypodium distachyon
MAPVDPHSYTDGAHPVTSHLALAFYLDFSASAIHASALVTLSAPHSGDILLDTRALAVHSATTTTDAPSPIPFSLAADADPVLGTALTLTLPPNTSSFLLTFSTSPAASALQWLSPPQTASALPFVFSQCQSIHARSVFPCHDTPAARITYSLLLNVPAQLSAVAAARHVSRRDPASADHRGACDDALWCAPDRVVEEFEMAQCVPPYLFAFAAGGIRCRDLGPRTRVYAEGGDTLLDEAAREFAGVEDMVKVGEALFGPYEWERFDLLVLPPSFPYGGMENPRMVFLTPTVIKGDSAGAQVVAHELAHSWTGNLITNKTNEDFWLNEGFTTYAERRIVEVVQGEERAALNMGIGWRGLNRMMERFKDNMEFTKLKPKMAGIDPDDVYSEVPYEKGFQFLWRIERQIGRPAFDEFLKKYIATFKFQSIDTETFLEFLKANVPGIENQIDLQLWIEGTGIPPDAMEPDSATYKKICALAAEFKSGKFPSEEEVADWSGQEWELYLENLPTDVEASQVTALDERYRLSESRDYEVKVAFLQLAIPTGCRCYFNEVEKCLKQVGRMKYLRPLYSSLARCSGEEKILAQRIFSEAHDFYHPIARSVAESILLKHG

SEQ ID NO: 3331 - protein, 512 aa, Pennisetum glaucum
RSSSTSPDASALQWLGPPQTASGQPFVFSQCQSIHARSIFPSHDTPAARITFSLLLNVPSQLSAVAAARHVGRRDPLPSDHRGACDDELWCASGRIVEEFQMEQSVPPYLFAFAAGGIGFRDLGPRTRVYAEGGDKVLDEAAREFAGVEEMVKVGESLFGPYEWERFDLLVLPPSFPYGGMENPRMVFLTPTVIKGDAAGAQVVAHELAHSWTGNLITNKTNEDFWLNEGFTTYAERRIVEVVQGEERAALNMGIGWRGLNRMMERFKDNMEFTKLKPKMAGIDPDDVYSEVPYEKGFQFLWRIERQIGRPAFDEFLKKYIATFKFKSIDSETFLEFLKTNIPGIENQIDLQLWVEGTGIPPDAMEPDSATYKKICDLAAEFKSGKLPSEDEVADWSGQEWELYLENLPTDVEASQVTALDERYKLSESRDYEVKVAFLQLAIPTGCKCYFNEVEKCLKQVGRMKYLRPLYSSLAKCSGEEKMLAQRIFSEAQEFYHPIARSVAESILSKHS

SEQ ID NO: 3332 - protein, 202 aa, Zea mays
MASEHAQLSAKAAAGSRFAVTYGLLRQYMKEQGGSGATRSLAPAVGVGLMPEADAAAAAEATEERTTVLELFPQQAGTLKDEQQRKRKERADGRAPLTIFYGGKMVVFDDFPAEKAEELMQLAGSGNAAQDALGQPSLTDMPLARKVSLKRFLEKRKNRLTAADPYPAAAATAAASESSTKPPAVKDEGAPWVGVNSALSLS

SEQ ID NO: 3333 - protein, 205 aa, Panicum virgatum
MAAAEQQQQPGSKAAGGSRFAVTCGLLRQYMKEQGGNGALRLAPAVAMGLAPVADAAAAAAEEGTEERKAVLELFPQQAGTLKDEQQRKRKEPAADERAPLTIFYGGKMVVFDDFPAEKAEELMHLAGSGNAAAPAGQNALGQPSLTDMPIARKASLKRFLEKRKDRLTAGDPYPAAASESIKPAAKDEAGAPWLSSVNSALSLS

SEQ ID NO: 3334 - protein, 199 aa, Setaria italica
MAAEHQQQPVVVAGGSRFAVTCGLLRQYMKEQGGNGARRLAPAVAMGLVPGADAAAAVAEEPEERKPVLELFPQQAGTLKDEQQRKMKEPAERAPLTIFYGGKMVVFDDFPAEKAEELMHLAGSGNAAAAGQNALGQPSLTDMPIARKASLKRFLEKRKNRLTAGDPYPVAATESMSSKAAVKEEGAPWLGVNSALSLS

SEQ ID NO: 3335 - protein, 195 aa, Panicum virgatum
MAAAEQQQPGTKAGGGSRFAVTCGLLRQYMKEQGGNGALRLAPAVAMGLVPGADAAEEGTEERKAVLELFPQQAGTLKDERQRKRKEPADERAPLTIFYGGKMVVFDDFPAEKAEELMQLAGSGNAAAAALAQPSLTDMPIARKASLKRFLEKRKNRLTAGDPYPAAASESIKPALKDEAGAPWLSSVNSALSLS

SEQ ID NO: 3336 - protein, 514 aa, Oryza sativa
MGSLDTNPTAFSAFPAGEGETFQPLNADDVRSYLHKAVDFISDYYKSVESMPVLPNVKPGYLQDELRASPPTYSAPFDVTMKELRSSVVPGMTHWASPNFFAFFPSTNSAAAIAGDLIASAMNTVGFTWQASPAATEMEVLALDWLAQMLNLPTSFMNRTGEGRGTGGGVILGTTSEAMLVTLVAARDAALRRSGSDGVAGLHRLAVYAADQTHSTFFKACRLAGFDPANIRSIPTGAETDYGLDPARLLEAMQADADAGLVPTYVCATVGTTSSNAVDPVGAVADVAARFAAWVHVDAAYAGSACICPEFRHHLDGVERVDSISMSPHKWLMTCLDCTCLYVRDTHRLTGSLETNPEYLKNHASDSGEVTDLKDMQVGVGRRFRGLKLWMVMRTYGVAKLQEHIRSDVAMAKVFEDLVRGDDRFEVVVPRNFALVCFRIRAGAGAAAATEEDADEANRELMERLNKTGKAYVAHTVVGGRFVLRFAVGSSLQEEHHVRSAWELIKKTTTEMMN

SEQ ID NO: 3337 - protein, 516 aa, Pennisetum glaucum
MGSLDSNPATFDAFAAEADGFQPLNAEDVRSYLHKSVDFIYDYYKSVESMPVLPGVEPGYLSRLLQSAPPSAAAPFDIAMKEVREAVVPGMTHWASPNFFAFFPATNSAAAIAGELIASAMNTVGFTWQANPAATEMEVLALDWLAQLLHLPESFLMNRNGGGRGTGGGVILGTTSEAMLVTLVAARDAALRRMGSNGVAGITRLVVYAADQTHSTFFKACRLAGFDPANIRSIPTGADTDYGLDPAKLLEVMQADVDAGLVPTYICATVGTTSSNAVDPVGAVADVAAQFKAWVHVDSAYAGSACICPEFRHHLDGVERVDSISMSPHKWLMTCLDCTCLWVRDAHRLTDSLETNPEYLKNDASDSGTVTDLKDMQVGVGRRFRGLKLWMVMRTYGANKLQEHIRSDVAMAKTFEEWVRADDRFEVVVPRNFALVCFRVKPHAGMTEEATEAANRELMERLNRTGKAYLAHTVIGGKFVLRFAVGSSLQEERHVRSAWELITKKTTEIMSGEMSV

SEQ ID NO: 3338 - protein, 516 aa, Zea mays
MGSLDTTPTAAFADVAGGGFEPLNADDVRSYLHKSVDFIYDYYKSVESLPVLPGVEPGYLRRLLQSVPPTSSAPFDIALKEVRDAVVPGMTHWASPNFFAFFPSTNSAAAIAGELIASAMNTVGFTWQASPASTEMEVLALDWLAQLLRLPPTFMNRTAAAGRGTGGGGVILGTTSEAMLVTLVSARDAALRRAGSVGVAGITRLAVYAADQTHSTFFKACRLAGFDPANIRSIPTGPETDYALDPARLLEVMQADVDAGLVPTYVCATVGTTSSNAVDPVGAIADVAAVFNAWVHIDAAYAGSACICPEFRHHLDGVERVDSISMSPHKWLMTCLDCTCLWVRDTHRLTDSLETNPEYLKNDASESGTVTDLKDMQVGVGRRFRGLKLWMVMRTYGSAKLQEHIRSDVAMAKMFEDAVRADHRFEVVVPRNFALVCFRIRPQGTDLTEEDADVVNRELMERLNRTGKAYLAHTAIGGKFVLRFAVGSSLQEERHVRSAWELIKKTTTEIFEEETM

SEQ ID NO: 3339 - protein, 530 aa, Pennisetum glaucum
MGSLDSNPVTFDAFAAEGADGGFQPLDADDVRSYLHKSVDFIYDYYKSVESLPVLPGVEPGYLRRLLQSAPPSAAAPFDIAMQEVREAVVPGMTHWASPNFFAFFPATNSAAAIAGELIASAMNTVGFTWQANPAATEMEVLALDWLAQLLRLPSSFLMHHRGADDGEERRGTGGGVILGTTSEAMLVTLVAARDAALRRMGSSGVAGITRLVVYAADQTHSTFFKACRLTGFDPANIRSIPTAADTDYGLDPEKLLEAMRADADAGLVPTYVCATVGTTSTNAVDPVGAVADVAALFNAWVHVDAAYAGSACICPEFRHHLDGVERVDSISMSPHKWLMTCLDCTCLWVRDANRLTDSLETNPEYLKNGASDSGTVTDLKDMQVGVGRRFRGLKLWMVMRTYGAARLQEHIRSDVAMAKTFEEWVRADDRFEVVVPRNFALVCFRMKPTTAEEEEEAAAEAANRELMERLNRTGKAYLAHTVVGGRFVLRFAVGSSMQEERHVRSAWELIRKTAAEIVEEEGEKKRARG

SEQ ID NO: 3340 - protein, 521 aa, Sorghum bicolor
MGSLDTTPTATATFADINGSGGFQPLNADDVRSYLHKSVDFIYDYYKSVESLPVLPGVEPGYLRRLLQSVPPTSSAPFDIALKEVRDAVVPGMTHWASPNFFAFFPATNSAAAIAGELVASAMNTVGFTWQANPAATEMEVLALDWLAQLLRLPSTFMNRTAAAGRGSGGGVILGTTSEAMLVTLVAARDAALRRSGSVGVAGITSLAVYAADQTHSTFFKACRLAGFDPANIRSIATGPETDYALDPAKLLEIMLADVDAGLVPTYICATVGTTSSNAVDPVGAIADVAAMFDAWVHIDAAYAGSACICPEFRHHLAGVERVDSISMSPHKWLMTCLDCTCLWVRDAHRLTDSLETNPEYLKNDASESGNVTDLKDMQVGVGRRFRGLKLWMVMRTYGAAKLQEHIRSDVAMAKMFEEAVRADDRFEVVVPRNFALVCFRIRPEGAMTEEDAEEVNRELMERLNRTGKAYLAHTVVGGKFVLRFAVGSSLQEERHVRSAWELIKKTTTEIMEEARDVVEN

SEQ ID NO: 3341 - protein, 516 aa, Brachypodium distachyon
MGSLDSTPATAFAAIVDDKAEPFQPLNTDDVRAYLHKAVDFITDYYTNVESFPVLPNVKPGYLQDMLTSSPPSHSAPFDVAMKELRTSVVPGMTHWQSPNFFAFFPSTNSAAAIAGELIASAMNTVGFTWQAAPAATEMEVLALDWLAQLLRLPTTFMNRTSSGRGTGGGVILGTTSEAMLVTLVAARDAALKRIGSNGVAGITRLAVYAADQTHSTFFKACRLAGFDPANIRSIPTGAETDYGLDPAKLLEVMQADVDAGLVPTYVCATVGTTSSNAVDPVGAVADVAAMFNAWVHVDAAYAGSACICPEFRHHIDGVERVDSISMSPHKWLMTCLDCTCLYVRDVHRLSDSLETNPEYLKNDVTDSGEVTDLKDMQVGVGRRFRGLKLWMVMRTYGTAKLQEHIRSDVAMAKMFEDFVCADDRFEVVVPRNFALVCFRIKANGAMTEEYADELTRELMERLNKTGKAYLAHTVVGGRFVLRFAVGSSLQEERHVRSAWELIKKTTTEIIEEAEH

SEQ ID NO: 3342 - protein, 519 aa, Sorghum bicolor
MGSLDTNPTAFSAFGDDVSSGFQPLNPDDVRSYLHKAVDFISDYYKSVESLPVLPDVKPGYLRDQLRSAPPTSSAPFDVTMKELTASVVPGMTHWASPNFFAFFPATNSAAAIAGDLIASAMNTVGFTWQAAPAATEMEVLALDWLAQLLRLPSSFMNRTGAAGRGTGGGVILGTTSEAMLVTLVAARDAALRRSGSHGVSGLPRLAVYAADQTHSTFFKACRLAGFDPANIRSIPTGPETDYALDPARLLEVMRADVEAGLVPTYVCATVGTTSSNAVDSVGAIADVAAVFKAWVHIDAAYAGSACICPEFRHHLDGVERVDSISMSPHKWLLTCLDCTCLWVRDTHRLTDSLETNPEYLKNDASESGNVTDLKDMQVGVGRRFRGLKLWMVMRTYGAAKLQEHIRSDVAMAKMFEDAVRGDDRFEVVVPRNFALVCFRIKPHGGGMTEEDADEANHELMERLNRTGKAYLAHTVVGDRFVLRFAVGSSLQEERHVRSAWELINKTTSEIMQEHIAVE

SEQ ID NO: 3343 - protein, 515 aa, Zea mays
MGSLDTNPNAFSAFGVDATTGFQPLHPDDVRAYLHKAVDFISDYYKSVESLPVLPDVKPGYLRQQLRSAPPTSSAPFDVTMKELTDSVVPGMTHWASPNFFAFFPSTNSAAAIAGDLIASAMNTVGFTWQAAPAATEMEVLALDWLAQLLRLPPSFMNRTGAAGRGTGGGVILGTTSEAMLVTLVAARDAALRRTGSQGVSGLPRLAVYAADQTHSTFFKACRLAGFDPANIRSIPTGPETDYALDPARLFEVMQADVDAGLVPTYVCATVGTTSSNAVDPVGAIADVAAVFNAWVHIDAAYAGSACICPEFRHHLDGVERVDSISMSPHKWLLTCLDCTCLWVRDTHRLTDSLETNPEYLKNDASDSGNVTDLKDMQVGVGRRFRGLKLWMVMRTYGAAKLQEHIRSDVAMAKMFEDAVRSDNRFEVVVPRNFALVCFRIKPHGGGIMTEEDADEANRELMERLNRTGKAYLAHTVVGDRFVLRFAVGSSLQEERHVRSAWELINKTTTEIMQK

SEQ ID NO: 3344 - protein, 512 aa, Zea mays
MGSLDTNPAAMSALGDNACSGFQPLNPDDVRSYLHKAVDFISDYYKSVESLPVLPDVKPGYLRNELQSAPPTSSAPFDVTMKELTASVVPGMTHWASPNFFAFFPSTNSAATIAGDLIASAMNTVGFTWQAAPAATEMEVLALDWLAQLLRLPPSFMNRTGGAARGSGGGVILATTSEAMLVTLVAARDAALRRSGSHGVSQLPRLAVYAADQTHSTFFKACRLAGFDPANIRCIPTGPETDYGLDPARLLEVMQADVDAGLVPTYVCATVGTTSSNAVDPVRAIADAAAVFNAWVHIDAAYAGSACICPEFRHHLDGVERVDSISMSPHKWLMTCLDCTCLWVRDTHRLTGSLETNPEYLKNDASESGNVTDLKDMQVGVGRRFRGLKLWMVMRTYGASKLQEHIRSDVAMAKMFEDAVRADDRFEVVVPRNFALVCFRIKPRGGMTEEDADEVNRELMERLNRTGKAYLAHTVVGGRFVLRFAVGSSLQEERHVRSAWELINKTTNEIML

SEQ ID NO: 3345 - protein, 520 aa, Zea mays
MGSLDTNPAAMSALGDNACSGFQPLNPDDVRSYLHKAVDFISDYYKSVESLPVLPDVKPGYLRNELQSAPPTSSAPFDVTMKELTASVVPGMTHWASPNFFAFFPSTNSAATIAGDLIASAMNTVGFTWQAAPAATEMEVLALDWLAQLLRLPPSFMNRTGGAARGSGGGVILATTSEAMLVTLVAARDAALRRSGSHGVSQLPRLAVYAADQTHSTFFKACRLAGFDPANIRCIPTGPETDYGLDPARLLEVMQADVDAGLVPTYVCATVGTTSSNAVDPVRAIADAAAVFNAWVHIDAAYAGSACICPEFRHHLDGVERVDSISMSPHKWLMTCLDCTCLWVRDTHRLTGSLETNPEYLKNDASESGNVTDLKDMQVGVGRRFRGLKLWMVMRTYGASKLQEHIRSDVAMAKMFEDAVRADDRFEVVVPRNFALVCFRIKPRGGMTEEDADEVNRELMERLNRTGKAYLAHTVVGGRFVLRFAVGSSLQEERHVRSAWELINKTTNEIMLEPEQIVVE

SEQ ID NO: 3346 - protein, 510 aa, Brachypodium distachyon
MGSIDTNPTAFSAFPDDDKPFQPLNTDDVRAYLHKAVDFISDYYTNVESMPVLPNVKPGYLQDQLSASPPTYSAPFDVTMKEIRNSVVPGMTHWASPNFFAFFPSTNSAAAIAGDLIASAMNTVGFTWQAAPAATEMEVLALDWLAQLLRLPTTFMNRTSSGRGTGGGVILGTTSEAMLVTLVAARDAALRRSGSIGVSGLPKLAVYAADQTHSTFFKACRLAGFDPANIRSIRTGPETDYGLDPVRLLEVMQADVDAGLVPTYVCATVGTTSSNAVDPVGAVADVAAMFNAWVHVDAAYAGSACICPEFRHHLDGVERVDSISMSPHKWLMTCLDCTCLYVRDAHRLSDALETNPEYLKNDVTDSGEVTDLKDMQVGVGRRFRGLKLWMVMRTYGTAKLQEHIRSDVAMAKMFEDLVRDDDRFEIVVPRNFALVCFRIKTNGSMTEEEADEANRVLMENLNKTGKAYLAHTVVGDRFVLRFAVGSSLQEERHVRSAWELIKKTTSEMMD

SEQ ID NO: 3347 - protein, 510 aa, Brachypodium distachyon
MGSIDTNPTAFSAFPDDDKSFQPLNTDDVRAYLHKAVDFISDYYTNVESMPVLPNVKPGYLQDQLSASPPTYSAPFDVTMKEIRNSVVPGMTHWASPNFFAFFPSTNSAAAIAGDLIASAMNTVGFTWQAAPAATEMEVLALDWLAQLLRLPTTFMNRTSSGRGTGGGVILGTTSEAMLVTLVAARDAALRRSGSVGVSGLPKLAVYAADQTHSTFFKACRLAGFDPANIRSIPTGPETDYGLDPVRLLEIMQADVDAGLVPTYVCATVGTTSSNAVDPVGAVADVAAMFNAWVHVDAAYAGSACICPEFRHHLDGVERVDSISMSPHKWLMTCLDCTCLYVRDAHRLSDALETNPEYLKNDVTDSGEVTDLKDMQVGVGRRFRGLKLWMVMRTYGTAKLQEHIRSDVAMAKMFEDLVRADDRFEIVVPRNFALVCFRIKASGVMTEDDADEANRVLMENLNKTGKAYLAHTVVGDRFVLRFAVGSSLQEERHVRSAWELIKKTTSEMMD

SEQ ID NO: 3348 - protein, 510 aa, Brachypodium distachyon
MGSIDTNPTAFSAFPDDDKSFQPLNTDDVRAYLHKAVDFISDYYTNVESMPVLPNVKPGYLQDQLSASPPTYSAPFDVTMKEIRNSVVPGMTHWQSPNFFAFFPSTNSAAAIAGDLIASAMNTVGFTWQAAPAATEMEVLALDWLAQLLRLPTTFMNRTSSGRGTGGGVILGTTSEAMLVTLVAARDAALRRSGSVGVSGLPKLAVYAADQTHSTFFKACRLAGFDPAHIRSIPTGPETDYGLDPVKLLEIMQADVDAGLVPTYVCATVGTTSSNAVDPVGAVADVAAMFNAWVHVDAAYAGSACICPEFRHHLDGVERVDSISMSPHKWLLTCLDCTCLYVRDAHRLSDALETNPEYLKNDVTDSGEVTDLKDMQVGVGRRFRGLKLWMVMRTYGTAKLQEHIRSDVAMAKMFEDLVGADDRFEIVVPRNFALVCFRIKASGAMTEEDADEVTRELMERLNKTGKAYLAHTVVGGRFVLRFAVGSSLQEERHVRGAWELIKKTTTEMMD

SEQ ID NO: 3349 - protein, 524 aa, Zea mays
MGSLSGTSSSLAAAFDADSERFQPLNADDVRSYLHKAVDFIYDYYKSVESVPVLPSVEPGYLARQLKSAPPNAAAPFDVAMHELREAVVPGTTHWASPNFFAFFPATNSAAAIAGELVASAMNTVGFTWQANPAAAELEALALDWLAQLLLLPDSFMNRPCSAVVAGRGAGTRGGGVILGTTSEAMLVTLVAARDAALRRSGSDGVAGITRLTVYAADQTHSTFFKACRLAGFDPANVRSIPTGADTDYALDPARLLEAMRRDAGAGLVPTYVCVTVGTTSSNAVDPVGAAADAAAEFGAWVHVDAAYAGSACICPEFRHHLDGVERVDSLSLSPHKWLLTCLDCTCLWVRDTRRLTDSLETRPEYLRNHATESGAVTDLKDMQVGVGRRFRGLKLWMVMRTYGAAKLRQHIRSDVAIAKVFEESVRADHRFEVVVPRNFALVCFRIRPSATASMTEEDAEVANRELMERLNKSGRAFLANTVIGGKFVLRFAVGSTLQEERHVRNAWDLIKMTTTEIINGEVD

SEQ ID NO: 3350 - protein, 511 aa, Hordeum vulgare
MGSLDANPMTTFSAFPDDKAAFEPLNPEDVRAYLHKAVDFISDYYTNVESMPVLPNVKPGYLQDELTASPPTHSAPFDVTMKELRTSVVPGMTHWASPNFFAFFPSTNSAAAIAGDLIASAMNTVGFTWQASPAATEMEVLALDWLAQLLRLPTTFMNRTSTGRGTGGGVILGTTSEAMLVTLVAARDAALRRSGSVGVSDIPRLAVYAADQTHSTFFKACRLAGFDPANIRSISTGPETNYGLDPTKLLEVMQADADAGLVPTYVCATVGTTSSNAVDPVGAVADVAAMFNAWVHVDAAYAGSACICPEFRHHLDGVERVDSISMSPHKWLLTCLDCTCLYVRDAHRLSDSLETNPEYLKNDVTDSGEVTDLKDMQVGVGRRFRGLKLWMVMRTYGTAKLQEHIRSDVAMAKMFEDSVRADNRFEVVVPRNFALVCFRIKARGDMTEEDADEVNRLLMENLNKTGKAYLAHTVVGDRFVLRFAVGSSLQEERHVRSAWDLIKKTTSSIMD

SEQ ID NO: 3351 - protein, 510 aa, Brachypodium distachyon
MGSIDTNPTAFSAFPDDDKSFQPLNPEDVRAYLHKAVDFVSDYYTNVESMPVLPNVKPGYLQDELSASPPTYSAPFDVTMKELRTSVVPGMTHWASPNFFAFFPSTNSAAAIAGDLIASAMNTVGFTWQAAPAATEMEVLALDWLAQLLHLPTTFMNRTSSGRGTGGGVILGTTSEAMLVTLVAARDAALRRSGSVGVSGLPKLAVYAADQTHSTFFKACRLAGFDPAHIRSIPTGPETNYGLDPAKLLEVMQADVAAGLVPTYVCATVGTTSSNAVDPVGAVADVAAMFNAWVHVDAAYAGSACICPEFRHHLDGVERVDSISMSPHKWLLTCLDCTCLYVRDAHRLSDSLETNPEYLKNDVTDSGEVTDLKDMQVGVGRRFRGLKLWMVMRTYGTAKLQEHIRSDVAMAKIFEDLVRADDRFEIVVPRNFALVCFRIKASGSMTEKDADEANRLLMESLNKTGKAYLAHTVIGERFVLRFAVGSSLQEERHVTSAWELIKKTTSEMLD

SEQ ID NO: 3352 - protein, 520 aa, Zea mays
MGSLSGTSSSLAAAFDADSERFQPLNADDVRSYLHKAVDFIYDYYKSVESVPVLPSVEPGYLARQLKSAPPNAAAPFDVAMHELREAVVPGTTHWASPNFFAFFPATNSAAAIAGELVASAMNTVGFTWQANPAAAELEALALDWLAQLLLLPDSFMNRPCSAVVAGRGAGTRGGGVILGTTSEAMLVTLVAARDAALRRSGSDGVAGITRLTVYAADQTHSTFFKACRLAGFDPANVRSIPTGADTDYALDPARLLEAMRRDAGAGLVPTYVCVTVGTTSSNAVDPVGAAADAAAEFGAWVHVDAAYAGSACICPEFRHHLDGVERVDSLSLSPHKWLLTCLDCTCLWVRDTRRLTDSLETRPEYLRNHATESGAVTDLKDMQVGVGRRFRGLKLWMVMRTYGAAKLRQHIRSDVAIAKVFEESVRADHRFEVVVPRNFALVCFRIRPSATASMTEEDAEVANRELMERLNKSGRAFLANTVIGGKFVLRFAVGSTLQEERHVRNAWDLIKMTTTEIIN

SEQ ID NO: 3353 - protein, 510 aa, Triticum aestivum
MGSLGTNPMSFSAIPDDKAAFEPLNPEDVRAYLHKAVDFISDYYTNIESMPVLPNVKPGYLQDELSASPPTYSAPFDVTMKELRTSVVPGMTHWASPNFFAFFPSTNSAAAIAGDLIASAMNTVGFTWQASPAATEMEVLALDWLAQLLRLPTTFMNRTSTGRGTGGGVILGTTSEAMLVTLVAARDAALRRSGSVGVSGIPRLAVYAADQTHSTFFKACRLAGFDPANIRSIPTGPETNYGLDPAKLLEVMQADADAGLVPTYVCATVGTTSSNVVDPVGDVADVAAMFSAWVHVDAAYAGSACICPEFRHHLDGVERVDSISMSPHKWLLTCLDCTCLYVRDAHRLSDSLETNPEYLKNDATESGEVTDLKDMQVGVGRRFRGLKLWMVMRTYGTAKLQEHIRSDVAMAKMFEDFVRADDRFEVVVPRNFALVCFRIKASGAMTEKDADETNRVLMENLNKTGKAYLAHTVVGDKFVLRFAVGSSLQEERHVRSAWDLIKKTTSSIMD

SEQ ID NO: 3354 - protein, 510 aa, Hordeum vulgare
MGSLGTNPTSFSAFPDDKAAFEPLNPEDVRAYLHKAVDFISDYYTNVESMPVLPNVKPGYLQDELTASPPTHSAPFDVTMKELRTSVVPGMTHWASPNFFAFFPSTNSAAAIAGDLIASAMNTVGFTWQASPAATEMEVLALDWLAQLLRLPTTFMNRTSTGRGTGGGVILGTTSEAMLVTLVAARDAALRRSGSVGVSDIPRLAVYAADQTHSTFFKACRLAGFDPANIRSISTGPETNYGLDPTKLLEVMQADADAGLVPTYVCATVGTTSSNAVDPVGAVADVAAMFNAWVHVDAAYAGSACICPEFRHHLDGVERVDSISMSPHKWLLTCLDCTCLYVRDAHRLSDSLETNPEYLKNDVTDSGEVTDLKDMQVGVGRRFRGLKLWMVMRTYGTAKLQEHIRSDVAMAKMFEDSVRADNRFEVVVPRNFALVCFRIKARGDMTEEDADEVNRLLMENLNKTGKAYLAHTVVGDRFVLRFAVGSSLQEERHVRSAWDLIKKTTSSIMD

SEQ ID NO: 3355 - protein, 515 aa, Brachypodium distachyon
MGSLDANSAALADDRAAPGSSFQPLNADDVRAYLHKAVDFISDYYANVESMAVLPNVKPGYLQEELKLSSPPNYSSPFEVTMKELRSAVVPGMTHWASPNFFAFFPSTNSAAAIAGDLIASAMNTVGFTWKAAPAATEMEVLALDWLAQLMRLPATFMTRSTGSEGARGTGGGVILGTTSEAMLVTLVAARDSALRRSGSNGVAGITRLTVYASDQTHSTFFKACRLAGFDPANIRSIPTGPEAHYSVSPEKLLEAMQADAEAGLVPTYVCATVGTTSSNAVDPVGAVADVAALFDAWVHVDAAYAGSACICPEFRHYLDGVERVDSISMSPHKWLLTCLDCTCLYVRDTQRLSDSLETNPEYLKNDVTDSGEVTDLKDMQVGVGRRFRGLKLWMVMRTYGTAKLQEHIRSDVAMAKMFEELVRADDRFEVVVPRNFALVCFRIKARGTMTEDDADEATRVLMENLNKTGKMYLAHTVVGGRFVLRFAVGSSLQEERHVRSSWELIKKTTSQLTD

SEQ ID NO: 3356 - protein, 516 aa, Solanum phureja
MGWLEKIFGGSTHRISGGQYHGGYEGGQYHGGYDGGQYHSGHEGGQNHGGYEDSTTWDGPTTSVDELSDFDKEEIDRAIALSLAEEDQKGKKVIESEPHLEEDEALAKALQESLNVESSPPPPPPPRYDYGSPFPPVSYSFPYGYRVCAGCNAEIGQGRYLSCMGAVWHPECFRCHGCNQPISDYEFSMSDNRPYHKSCYKEQHHPKCDVCKNFIPTNPAGLIEYRAHPFWLQKYCPSHETDGTPRCCSCERMEPVDARYLILEDGRKLCLECLDSSIMDTHECQPLYLEIQEFYEGLNMKVEQQIPLLLVERQALNEAMEGEKNGHHHMPETRGLCLSEEQTISSISRRPRIGGYRILDMFTEPHRLIRQCEVTAILILYGLPRLLTGSILAHEMMHAWLRLKGYPSLSPEVEEGICQVLAHMWLDSEIIAGSGSTSTSASTSASSSSSSSPSTSSKKGKRSDFEKKLGDFFKHQIESDTSAAYGDGFREGNKAVLKYGLKTTLDHIRLTGTYPC

SEQ ID NO: 3357 - protein, 571 aa, Populus trichocarpa
MSHWTLKGAYHESLDFVMSLCETSYGLVDSLAEINVHLAEARNSGGVCFPMGKGLYRVVHIPEDEAVLLNSREKAPYLICVEVLKSEMPSNSKDTSGAQNLSRGGIPLANGDAFLPKPPPWAYPLWTTQDMYRNSSDRMSQSTAEAIDQAMSHASETKMKFVNVNLSVEKKLPSQSTVIEAPKLNSGINFMHQNAAHCSDLEWVRVVLTADPGVRMEDVGDEGAPRRKEHRRVPSTIAIEEVKAAAAKGEAPPGLPLKGAGQVSSDAQPNVNGGNPKASDALSGELWEVKKERIRKASVYGKLPGWDLRSVIVKSGDDCRQEHLAVQLISHFYDIFQEAGVPLWLRPYEVICTSSYTALIETIPDTASIHSIKSRYPDITSLRDFFVAKYGENSPSFKLAQRNFVESMAGYSLVCYLLQVKDRHNGNLLMDEDGHIIHIDFGFMLSNSPGGVNFESAPFKLTRELLEVMDSDAEGIPSEFFDYFKVLCIQGFLTCRKHAERIILLVEMLQDSGFPCFKGGPRTIQNLRKRCHLSLTEEQCVSLVLSLISSSLDAWRTRQYDYYQRVLNGIL

SEQ ID NO: 3358 - protein, 1086 aa, Ricinus communis
MVRLLGLSRGESDELPREITSRSNLISESGESGWLIRFFDSSFFCEWIAVSYLYKHEHAGVRDYLCNRMYTLPLSGIESYLFQICYMLIHKPSPSLDKFVIDICSKSLLIALKVHWFLLAEIEDSDDNEGISRIQEKCQIAATLMGEWPPLVRPPNESSTPGSKNQVLNKILSSKQKLLSLTSSPPVNKSLSFSPSSGNNLQEDGNPLSPDENKIFKKFIPGPKVRDALLFRKSVEKDDDESEKNGFFKRLLRDSSKGDDEELTSSSDGFFKKFLRDSSIRGEDEELTSTSDGFFKRLLSSKGEDEELTSSSEGFFKRLFRDSKSDGDEKPVTKSMEDDDKDGFFRKFFKEKFEDKKDGNDRNEHEKRVNSEEKCSRSSEDDEKEGFFRKLFKEKFEDRKDGNDKIDEANINGEEEEYSDFSLFRRLFRVHPEDVKSTSVNESSNGGLFEGSPGTENFFRKLFRDRDRSVEDSELFGLKKNKEKRPGSPKQQNEKSSTKPPLPNNTASHFRKGAYHESLDFVMSLCETSYGLVDVFPVEDRKSALCESLADINLHIAEAQNSGGVCFPMGKGMYRVVHIPEDEAALLNSREKAPYLICVEVLKCDTPSNTKDASAVQKLSKGGIPLANGDAFLPKPPPWAYPLWTTQEVYRNSSDRMSRSTAQAIDQAMSHAMESKLKFVSVTLSLEKQVSRQSMNIRHGINRSGAHQRAVDGGDLEWVRVVLTADSGVRMEDIGDQGPPRRREHRRVPSTIAIEEVKAAAAKGEAPPGLPLKGAGQDSSDAQPRVNGGTSEASDALSGELWEIKKERIRKASVYGKLPGWDLRSVIVKSGDDCRQEHLAVQLISHFYDIFQEAGLPLWLRPYEVLVTSSYTALIETIPDTASLHSIKSRYPSITSLRDFFVAKYEENSPSFKLAQRNFVESMAGYSLVCYLLQVKDRHNGNLLMDEEGHIIHIDFGFMLSNSPGGVNFESAPFKLTRELLEVMDSDAEGIPSEFFDYFKVLCIQGFLTCRKHAERIILLVEMLQDSGFPCFKGGPRTIQNLRKRFHLNLTEEQCVSLVLSLISSSLDAWRTRQYDYYQRVLNGIL

SEQ ID NO: 3359 - protein, 1074 aa, Manihot esculenta
MVRLLGLSRGESDESPREITSRTSLLSESGESGWLIRFFDSAFFCEWIAVSYLYKHDHAGVRDYLCNRMYTLPLSGIESYLFQICYMVIHKPSPSLDKFVIDICSKSLLIALKVHWFLLAEIEDSDDNEGISRIQEKCQIAATLMGEWPPLVRPPSESSSVGGKNPVLNKILSSKQKFLSLTSSPPTNKSLSFSPSSGSSLVEDGNLLSPDQNSIFKKFIPGPKVRDALLFRKSVEKDEEESEKDGFFKRLLRDSRDDEEITSTSDGIFKRLLRDSKGEDEELTSSSEGFFKRLFRDSKSDDEDKSVSKSVEDDEKEGFFRKFFKEKFEDKKDEHEERVSSEEKCSKSAEDEEKEGFFRKLFKDKFEDKKDGNGKIDDRNAKDGNGKIDDRNANGEEEETSEFSLFRRLFRVHPEDAKNTALNENGNGGGLFESSPGTERFFRKLFRDRDRSVEESELFVSKKNKEKRPGSPKQQNDKSNTKPPLHNNTASHFRKGAYHESLDFVMSLCETSYGLVDVFPLEDRKSALRESLVEINLHLAEAQNSGGICFPMGKGMYRVVHIPEDEAILLNSREKAPYMICVEVLKCEMPSNNKGTFGGQKLSRGGIPLANGDAFLPKPPPWAYPLWTTQEVYRNSSDRMSRSTAQAIDQAMSHSLEARQKFANVSLSVVKQLPRHPINTNAQDIHHGINRSGLHQRATNDGEFEWVRVVLTADPGVRMDDIGDQEPPRRREHRRVPSTIAIEEVKAAAAKGEAPPGLPLKGAGQDSSDARLRVNGGTPKASDALSGELWEAKKERIRKASVYGKLPGWDLRSVIVKSGDDCRQEHLAVQLISHFYDIFQEAGLPLWLRPFEVLVTSSYTALIETIPDTASLHSIKSRYPNITSLRDFFVAKYEENSPSFKLAQRNFVESMAGYSLVCYLLQVKDRHNGNLLLDEDGHIIHIDFGFMLSNSPGGVNFESAPFKLTRELLEVMDSDAEGVPSEFFDYFKVLCIQGFLTCRKHAERIILLVEMLQDSGFPCFKGGPRTIQNLRKRFQLSLTEEQCVSLVLSLISSSLDAWRTRQYDYYQRVLNGIL

SEQ ID NO: 3360 - protein, 484 aa, Panicum virgatum
MQLSDAAAYARKKKVILKGDLPIGVDRNSVDTWVYPTLFRMNTATGAPPDYFDKNGQNWGFPTYNWEEMSKDNYGWWRARLTQMAKYFTAYRIDHILGFFRIWELPDHAATGLLGKFRPSIPLSQEEFLSEGLWDFNRMSRPYIRQEILEEKFGSFWTVIAANFLNEYQKQCYEFKEDCNTEKKIIAKIKTSPEKSLWLEKEDSIRRGLFDLLQNIVLIRDPEDSTKFYPRFNLEDTSSFRDLDEHSKNVLRRLYYDYYFARQENLWRQNALKTLPVLLNSSDMLACGEDLGLIPACVHPVMQELGLIGLRIQRMPSEPNTEFGIPSQYSYMTVCAPSCHDCSTLRAWWEEDEGRRSRFYKTVVGSDEEPPSRCTPEVVHFIVQQHFDAPSMWAIFPLQDLLALKDKYTSRPAPEETINDPTNPRHYWRFRVHVTLESLLDDKDIQATIKGLVTSSGRSFPGKKVEGADESGEKLSKVQLNGKA

SEQ ID NO: 3361 - protein, 944 aa, Pennisetum glaucum
MASKKSLNTVTLLFKLPYYTQWGQSLVIAGSEQALGSWNVKQGLSLSPVHQDKELFWCGRVSVAAGFTCEYKYYVVDDNKNVLRWESGEKRKLVLPEGVQDGDIIEIRDWWQDASEALFHRSAFKNVIFNDTEGVKKELQSLSLNKSLDPEDIVVQFIISCPRLVSGSTVVVTGSNPQLGRWRAQDGLKMSYVGDSLWKANCVLRKSEFPVKYKYCQISQAGKPSLELGPNREVDIELSSPKQPRYVVLSDGALRDAPWRGAGVAVPVFSIRSDEDLGVGEFLDLKLLVDWAVNSGFHLVQLLPINDTSVHGMWWDSYPYSSLSVFALHPLYLRVQALSDAIPADVKEEIQQAKKHLDKKDVDYEASLSTKLSIARKIFNLEKDKVLNSSSFKQFLSENEEWLKPYAAFCFLRDFFETSDHSQWGRFSQFSKEKLEKLISEGTLHHDVIRFHYFVQYHLYMQLSEAAAYARKKKVILKGDLPIGVDRNSVDTWVYPTLFRMNTATGAPPDYFDKNGQNWGFPTYNWEEMSKDNYGWWRARLTQMAKYFTAYRIDHILGFFRIWELPDHAATGLVGKFRPSIPLSQEELLSEGLWDFDRMSRPYIRQEILEEKFGSFWTVIAANFLNEYQKQCYEFKEDCNTEKKIIAKIKTSPEKLLWLEKEDSIRRGLFDLLQNIVLIRDPEDPTKFYPRFNLEDTSSFRDLDEHSKNVLRRLYYDYYFARQENLWRQNALKTLPVLLNSSDMLACGEDLGLIPACVHPVMQELGLIGLRIQRMPSEPNLEFGIPSQYSYMTVCAPSCHDCSTLRAWWEEDEGIRSRFYKDVVGSNEEPPSRCTPEVVHFIVKQHFDAPSMWAIFPLQDLLALKDKYTTRPAPEETINDPTNPKHYWRFRVHVTLESLLDDKDIQATIKDLVTGSGRSFPGNKVEGADEGGEKLSKVQLNGKA

SEQ ID NO: 3362 - protein, 632 aa, Sorghum bicolor
MWWDSYPYSSLSVFALHPLYLRVQALSDAIPADVKEEIQQAKKQLDKKDVDYEAALSTKLSIARKIFNLEKDKVLNSSSFKQFLSENEEWLKPYAAFCFLRDFFETSDHSQWGRFSQFSKEKLDKLISEGTLHHDVIRFHYYVQYHLYIQLSEAATYARKKKVILKGDLPIGVDRNSVDTWVYPTLFRMNTATGAPPDYFDKNGQNWGFPTYNWEEMSKDNYGWWRGRLTQMAKYFTAYRIDHILGFFRIWELPDHAATGLVGKFRPSIPLSQEELLSEGLWDFNRMSQPYIRQEILEEKFGSFWTVIAANFLNEYQKQCYEFKEDCNTEKKIIAKIKTSAEKSLWLEKEDSIRSGLFDLLQNIVLIRDPEDSTKFYPRFNLEDTSSFRDLDEHSKNVLRRLYYDYYFARQENLWRQNALKTLPVLLNSSDMLACGEDLGLIPACVHPVMQELGLIGLRIQRMPSEPNTEFGIPSQYSYMTVCAPSCHDCSTLRAWWEEDEGRRSRFYKTVVGSDEEPPSRCTPEVVHFIVQQHFDAPSMWAIFPLQDLLALKDKYTTRPAPEETINDPTNPKHYWRFRVHVTLESLLDDKDIQATIKDLVTSSGRSFPGKKAEGADESGEKLSKVQLNGKA

SEQ ID NO: 3363 - protein, 929 aa, Brachypodium distachyon
MVKSLHVTVIFKLPYYTQWGQSLVIAGSEPALGSWNVKQGLALSPVHQGNALIWCGQLSVAAGFTCEYSYHVVDDHKNVLRWESGEKKKLVLPEGVQDGDVVEIRDWWQDASEALFLRSAFKNVIFSENENAKRELKSASLSKSLDPEDIVVQFIISCPRLGAGSTVVVTGSNPSIGNWRAQDGLKLNYVGDSIWKANCVLRKSEFPVKYKYCQISEAGASTLEFGPNREVDVDSPSRYILLSDGSLRESPWRGAGVAVPMFSIRSNEDLGVGEFLDLKLLVDWAVNSGFHLVQILPINDTSVHQMWWDSYPYSSLSVFALHPLYLRVQALSDAIPKDVKEEILQAKKQLDKKDVDYEAAMATKLSIAKKIFNLEKDKVLSSASFKKFLSENEEWLKPYAVFCFLRDFFETSDHSQWGRFSQFSKEKLDKLVAEGTLHHDIIRFHYYIQYHLYTQLSEAAAYARKNKVILKGDLPIGVDRNSVDTWVYPTLFRMNTATGAPPDYFDKNGQNWGFPTYNWEEMSKDNYGWWRARLTQMAKYFTAYRIDHILGFFRIWELPDHAATGLIGKFRPSIPLSQEELLGDGIWDFDRMSRPYIRQDMLEEKFGSFWTVIAANFLNEYQKQCYEFKEECNTEKKIIAKLKTSPEKSLWLEKEDSVRRGLFDLLQNIVLIRDPEDPTKFYPRFNLEDTSNFRDLDEHSKNVLRRLYYDYYFTRQENLWRQNALKTLPVLLDASDMLACGEDLGLIPACVHPVMQELGLIGLRIQRMPSEPNCEFGIPSQYSYMTVCAPSCHDCSTLRAWWEEEAGRRSRFYKGVIGSDKEPPSRCTPEVVHFIVQQHFDAPSMWAIFPLQDLLALKDKYTTRPAVEETINDPTNPKHYWRFRLHVPLESMLEDKDIQATIKDLVTSSGRSFPGKKTEASKGQSSGKP

SEQ ID NO: 3364 - protein, 677 aa, Zea mays
MFSIRSDEDLGVGEFLDLKLLVDWAVNSGFHLVQLLPINDTSVHGMWWDSYPYSSLSVFALHPLYLRVQALSDAIPVDVKEEIQQAKKQLDKKDVDYEAALSTKLSIARKIFNLEKEKVLNSSSFKQFLSENEEWLKPYAAFCFLRDFFETSDHSQWGRFSQFSKDKLDKLICEGTLHHDIIRFHYYVQYHLYIQLSEAATYARKKNVILKGDLPIGVDRNSVDTWVYPTLFRMNTATGAPPDYFDKNGQNWGFPTYNWEEMSKDNYGWWRARLTQMAKYFTAYRIDHILGFFRIWELPDHAATGLVGKFRPSIPLSQEELLSEGLWDFNRMSQPYIRQEILEEKFGSFWTVIAANFLNEYQKQCYEFKEDCNTEKKIIVKIKTSAEKSLWVEKEDNIRRGLFDLLQNIVLIRDPEDSTKFYPRFNLEDTSSFRDLDEHSKNILRRLYYDYYFVRQENLWRQNALKTLPVLLNSSDMLACGEDLGLIPACVHPVMQELGLIGLRIQRMPSEPNLEFGIPSQYSYMTVCAPSCHDCSTLRAWWEEDEGRRSRFYKTVVGSDEEPPSRCTPEVVHFIVQQHFDAPSMWAIFPLQDLLALKDKYTTRPAPEETINDPTNPKHYWRFRVHVTLESLLNDKDIQATIKDLVTSSGRSFPGKKAEGADESGEKLSKVQLNGKA

SEQ ID NO: 3365 - protein, 931 aa, Hordeum vulgare
MGKNTVTVIFKLPYYTQWGQSLVIAGSAPALGSWSVKQGLSLSPVHQGNALVWCGQVSVAAGFTCEYSYHVVDDHKNVLRWESGEKKKLVVPEGVQDGEVVEVRDWWQDNSEALFLRSAFKNVIFSAADNAKRELQSSSLTKSLDPEDTVVQFIISCPRLASGSTVVVTGSNPAVGNWKAQDGLKLNYVGDSIWKANCVLRKSEFPVKYKYCQVSEAGVTSLEFGPNREVDVDLSSPKPSRYVLLSDGSLREAPWRGAGVAVPMFSIRSNEDLGVGEFLDLKLLVDWAVNSGFHLVQLLPINDTSVHKMWWDSYPYSSLSVFALHPLYLRVQALSDAIPADVKEEISKAKKELDKKDVDYEAALATKLTIAKKIFNLEKDKVLNSAPFKQFLSENEEWLKPYAAFCFLRDFFETSDHSQWGRFSQFSKEKLDKLVAPDALHHDIIRFHYYVQYHLFTQLSEAATYARKNKVILKGDLPIGVDRNSVDTWVYPTLFRMNTATGAPPDYFDKNGQNWGFPTYNWEEMSKDNYGWWRARLTQLSKFFTAYRIDHILGFFRIWELPDHAATGLVGKFRPSIPLSQEELLGDGIWDFDRMSRPYIRQDMLEEKFGSLWTVVAANFLNEYQKHCYEFKEECNTEKKIITKVKTSPEKSLWLEKEDSIRRGLFDLLQNIVLIRDPEDSTKYYPRFNLEDTSSFRDLDEHSKNVLRRLYHDYYFVRQENLWRQNALKTLPVLLNCSDMLACGEDLGLIPACVHPVMQELGLIGLRIQRMPSEPGLEFDIPSNYSYMTVCAPSCHDCSTLRAWWEGDEGTRSRFYKTVIGSDKEAPSRCTPEVVHFIVQQHFDAPSMWAIFPLQDLLALKDKYTARPAAEETINDPTNPKHYWRFRLHVPLESMLEDKDIQATIKELVTSSGRSFPGKTVDKAQPNAKKS

SEQ ID NO: 3366 - protein, 741 aa, Zea mays
MIVLNIFSTYKYCQISQAGNSTLELGPNREVNVDLSSPKQSRYIVLSDGALRDAPWRGAGVAVPMFSIRSDEDLGVGEFLDLKLLVDWAVNSGFHLVQLLPINDTSVHGMWWDSYPYSSLSVFALHPLYLRVQALSDAIPVDVKEEIQQAKKQLDKKDVDYEAALSTKLSIARKIFNLEKEKVLNSSSFKQFLSENEEWLKPYAAFCFLRDFFETSDHSQWGRFSQFSKDKLDKLICEGTLHHDIIRFHYYVQYHLYIQLSEAATYARKKNVILKGDLPIGVDRNSVDTWVYPTLFRMNTATGAPPDYFDKNGQNWGFPTYNWEEMSKDNYGWWRARLTQMAKYFTAYRIDHILGFFRIWELPDHAATGLVGKFRPSIPLSQEELLSEGLWDFNRMSQPYIRQEILEEKFGSFWTVIAANFLNEYQKQCYEFKEDCNTEKKIIVKIKTSAEKSLWVEKEDNIRRGLFDLLQNIVLIRDPEDSTKFYPRFNLEDTSSFRDLDEHSKNILRRLYYDYYFVRQENLWRQNALKTLPVLLNSSDMLACGEDLGLIPACVHPVMQELGLIGLRIQRMPSEPNLEFGIPSQYSYMTVCAPSCHDCSTLRAWWEEDEGRRSRFYKTVVGSDEEPPSRCTPEVVHFIVQQHFDAPSMWAIFPLQDLLALKDKYTTRPAPEETINDPTNPKHYWRFRVHVTLESLLNDKDIQATIKDLVTSSGRSFPGKKAEGADESGEKLSKVQLNGKA

SEQ ID NO: 3367 - protein, 447 aa, Panicum virgatum
MATRPLATALTLSKTPRAPSSSSSSGSHHSPPALVRRLQTLARALASSSPQAMASAPAPKKVLVPIANGTEPMEAVITIDVLRRAGADVAVASVEPASATVAAAWGVKLAADALLADIADAEFDLISLPGGMPGASNFRDCKLLENVVRKHVEKGKLYAAICAAPAVALGTWGLLNGLKATCHPSFMDKLPSEVHAVESRVQIDGKCVTSRGPGTAMEYSIVLVEQLYGKEKAEEVAGPMVMRPQHGVEFSTKELNSTSWNVGETPSILVPIANGTEEMEATMIIDILRRAKANVVVASLEDKLEVVASRKVKMVADVMLDDALKQQYDLILLPGGLGGAEAYAKSDKLMGLIKKQAEANKLYGAICASPAIALEPHGLLKGKKATSYPAMWNKLADQSECKNRVVVDGNLITSQGPGTSMEFSLAIVEKLFGREKARELAKTMVFV

SEQ ID NO: 3368 - protein, 435 aa, Avena sativa
MATRPLVFSTLRTPSSPSPPPLLRRLQTLTRALASSSPQTMASSPAPKKVLVPIANGTEPMEAVITIDVLRRAGAEVSVASVEPAAAQVAAAWGVKLVADALLDDLAETDFDLISLPGGMPGASTFRDSKVLENMVKIHVEKGKLYAAVCAAPAVALGSWGLLNGLKATCYPAFMDKLPSEVNAVESRVQIDGKCVTSRGPGTTMEYSVVLVEQLCGKEKADEVAGPMVMRPQHGAEFSMKELNSISWNVGEGPQILVPIANGTEEMEAIMIIDILRRAKANVVVASLEGTLEIVASRNVKMVADVLLNDALKQQYDLILLPGGLGGAQAYAKSDELIGLIKKQAEANKLYGAICASPAIALEPHGLLKGKKATSYPAMWNKLTDQSECKNRVVVDGNLITSQGPGTSMEFSLAIVEKLFGRERALELAKTMVFV

SEQ ID NO: 3369 - protein, 435 aa, Triticum aestivum
MATRPPVFSTLTASFSPSPPHLLRRLQTLTRALASSSPQPMASSPPLKKVLVPIANGTEPMEAVITIDVLRRAGADVAVASVEPGAAQVAASWGVKLAADTLLADLAEADFDLISLPGGMPGASTFRDCKILENIVKKHAEKGKLYAAVCAAPAVALGAWGLLNGLKATCHPSVMDKLPSEVQAVESRVQIDGNCVTSRGPGTTMEYSVVLVEQLYGKEKADEVAGPMVMRPQHGAEFSMKELNSTSWNVGENPQILVPIANGTEEMEAVMIIDILRRAKANVVVASLEGTLEIVASRNVKMVADVLLDDALKQQYDLILLPGGLGGAQAYAKSDKLIGLIKKQAEASKLYGAICASPAIALEPHGLLKGKKATSYPAMWSKLADQSECENRVVVDGNMITSQGPGTSMEFSLAIVEKLFGRERAFELAKSMVFV

SEQ ID NO: 3370 - protein, 435 aa, Triticum aestivum
MATRPPVFSTLTTSFSPSPPPLLRRLQTLTRALASSSPQPMASSPPLKKVLVPIANGTEPMEAVMTIDVLRRAGADVAVASVEPGAAQVAASWGVKLAADALLADLAEADFDLISLPGGMPGASTFGDCKILENIVKKHAEKGKLYAAVCAAPAVALGAWGLLNGLKATCHPLVMDKLPSEVQAVESRVQIDGNCVTSRGPGTTMEYSVVLVEQLYGKEKADEVAGPMVMRPQHGAEFSMKELNSTSWNAGENPQILVPIANGTEEMEAVMIIDILRRAKANVVVASLEGTLEIVASRNVKMVANVLLDDALKQQYDLILLPGGLGGAQAYAKSDKLIGFIKKQAEANKLYGAICASPAIALEPHGLLKGKKATSYPAMWSKLTDQSECKNRVVVDGNLITSQGPGTSMEFSLAIVEKLFGRERALELAKSMVFV

SEQ ID NO: 3371 - protein, 434 aa, Brachypodium distachyon
MATLSLVFTSRTLPTSSPSHLLRRLQTLTRAIASSSPQAMASSPTPKKVLVPIANGTEPMEAVITIDVLRRAGVDVAVASVEPGAAQVAASWGVKLAADALLADLADADFDLISLPGGMPGASSFRDCKILENMVKKHAEKGKLYAAICAAPAVALGSWGLLDGLKATCYPSFMDKLPSEVKAVESRVQIDGKCVTSRGPGTAMEYSVILVEQLYGKEKADEVAGPMVMRPQHGVEFSMKELNSTSWNVGESPQILVPIANGTEEMEAIMVIDILRRAKANVVVASLEDNLEIVASRNVKMVADVLLDEAIKQQYDLILLPGGLGGAQAYANSDKLIGLIKKQAETNKLYGAICASPAIALEPHGLLKGKKATSYPAMWNKLADQSECKNRVLVDGNLITSQGPGTSMEFSLAIVEKLFGRERALELAKTMVFV

SEQ ID NO: 3372 - protein, 435 aa, Triticum aestivum
  misc_feature (21)..(21): Xaa can be any naturally occurring amino acid
MATRPPVFSTLTTSFSPSPPXLLRRLQTLTRALASSSPQPMASSPPLKKVLVPIANGTEPMEAVITIDVLRRAGADVAVASVEPGAAQVAASWGVKLAADTLLADLAEADFDLISLPGGMPGASTFRDCKILENIVKKHAEKGKLYAAVCAAPAVALGAWGLLNGLKATCHPSVMDKLPSEVQAVESRVQIDGNCVTSRGPGTTMEYSVVLVEQLYGKEKADEVAGPMVMRPQHGAEFSMKELNSTSWNAGENPQILVPIANGTEEMEAVMIIDILRRAKANVVVASLEGTLEIVASRNVKMVANVLLDDALKQQYDLILLPGGLGGAQAYAKSDKLIGFIKKQAEANKLYGAICASPATALEPHGLLKGKKATSYPAMWSKLTDQSECKNRVVVDGNLITSQGPGTSMEFSLAIVEKLFGRERALELAKSMVFV

SEQ ID NO: 3373 - protein, 395 aa, Saccharum officinarum
MASSPAPKKVLVPIANGTEPMEAVITIDVLRRAGADVAVASVEPGAATVAASWGVKLAADALLADLAEDEFDLISLPGGMPGSSTFRDCKVLENMVKKHVEKGKLYAAICAAPAMALGTWGLLNGLKATCYPSFMDKLPSEVHAVESRVQIDGKCVTSRGPGTAMEYSVILVEQLYGKEKAKEVAGPMVMRPQHGVEFSIKELNATSWNVGETPNILVPIASGTEEMEATMIIDILRRAKANVVVASLEDKLEIVASRKVKMIADVLLDDALKEQYDLILLPGGLGGAEAYAKSDKLMDLIKKQAEANRLYGAICASPAIALEPHGLLKGKKGTSYPAMWNKLADQSECNNRVVVDGNLITSQGPGTSMEFSLAIVEKLFGRERALQLAKTMVFV

SEQ ID NO: 3374 - protein, 395 aa, Pennisetum glaucum
MASAPTPKKVLIPVANGTEPMEAVITIDVLRRAGADVAVASVEPGSATVAAAWGVKLAADVLLTDIADAEFDLISLPGGMPGSSTFRDCKLLENMVKKQVEKGKLYAAICAAPAMALGTWGLLNGLKATCYPSFMDKLPSEVHAVESRVQIDRKCVTSRGPGTAMEYSVVLVEQLYGKEKAEEVTGPMVMRPQHGVEFSMKELNSTSWNVGETPNILVPIANGTEEMEATMIIDILRRAKANVVVASLEDKLEVVASRKVKMVGDVLLDDALKQQYDLILLPGGLGGAEAYAKSDKLMDLIKKQAEANKFYGAICASPAIALEPHGLLKGKKATSYPAMWNKLADQSECKNRVVVDGNLITSQGPGTSMEFSLAIVDKLFGRGRALELMNTMVFI

SEQ ID NO: 3375 - protein, 396 aa, Sorghum bicolor
MASSSPAPKKVLVPIANGTEPMEAVITIDVLRRAGAHVAVASVEPGAATVAASWGVKLAADALLADLADDEFDLISLPGGMPGSSTFRDCKVLENMVKKHVEKGKLYAAICAAPAMALGTWGLLNGLKATCYPSFMDKLPSEVHAVESRVQIDGKCVTSRGPGTAMEYSVILVEQLYGKEKANEVAGPMVMRPQHGVEFSMKELNSTSWNVGETPNILVPIANGTEEMEATMIIDILRRAKANVVVASLEDKLEIVASRKVKMIADVLLDNVLKEQYDLILLPGGLGGAEAYAKSDKLMDLIKKQAEANRLYGAICASPAIAFEPHGLLKGKKATSYPAMWNKLADQSECDNRVVVDGNLITSQGPGTSMEFSLAIVEKLFGRERALELAKTMVFV

SEQ ID NO: 3376 - protein, 448 aa, Triticum aestivum
  misc_feature (20)..(20): Xaa can be any naturally occurring amino acid
  misc_feature (22)..(22): Xaa can be any naturally occurring amino acid
  misc_feature (362)..(362): Xaa can be any naturally occurring amino acid
NSPPKLREKSTDRNGHRGHXSXTLTTSFSPSPPPLLRRLQTLTRALASSAPQPMASSPPLKKVLVPIANGTEPMEAVITIDVLRRAGADVAVASVEPGAAQVAASWGVKLAADALLADLAEADFDLISLPGGMPGASTFRDCKILENMVKKHAEKGKLYTAICAAPAVALGAWGLLNGLKATCHPSVMDKLPSEMQAVQSRVQIDGNCVTSRGPGTTMEYSVVLVEQLYGKEKADEVAGPMVMRPQHGAEFSMKELNSTSWNVGENPQILVPIANGTEEMEAIMIIDILRRAKANVVVASLESTLEIVASRNVKMVADVQLDDALKQQYDLILLPGGLGGAQAYAKSDKLIGLIKKQAEANXLYGAICASPAIALEPHGLLKGKKATSYPAMWSKLVDQSECKNRVVVDGNLITSQGPGTSMEFSLAIVEKLFGRERAFELAKAMVFV

SEQ ID NO: 3377 - protein, 259 aa, Triticum aestivum
MASSPPLKKVLVPIANGTEPMEAVITIDVLRRAGADVAVASVEPGAAQVAASWGVKLAADALLADLAEADFDLISLPGGMPGASTFRDCKILENMVKKHAEKGKLYTAICAAPAVALGAWGLLNGLKATCHPSVMDKLPSEMQAVQSRVQIDGNCVTSRGPGTTMEYSVVLVEQLYGKEKADEVAGPMVMRPQHGAEFSMKELNSTSWNVGENPQILVPIANGTEEMEAIMIMDILRRGKQMLSLHLWKALWRLLHPGT

SEQ ID NO: 3378 - protein, 435 aa, Hordeum vulgare
MATRPPVFSTLTTSFSPSPPLLLRRLKTLTRAVASSAPQPMASSPPTKKVLVPIANGSEPMEAAIIIDVLRRAGADVAVASVEPGATQVAASWGVKLAADALLADLAEADFDLISLPGGMPGASTFRDCKVLENMVKKHAEKGKLYAAVCAAPAVALGAWGLLNGLKATCHPSCMNKLPSEVQAVESRVQIDGNCVTSRGPGTTMEYSVVLVEQLYGKEKADEVARPMVMRPQHGAEFSVKELNSISWNVGENPQILVPIANGTEEMEAIMIIDILRRAKANVVVASLEGTLEIVASRNVKMVADVLLDDVLKQQYDLILLPGGLGGAQAYTKSDKLVGLIKKQAEANKLYGAICASPAIALEPHGLLKGKKATSYPAMWSKLADQSECENRVVVDGNLITSQGPGTSMEFSLAIVEKLFGRERALELAKAMVFV

SEQ ID NO: 3379 - protein, 437 aa, Zea mays
MATRSLTSALPLSRTPRVPSHRPSLRRLQTLTRALTSSSPQAMASSPTPKKVLVPIANGTEPMEAVITIDVLRRAGADVAVASVEPGATSVAASWGIKLTADALLADLADDEFDLISLPGGMPGSSTFGECKVLEKMVKKHVEKGKLYAAICAAPAMTLGTWGLLNGLKATCYPSFIDKLPSEVHAVESRVQIDGKCMTSRGPGTAMEYSVILVEQLYGKEKAKEVAGPMVMRPQHGVEFSMKEVNSTSWNVGETPNILVPIANGTEEMEATMIIDILRRAKANVVVASLEDKLEIVASRKVKMIADVLLDDALKEQYDLILLPGGLGGAEAYAKSDKLMDLIKKQAEANRLYGAICASPAIALEPHGLLKGKKVTSYPAMWNKLADQSECNNRVIVDGNLITSQGPGTSMEFSLAIVEKLFGRERALELAKSMVFI

SEQ ID NO: 3380 - protein, 437 aa, Zea mays
MATRSLTSALPLSRTPRVPSHRPSLRRLQTLTRALTSSSPQAMASSPTPKKVLVPIANGTEPMEAVITIDVLRRAGADVAVASVEPGATSVAASWGIKLTADALLADLADDEFDLISLPGGMPGSSTFGECKVLEKMVKKHVEKGKLYAAICAAPAMTLGTWGLLNGLKATCYPSFIDKLPSEVHAVESRVQIDGKCMTSRGPGTAMEYSVILVEQLYGKEKAKEVAGPMVMRPQHGVEFSMKEVNSTSWNVGETPNILVPIANGTEEMEATMILDILRRAKANVVVASLEDKLEIVASRKVKMIADVLLDDALKEQYDLILLPGGLGGAEAYAKSDKLMDLIKKQAEANRLYGAICASPAIALEPHGLLKGKKVTSYPAMWNKLADQSECNNRVIVDGNLITSQGPGTSMEFSLAIVEKLFGRERALELAKSMVFI

SEQ ID NO: 3381 - protein, 395 aa, Pseudoroegneria spicata
  misc_feature (45)..(45): Xaa can be any naturally occurring amino acid
MASSPAPKKVLVPIANGSEPMEAAIIIDVLRRAGADVAVASVEPXTTQVAASWSVKLAADALLADLAEADFDLISLPGGMPGASTFRDCKILENMVKKHAEKGKLYAAVCAAPAVALGAWGLLNGLKATCHPSFMDKLPSEVQAVQSRVQIDGNCVTSRGPGTTMEYSVVLVEQLYGKEKADEVAGPMVMRPQHGAEFSVKELNSTSWNVGENPQILVPIANGTEEMEAIMIIDILRRAKANVVVASLEGTLEIVASRNVKMVADVLLDDALKQQYDIILLPGGLGGAQAYAKSDKLIGLIKKQAEASKLYGAICASPAIALEPHGLLKGKKATSYPAMWSKLADQSECKNRVVVDGNLITSQGPGTSMEFSLAIVEKLFGKERALELAKAMVFV

SEQ ID NO: 3382 - protein, 395 aa, Leymus cinereus x Leymus triticoides
MASSPPPKKVLVPIANGTEPMEAVITIDVLRRAGADVVVASVEPGAAQVAASWGVKLAADALLADLAEADFDLISLPGGMPGASTFRDCTVLENMVKKHAEKGKLYAAICAAPAVALGAWGLLNGLKATCHPSFMDKLPSEVQAVESRVQIDGNCVTSRGPGTTMEYSVVLVEQLYGKEKADEVAGPMVMRPQHGAEFSVKELNSTSWNVGENPQILVPIANGTEEMEAVMIIDILRRAKANVVVASLEGTLEIVASRNVKMVADVLLDDALKQQYDLILLPGGLGGAQAYAKSDKLIGLIKKQAEANKLYGAICASPAIALEPHGLLKGKKATSYPAMWSKLADQSECKNRVVVDGNLITSQGPGTSMEFSLAIVEKLFGRERALELAKTMVFV

SEQ ID NO: 3383 - protein, 307 aa, Sorghum bicolor
MMLLSHSSSTTTTTTTTWRLAAAAPPPARSRRARLLPPRARAADTTTGVSGAADRAAEALLQSGLRPESLPRHVAVVMDGNSRWARARGLTPADGHKAGGRNLERIVGLSRAWGIRALTAFVCSRENLSRPKAEVDYMMGLSEWLIGDNIDKLSRQGIRLQVIGDATQMPASLRSAAEQADEATRHNSQLHVMLAICYSGRWDMVQACRELVREAQAGRLSPDDVDESLVAGKLATSAAGHGEFSCPDLVVRTSGELRLSNFLLWQSAYSEFFFTDKMWPDFGEAEYLEALRSFQARDRRFGQSKLL

SEQ ID NO: 3384 - protein, 137 aa, Zea mays
MPASLRSAAAQADEATRHNSQLHVMLAICYSGRWDMVQACRELAREAQANRLSPDDIDESIIAGKLATSAAGEFSCPDLVIRTSGEMRLSNFLLWQSAYSELFFTAKMWPDFGEAEYLEALRSFQGRDRRFGQSKLL

SEQ ID NO: 3385 - protein, 347 aa, Hordeum vulgare
SWIWATARFDQSNKIGEGGYGPGYKGTLRDGTTVAVKVLSLQSRQGAREFLSELITISDISHENLVKLYGCCVEGSHKILVYNYLENNSLAQTLLGSRHSSIQFNWRTRVNICIGVAQGLAYLHDGVRPHVVHRDIKASNILLDQDLTPKISDFGLAKLLPSDVSHISTRVAGTLGYLAPEYAIRGQVTRKSDVYSFGVLLIEIVSGRCNTDTKLPYEDQILLEKTWAYYDQGQLEEIIDSSLGDDLDVDEACRFLKVGLLCTKNVTKRRPDMSTVTRMLKGEEDVESQEITKPDVIRDFRDLKLRSKATSSSLLTSIVARSSPSSSSSTGNTTRTSITFTAISDRP

SEQ ID NO: 3386 - protein, 387 aa, Brachypodium distachyon
MSCFSLFFKRIGVTHQQNDPCNEDFSGTENITRFSYKELVKATAKFDQSNKIGEGGYGPVYKGTLKDGTAVAVKVLSLQSRQGKKEFLSELLAISNVSHENLVKLYGCCVEESHKILVYNYLENNSLSQTLLGSRHSSIQFNWRTRVNICIGVAKGLAYLHDVIRPHIVHRDIKASNILLDDDLTPKISDFGLAKLLPSDVSHISTRVAGTLGYLAPEYAIRGQVTRKSDVYSFGVLLVEIVSGRCNTDTRLPYEDQILLEKTWAYYDQGNLDKIIDSNLGDDLDVDEACRFLKVGLLCTKNITKRRPDMSTVLAMLRGEVDVDSQEISKPDVIRDFRDLTLRSKATSSSMLSSIVARSSSPQSSSGSGDTVTTRTSITFTAISDRP

SEQ ID NO: 3387 - protein, 382 aa, Oryza sativa
MSCFSLFFKRSRTGQQQSDPYNEVFSGAENITRYSYKELAKATLNFDQSNKIGEGGFGPVYKGTLKDGTDVAVKLLSLQSRQGVKEFLNELMAISDISHENLVKLHGCCVEGRHRILVYNYLENNSLAHTLLGSRQSNIQFNWRARVNICIGVAKGLAFLHDGVRPHIVHRDIKASNILLDKDLTPKISDFGLAKLLPSDASHVSTRVAGTLGYLAPEYAIRGQVTRKSDVYSFGVLLVEIVSGRCNTDTKLPYEDQILLEKTWKCYDQGCLEKAIDSSMVDDVDVDEACRFLKVGLLCTQDISKRRPTMSMVISMLTGEMEVDKEKISKPDVIRDFRDLKLRSKATSSSSLLTSIMARSTPSSSQETTRTSITVTAISDRD

SEQ ID NO: 3388 - protein, 367 aa, Triticum aestivum
MARRHHLVLLLPLLALAVSFVAAAPEGHGDAAAAFIDGAPHRYLRDQQDDQATSMSLDEVSAAVSVLLGFAPPAMLPAPSSAKLNKLLLPKPFDRPRAVFLMQIDGSHDSVDSFVSDAGSIYKTKIEGAQNAATGLTDKDELIVIRSDESSGSDVLDNELTDLATWLEGSYQKADGKLNIPLKSGNSLTLLLNKEVDVEFASSLISLLKTIKRGIQVHEDFSGGIVSPAELLVCRFTGIKALEDEYGSAEIVKQGAEVVQTALTKAFDQLQGAYNGKIVGLVISTKEASTSLASIIDGPSSLHISRRLAEASKTNATASIAAIYLVRLSLAWITGIILLVSTLIGICLLMNMPLTRDTLLYSNVKMD

SEQ ID NO: 3389 - protein, 363 aa, Leymus cinereus x Leymus triticoides
  misc_feature (107)..(107): Xaa can be any naturally occurring amino acid
  misc_feature (150)..(150): Xaa can be any naturally occurring amino acid
  misc_feature (158)..(158): Xaa can be any naturally occurring amino acid
  misc_feature (172)..(172): Xaa can be any naturally occurring amino acid
  misc_feature (183)..(183): Xaa can be any naturally occurring amino acid
  misc_feature (189)..(189): Xaa can be any naturally occurring amino acid
  misc_feature (281)..(281): Xaa can be any naturally occurring amino acid
MARHHLLLPLLALAFSFVVAAPEGQGDAAAFIDGASHRYLRDQQDDQATSMSLDEVSAAVSVLLGFAPPAMLPAPSSAKLNKLLLPNPFDRPRAVFLMQLDGSHDSXDSFISDAGSIYKTKIDGAKNAATGLTDKDELIVIRSDESSGSXVLDNELTXLATWLEGSYQKADXKLNIPLKSGNXLTLLLXKEVDVEFASSLISLLKTIKRGIQVHEDFSGGIVSPAELLVCHFTGIKALEDEYGSAEIVKQGAEVVRTALTKAFDQLQGAYNGKIVGLVISXKEASTSLASIIDAPSSLHISRRLAEASKPNATASIAAIYLVRLSLAWITGIILLVSTLIGICLLMNMPLTRDTLLYSNVKMD

SEQ ID NO: 3390 - protein, 364 aa, Hordeum vulgare
MARRHLLLLPLLALAFSSAVAAPEGQGDAAAFIDGASHRYLRDQQDDQATSMSLDEVSAAVSVLLGFAPSAMLPAPSSAKLNKLLLPKPFDRPRAVFLVQIDGSHDSVDSFISDAGSVYKTKIDSAKNAATGLTDKDELIVIRSDESSGSGVLDNELTNLATWLEGSYQKADGKLNIPLKSGNSLTLLLNKEVDIKFASSLISLLKTIKRGIQVHEDFSGGIVSPAELLVCQFTGIKALEDEYGSAEIVKQGAEVVRTALTKAFDQLQGVYNGKIVGLVMSTKEASTSLSSIIDGPSSLHISRRLAEASRTNATASIAAIYLVRLSLAWITGIILLVSTLIGICLLMNMPLTRDTLLYSNVKID

SEQ ID NO: 3391 - protein, 235 aa, Hordeum vulgare
MARRHLLLLPLLALAFSSAVAAPEGQGDAAAFIDGASHRYLRDQQDDQATSMSLDEVSAAVSVLLGFAPSAMLPAPSSAKLNKLLLPKPFDRPRAVFLVQIDGSHDSVDSFISDAGSVYKTKIDSAKNAATGLTDKDELIVIRSDESSGSGVLDNELTNLATWLEGSYQKADGKLNIPLKSGNSLTLLLNKEVDIKFASSLISLLKPSKGYSGSRRFLRRHREPCRVISLPVHGH

SEQ ID NO: 3392 - protein, 366 aa, Hordeum vulgare
MACRHLLLLLPLIALAFSSAVAAPEGQGHAAAAFIDGASHRYLRDQQDDQAMSMSLDEVSAAVSVLLGFAPPAMLPAPSSAKLNELLLPKPFDRPRAVFLMQIDGSHDSVDSFVSDAGSIYKTKIDGAKSAATGLTDKDELIVIRSDESSGSDVLDNELTDLAIWLEGSYQKADSKLNIPLKSGNSLTLLLKKEVDVEFASSLISLHKTIKSGIQVHEDFSGGIVSPAELLVCHFTGIKALEDEYGSTEIVKQGAEVVQTALTKAFNQLQGAYNGKLVGLVISTKEASTSLASITDGPSSLHISRLLAEASKTKATASIAAIYLVRLSLAWITGIILLVSTLIGICLLMNMPLTKDTLLYSNVKID

SEQ ID NO: 3393 - protein, 423 aa, Triticum aestivum
LPLLDQSTLLSMQLASPIYFLEGGGERDNQDPNLGLAFKRRSKSWPATRPDLQPTPATMARHHLLLFLPLLALAFSFVVAAPERQGDAAAFIDGASHRYLRDQQEDQATSMSLDEVSAAVSVLLGFAPPAMLPAPSSAKFNKLLLPNPFDRPRSVFLMQLDGSHDYVDCFISDAGSIYKTKIDGAKSAAIELTDKDELIVIRSDESSGLDVLDNELANLATWLAGSYQKADSKLNIPLKSGNSLTLFLTKEADVEFASSLISLLKTIERGIQVHEDFSGGIVSPAELLVCHFTGIKALEDEYGSAEIVKQGAEVVQTALTKAFDQLQGAYNGKIVGLVISAKEASTSLASIIDAPSSLHISRRLAEASKTNATASIAAIYLVRLSLAWITGIILLVSTLIGICLLMNMPLTRDTLLYSNVKID

SEQ ID NO: 3394 - protein, 365 aa, Triticum aestivum
MARHHLLLFLPLLALAFSFVVAAPERQGDAAAFIDGASHRYLRDQQEDQATSMSLDEVSAAVSVLLGFAPPAMLPAPSSAKFNKLLLPNPFDRPRSVFLMQLDGSHDYVDCFISDAGSIYKTKIDGAKSAAIELTDKDELIVIRSDESSGLDVLDNELANLATWLAGSYQKADSKLNIPLKSGNSLTLFLTKEADVEFASSLISLLKTIKRGIQVHEDFSGGIVSHAELLVCHFTGIKALEDEYGSAEIVKQGAEVVQTALTKALDQLQGAYNGKIVGLVISAKEASTSLASIIDALSSLHISRRLAEASKTNATASIAAIYLVRLSLAWITGIILLVSTLIGICLLMNMPLTRDTLLYSNVKID

SEQ ID NO: 3395 - protein, 365 aa, Triticum aestivum
MARHHLLLFLPLLALAFSFVIAAPERQGDAAAFIDGASHRYLRDQPEDQATSMSLGEVSAAVSVLLGFAPPAILPAPSSAKLNKLLLPNPFDRPRSVFLMQLDGSHDYVNGFISDAGSIYKTKIDGAKSAAIELSDKDELIVIRSDESSGLDVLDNELANLATWLAGSYQKADSKLNIPLKSGNSLTLFLTKEADVEFASSLISLLKTIERGIQVHEDFSGGMVSPAELLVCHFTGIKALEDEYGSAEIVKQGAEVVQTALTKAFDQLQGAYNGKIVGLVISAKEASTSLASIIDAPSSLHISRRLAEASKTNATASIAAIYLVRLSLAWITGIILLVSTLIGICLLMNMPLTRDTLLYSNAKID

SEQ ID NO: 3396 - protein, 388 aa, Triticum aestivum
GGQPRSKSSVATRSDLQPTPATMAHRHHLLLLLPLLALAVSFVVAAPEGHGDSAAFIDGASHRYLRDQQDDQATSMSLDEVSAAVSVLLGFAPPAMLPLPSSAKLNKLLLPKPFDRPRAVFLMQIDGSHDSVDSFISDAGSIYKTKIDGANNAATGLTDKDELIVICSDESSGSDVLDNELTDLATWLEGSYQKADGKLNIPLKSGNSLTLLLNKEVDVEFASSLISLLKTIKRGIQVHEDFSGGIVSPAELLVCRFTGIKALEDEYGSAEIVKQGAEVVRTALTKAFDQLQGAYNGKIVGLVISTEEASTSLASIIDGPSSLHISRRLAEASKTNATASIAAIYLVRLSLAWITGIILLVSTLIGICLLMNMPLTRDTLLYSNVKMD

SEQ ID NO: 3397 - protein, 396 aa, Triticum aestivum
YFLEVVRGGQPRSKSSVATRSDLQPTPATMARRHHLVVLLPLLALAVSFVAAAPEGHGDAAAAFIDGAPHRYLRDQQDDQATSMSLDEVSAAVSVLLGFAPPAMLPAPSSAKLNKLLLPKPFDRPRAVFLMQIDGSHDSVDSFVSDAGSIYKTKIEGAQNAATGLTDKDELIVIRSDESSGSDVLDNELTDLATWLEGSYQKADGKLNIPLKSGNSLTLLLNKEVDVEFASSLISLLKTIKRGIQVHEDFSGGIVSPAELLVCRFTGIKALEDEYGSAEIVKQGAEVVQTALTKAFDQLQGAYNGKIVGLVISTKEASTSLASIIDGPSSLHISRRLAEASKTNATASIAAIYLVRLSLAWITGIILLVSTLIGICLLMNMPLTRDTLLYSNVKMD

SEQ ID NO: 3398 - protein, 383 aa, Triticum aestivum
RSKSWPATRSDLQPTPATMARHHLLLFLPLLALAFSFVIAAPERQGDAAAFIDGASHRYLRDQPEDQATSMSLGEVSAAVSVLLGFAPPAILPAPSSAKLNKLLLPNPFDRPRSVFLMQLDGSHDYVNGFISDAGSIYKTKIDGAKSAAIELSDKDELIVIRSDESSGLDVLDNELANLATWLAGSYQKADSKLNIPLKSGNSLTLFLTKEADVEFASSLISLLKTIERGIQVHEDFSGGMVSPAELLVCHFTGIKALEDEYGSAEIVKQGAEVVQTALTKAFDQLQGAYNGKIVGLVISAKEASTSLASIIDAPSSLHISRRLAEASKTNATASIAAIYLVRLSLAWITGIILLVSTLIGICLLMNMPLTRDTLLYSNAKID

SEQ ID NO: 3399 - protein, 369 aa, Avena sativa
MARHHLLLLLPLLALTFSVAVASTEGQGDSAAFIDGASHRYLRDQQDDQATLMSLDEVSAAVSVLLGFAPPAMLPSHSSAKLNKVLLPNPFDRPRAVFLMQLDGSKTSVDSFVSEAGGIFRTKVEGAKNAATGLTDKDELIVIRSDESLDAHSGSDSLDNELTDLAIWLEGSYQKTDGKLNIPLESGNSLTLLVSKDADLEFASSLISLLKTITRGIQVHQDFSGGIVSPAELLVCRFTGMKALEGEYGSAEVVKQGAEVVRTALTKAFDQLQAAYNGKIVGLVISTNEASTSLASIIDAPSSLHISRRLAEASKTNASASIAAIILVRLSLAWTTGIILLISTLIGICLLMNMPLTRDTLLYSNVKLD

SEQ ID NO: 3400 - protein, 361 aa, Brachypodium distachyon
MARRHLLLPLLALAFSVSLAAPQGLGDVAAFIDGASHRYLRHQQHDQASSMSLDEVSAAVSVLLGFAPPASLPALSSSKLNKVLLPNPFDRPRAVFLMQLDGSHASVDSFISEAGTIFRTRIDGAKNLATGLTDKDELIVIHSDESLAVQDNDLTNLANWLEGSYQKADGKLKIPLESGNSLTLFISKEADLEFASSLISLLKTIKRSIQVHEDFSGGIVSPAELLVCHFTGIKALEDEYGSAEIVKQGAEVVRTALSKAFDLLQGAYRGKIVGLVISAKEASTSLASIIDAPSSMHISRRLEEASRTNAAASIAAIYLVRLSLAWITGIILLVSTLIGVCLLMNMPLTRDTLLYSNVKID

SEQ ID NO: 3401 - protein, 399 aa, Triticum aestivum
QLASPIYFLRGRGREGQPRSKSWPATRSDLQPTPATMARHHLLLFPPLLALAFSFVVAAPEGDAAAFIDGASHRYLRDQQEDQATSMSLDEVSAAVSVLLGFAPPAMLPAPSSAKLNKLLLPNPFDRPRSVFLMQLDGSHDYVDGFISDAGSIYKTKIDGAKSAAIELTDKDELIVIRSDESSGLDVLDNELANLATWLAGSYQKADSKLNIPLKSGNSLTLFLTKEADVEFASSLISLLKTIERGIQVHEDFSGGIVSPAELLVCHFTGIKALEDEYGSAEIVKQGAEVVQTALTKALDQLQGAYNGKIVGLVISAKEASTSLASIIDALSSLHISRRLAEASKTNATASIAAIYLVRLSLAWITGIILLVSTLIGICLLMNMPLTRDTLLYSNVKID

SEQ ID NO: 3402 - protein, 137 aa, Saccharum officinarum
MAASVMASLSLKPSPFLDRSRFTGVQPSARSSTFRVMAKKTKKIQTSQPFGPAGGLNLKDGVDASGRPAKGKGAYQFTNKYGANVDGYSPIYNPEEWSPSGDVYVGGKTGLLLWAVTLTGMLLGGALLVYNTSALAS

SEQ ID NO: 3403 - protein, 137 aa, Panicum virgatum
MEATVMASLALKPSPFLDRSRFPGVKPSARSSAFRVMAKKAKKIQTSQPFGPAGGLNLKDGVDASGRPAKGKGVYQFSSKYGANVDGYSPIYNPEEWSPSGDVYVGGKTGLLLWAITLAGILLGGALLVYNTSALAS

SEQ ID NO: 3404 - protein, 139 aa, Brachypodium distachyon
MAASVMASTALKPSPSPFIGQPRLRAIQPSARSPSFRVMSKKAKKVQTSQPFGPGGGLELKDGVDASGRPAKGKGVYQFASKYGANVDGYSPIYNPEEWSPSGDFYAGGKTGLLLWAVTLAGILLGGALLIYNTSSLAS

SEQ ID NO: 3405 - protein, 139 aa, Oryza sativa
MATSVMASCALKPSPSPFLEQTRIRAIQPSSRPSLFRVMAKKAKKIQTSQPFGPGGGLNLKDGVDASGRPIKGKGVYQFASKYGANVDGYSPIYNPEEWSPSGDLYTGGKTGLLLWAVTLSGILLAGALLVYNTSALAS

SEQ ID NO: 3406 - protein, 139 aa, Triticum aestivum
MATSIMASMALKSSPSPFSGQSQLQRIQPSARSSSFRVMSKKAKKVQTSQPFGPGGGLELKDGVDASGRPAKGKGVYQFASKYGANVDGYSPIYNPEEWSPSGDYYAGGKTGLLLWVATLAGILLGGALLVYNTSALAS

SEQ ID NO: 3407 - protein, 139 aa, Festuca arundinacea
MGTSVMASMALKPSPFQFFGKSRLQGIQPSTRSSSFRVMSKKAKKVKTTQPFGPGGGLELKDGVDASGRQAKGKGVYQFANKYGANVDGYSPIYNPEEWSPSGDYYAGGKTGLLLWVATLSGILLGGALLVYNTSALAS

SEQ ID NO: 3408 - protein, 480 aa, Unknown
  Sequence found in Organisms: Solanum tuberosum, Solanum phureja
MAATHLVSHSSSLHKSLKYPSNASQKLYFFKPNFPLKPISRNLSIRASVSTSEPQTQKFQHCFKKSEDGFLYCEGVKVEDVMETVERRPFYLYSKPQITRNVEAYKAALEGLNSIIGYAIKANNNLKILEHLRGLGCGAVLVSGNELKLALTAGFDPTKCIFNGNGKLLEDLVLAAQAGVFVNIDSEFDLDNIVAAARLAGKKVNVLLRINPDVDPQVHPYVATGNKSSKFGIRNEKLQWFLDAVKAHPQELKLVGAHCHLGSTITKVDIFRDAAVLMVNYIDEIRSQGFEIDYLNIGGGLGIDYYHAGAILPSPRDLINTVRELVLSRNLNLIIEPGRSLIANTCCLVNRVTGVKTNGTKNFIVIDGSMAELIRPSLYDAYQHIELVSPPPPEAAIAKFDVVGPVCESADFLGKDRELPAPTRGTGLVVHDAGAYCMSMASTYNLKMRPPEYWVEEDGSLSKIRHGETFEDHLRFFDGL

SEQ ID NO: 3409 - protein, 480 aa, Nicotiana tabacum
  misc_feature (247)..(247): Xaa can be any naturally occurring amino acid
  misc_feature (286)..(286): Xaa can be any naturally occurring amino acid
MAATHLVSHSPSLPKSLKYPSNPTPKLSFFKPIFPLKPISRNLCVRAAVSTSEPQTQKFQHCFMKSGDGFLYCEGVKVQDVMETVEKRPFYLYSKPQITRNVEAYKAALEGLNSIIGYAIKANNNLKILEHLRGLGCGAVLVSGNELKLALRAGFDPTKCIFNGNGKLLEDLVIAAQEGVFVNIDSEFDLDNIVAAARISGKKVNVLLRINPDVDPQVHPYVATGNKSSKFGIRNEKLQWFLDAVKXHPQELKLVGAHCHLGSTITKVDIFRDAAVLMVNYIDEIXSQGFEINYLNIGGGLGIDYYHSGAVLPSPRDLIDTVRELVLSRKLNLIIEPGRSLIANTCCLVNRVTGVKTNGTKNFIVIDGSMAELIRPSLYDAYQHIELVSPPPPEAAISRFDVVGPVCESADFLGKGRELPAPTRGTGLVVHDAGAYCMSMASTYNLKMRPPEYWVEEDGSISKIRHGETFEDHLRFFEGL

SEQ ID NO: 3410 - protein, 480 aa, Cucumis melo
MAATNLYSPSPSLSSTLKHSLNSNPFHRIPFRLHKPFLKTPLSLKAVLSQNPSKTQTQFQHCFSKSSDGFLYCEGIKVQDIMESVDKRPFYLYSKPQITRNVEAYKEALEGLNSIIGYAIKANNNLKVLEHLRKLGCGAVLVSGNELRLALHAGFDPTKCIFNGNGKLLEDLVLAAEQGVFVNVDSEFDLDNIVAAARIAGKKVNVLLRINPDVDPQVHPYVATGNKNSKFGIRNEKLQWFLDAVKAHPDELKLVGAHCHLGSTITKVDIFRDAAVLMVNYIDEIRDQGFEVDYLNIGGGLGIDYYHAGAILPTPRDLINTVRELVLSRNLNLIIEPGRSVIANTCCLVNRVTGVKTNGTKNFIVIDGSMAELIRPSLYDAYQHIELVAPTPPDSEISTFDVVGPVCESADFLGKQRELPTPPKGAGLVVHDAGAYCMSMASTYNLKMRPPEYWVEEDGSVSKIRHGETFDDHLRFFENL

SEQ ID NO: 3411 - protein, 485 aa, Triphysaria pusilla
MAASNFLSHQTPKTLPSKFLHLFPNPPFSTTHILPFKIKHNSKPLSLRALTPSAVLSTSEPKTQKFEHCFEKSNDGFLYCEGVKVEEIMEGVEKRPFYLYSKPQITRNVEAYKDALEGLNSIIGYAIKANNNLKILEHLQGLGCGAVLVSGNELKLALRAGFDPTRCVFNGNGKIVEDLVLAAQEGVFVNIDSEFDLENIVAAARIAGKKVNVLLRINPDVDPQVHPYVATGNKNSKFGIRNEKLQWFLDAVKAHPKELKLVGAHCHLGSTITKVDIFRDAASLMVNYIDEIRSQGFEIDYLNIGGGLGIDYYHTGAVLPTPRDLIDTVRELVLSRNLNLIIEPGRSLIANTCCFVNHVTGVKTNGTKNFIVIDGSMSELIRPSLYGAYQHIELISPSDAEMSTFDVVGPVCESADFLGKDRELPTPSKGDGLVVHDAGAYCMSMASTYNLKMRPPEYWVEDDGSLSKIRHGETFDDHLRLFEGL

SEQ ID NO: 3412 - protein, 482 aa, Cucumis sativus
MAATNLYSPSPSPSLSSTLKHSLNSNPFHRIAFLPHKPFLKAPLSLKAVLSQNPSKTQTQFQHCFSKSSDGFLYCEGIKVQDIMESVDKRPFYLYSKPQITRNVEAYKEALEGLNSIIGYAIKANNNLKVLEHLRKLGCGAVLVSGNELRLALHAGFDPTRCIFNGNGKLLEDLVLAAEQGVFVNVDSEFDLDNIVAAARIARKKVNVLLRINPDVDPQVHPYVATGNKNSKFGIRNEKLQWFLDAVKAHPDELKLVGAHCHLGSTITKVDIFRDAAVLMVNYIDEIRDQGFEVDYLNIGGGLGIDYYHAGAILPTPRDLINTVRELVLSRNLNLIIEPGRSVIANTCCLVNRVTGVKTNGTKNFIVIDGSMAELIRPSLYDAYQHIELVAPTPPDSEISTFDVVGPVCESADFLGKQRELPTPPKGAGLVVHDAGAYCMSMASTYNLKMRPPEYWVEEDGSVSKIRHGETFDDHLRFFENL

SEQ ID NO: 3413 - protein, 480 aa, Cucumis melo
  misc_feature (114)..(114): Xaa can be any naturally occurring amino acid
  misc_feature (166)..(166): Xaa can be any naturally occurring amino acid
  misc_feature (185)..(185): Xaa can be any naturally occurring amino acid
  misc_feature (465)..(465): Xaa can be any naturally occurring amino acid
MAATNLYSPSPSLSSTLKHSLNSNPFHRIPFRLHKPFLKTPLSLKAVLSQNPSKTQTQFQHCFSKSSDGFLYCEGIKVQDIMESVDKRPFYLYSKPQITRNVEAYKEALEGLNXIIGYAIKANNNLKVLEHLRKLGCGAVLVSGNELRLALHAGFDPTKCIFNGNXKLLEDLVLAAEQGVFVNVXSEFDLDNIVAAARIAGKKVNVLLRINPDVDPQVHPYVATGNKNSKFGIRNEKLQWFLDAVKAHPDELKLVGAHCHLGSTITKVDIFRDAAVLMVNYIDEIRDQGFEVDYLNIGGGLGIDYNHAGAILPTPRDLINTVRELVLSRNLNLIIEPGRSVIANTCCLVNRVTGVKTNGTKNFIVIDGSMAELIRPSLYDAYQHIELVAPTPPDSEISTFDVVGPVCESADFLGKQRELPTPPKGAGLVVHDAGAYCMSMASTYNLKMRPPEYWVEEDGSVSKIXHGETFDDHLSVFENL

SEQ ID NO: 3414 - protein, 485 aa, Quercus alba
MAATGTHFLCYSPTFTKTLNHSLNQNPFFKIPTLSLKTTQKLSLSLKAILSQNPAKTLNQNTSFQHCFTKSSDGFLYCEGLKVQEVMDSVEKRPFYLYSKPQITRNFEAYNQALEGLSSIIGYAIKANNNLKILEHLRQLGCGAVLVSGNELRLALHAGFDPTKCIFNGNGKLLEDLVLAAEAGVFVNVDSEFDLENIVAAARIAGKKVNVLLRINPDVDPQVHPYVATGNKNSKFGIRNEKLQWFLDAVKAHPNELKLVGAHCHLGSTITKVDIFRDAAVLMVNYIDEIRAQGFEVDYLNIGGGLGIDYYHAGAILPTPRDLIDTVRELVLSRNLKLIIEPGRSLIANTCCLVNRVTGVKTNGTKNFVVIDGSMAELIRPSLYDAYQHIELVSPAPPDAETSTFDVVGPVCESADFLGKDRELPTPAKGTGLVVHDAGAYCMSMASTYNLKMRPPEYWVEEDGSVTKIRHGETFGDHLRFFEGL

SEQ ID NO: 3415 - protein, 488 aa, Gossypium hirsutum
MAATHLLSHSSFLPKTLNHSLTKNPFSKSPILPLKPSKNVFKHPSLSLSLKAVLSQNPAKTLNPTFQHCFTKSPDGFLYCEDTKVQDVMEKVEKRPFYLYSKPQITRNVEAYKEALEGLKNSIIGYAIKANNNFKILQHLRMLGCGAVLVSGNELKLALRAGFDPTKCIFNGNGKILEDLVLAAQEGVFVNVDSEFDLENIVAAARIAGRKVNVLLRINPDVDPQVHPYVATGNKNSKFGIRNEKLQWFLDAVKAHPNELKLVGAHCHLGSTITKVDIFRDAAVLMVNYIDEIRAQGFEVDYLNIGGGLGIDYYHSGAVLPTPRDLIDTVRELVHSRNLNLIIEPGRSLIANTCCFVNRVTGVKTNGTKNFIVIDGSMAELIRPSLYDAYQHIELVSPAPPAAEVSTFDVVGPVCESADFLGKERELPTPAKGTGLVVHDAGAYCMSMASTYNLKMRPPEYWVEEDGSVTKIRHGETFEDHMRFFEGL

SEQ ID NO: 3416 - protein, 488 aa, Mimulus guttatus
MAAAANLLSPNPTTLSTKPANLHSDLFSVTRVLPFKSKPISRTLTSLRARIAPKAVIATSEPKTQNFQHCFTKSDDGFLYCEGVKVEEVMEAVEKRPFYLYSKPQITRNVEAYKEALEGLNSIIGYAIKANNNLKILEHLQKLGCGAVLVSGNEVKLALRAGFDPKRCVFNGNGKILDDLVLAAQEGVFVNIDSEFDLENIVAAARIAGKKVNVLLRINPDVDPQVHPYVATGNKNSKFGIRNEKLQWFLDAVKAHPKELKLVGAHCHLGSTITKVDIFRDAALLMVNYIDEIRSQGFEIDYLNIGGGLGIDYYHTGAVLPTPMDLINTVRELVVSRNLNLVIEPGRSLIANTCCFVNHVTGVKTNGTKNFIVIDGSMSELIRPSLYGAYQHIELVSPSPSDAEISTFDVVGPVCESADFLGKDRELPTPTKGAGLVVHDAGAYCMSMASTYNLKMRPPEYWVEDDGSLSKIRHGETFDDHLRFFDGL

SEQ ID NO: 3417 - protein, 484 aa, Citrus sinensis
MAATQLCSNSASLSKALTQNPFPKIPISPLKTTLNFQRTLKPFTLKAVLSQNPAKSQTHTAPVEHCFSKKADGFLYCEDVRVQDVMETVEKRPFYLYSKPQITRNVEAYKQALEGLNSIIGYAIKANNNYKILEHLRKLGCGAVLVSGNELRLALRAGFDPTKCIFNGNGKLLEDLVLAAQEGVFVNVDSEFDLENIVVASRIAGKKVNVLLRINPDVDPQVHPYVATGNKNSKFGIRNEKLQWFLDAVKAHPNELKLVGAHCHLGSTITKVDIFRDAAVLMVNYIDKIRAQGFEVDYLNIGGGLGIDYYHTGAVLPKPRNLIDTVRELVLSRNLNLIIEPGRSLIANTCCLVNHVTGVKTNGTKNFIVIDGSMAELIRPSLYDAYQHIELVSPAPQDAEISKFDVVGPVCESADFLGKERELPTPDRGAGLVVHDAGAYCMSMASTYNLKMRPPEYWVEEDGSVSKIRHGETFEDHMRFFEGL

SEQ ID NO: 3418 - protein, 485 aa, Arabidopsis lyrata
MAAATQCLSQPSSSLNPYQLKNQTSQLSRIIPIFSLKSTLKPLKRLSVKATAVSQNSTKTLTKFDHCFKKSSDGFLYCEGTKVEDIMESVERRPFYLYSKPQITRNLEAYKEALEGVTSVIGYAIKANNNLKILEHLRSLSCGAVLVSGNELRLALLAGFDPTKCIFNGNGKLLEDLVLAAQEGVFVNVDSEFDLNNIVEASRISGKQVNVLLRINPDVDPQVHPYVATGNKNSKFGIRNEKLQWFLDQVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPPPEAEVTKFDVVGPVCESADFLGKDRELPTPPQGAGLVVHDAGAYCMSMASTYNLKMRPPEYWVEEDGSISKIRHAETFDDHLRFFEGL

SEQ ID NO: 3419 - protein, 487 aa, Phaseolus coccineus
MAGSHLLSHSQSLTKTYNHSFNQNPLSQKLLLPFKFKATLKPRALRAVLSQNASQTAVEDSKKAPFQHCFTKFEDGYLYCEGLKVHDIMESVERRPFYLYSKPQITRNVEAYRDALDGLNSVIGYAIKANNNLKILEHLRHLGCGAVLVSGNELRLALRAGFDPTRCIFNGNGKILEDLVLAAQAGVFVNIDSEFDLENIVEAAKRAGKKVNVLLRINPDVDPQVHPYVATGNKNSKFGIRNEKLQWFLDAVKEHPNELKLVGAHCHLGSTITKVDIFRDAATIMINYIDEIRAQGFEVDYLNIGGGLGIDYYHSGAVLPSPRDLIDTVRDLVLSRGLNLIIEPGRSLIANTCCLVNRVTGVKTNGSKNFIVIDGSMAELIRPSLYDAYQHIELVSPTPSNAEIATFDVVGPVCESADFLGKGRELPTPAKGTGLVVHDAGAYCMSMASTYNLKMRPPEYWVEDDGSVSKIRHGETFEDHIRFFEGL

SEQ ID NO: 3420 - protein, 493 aa, Brassica rapa
MASATHLLSQPSSSLRRNLNQYQSNQSPLSRIPVLSLKSTLKPLQRLSVKAAASPPNSVKTVTKDSSDQSAFNHCFKKSSDGFLYCEGTKVEDIMESVERRPFYLYSKPQITRNVEAYKEALEGVSSVIGYAIKANNNLKILEHLRSLGCGAVLVSGNELRLALRAGFDPTKCIFNGNGKLLEDLVIAAQAGVFVNVDSEFDLDNIVEASRISGKQVNVLLRINPDVDPQVHPYVATGNKNSKFGIRNEKLQWFLDEVKAHPNELKLVGAHCHLGSTITKVDIFRDAAVLMVEYIDEIRRQGFEVSYLNIGGGLGIDYYHAGAILPTPMDLINTVRELVLSRGLNLIIEPGRSLIANTCCFVNHVTGVKTNGTKNFIVIDGSMAELIRPSLYDAYQHIELVSPPAPEAEVSKFDVVGPVCESADFLGKDRELPTPPKGAGLVVHDAGAYCMSMASTYNLKMRPPEYWVEDDGSITKIRHAETFEDHLRFFEGL

SEQ ID NO: 3421 - protein, 483 aa, Medicago truncatula
MVGTHLLSHSCSLPKTFNHSFTKNPLPQNFILPLKSKSTTKPIVLRAVLSKTPPETTKITNFDHCFSKSEDGYLHCENLKVAEIMESVEKRPFYLYSKPQITRNVEAYKDALEGLTSIIGYAIKANNNYKILEHLRSLGCGAVLVSGNELKLALRAGFDPTRCIFNGNGKILEDLVLAAEAGVFVNIDSEFDLENIVAAARIAGKRVNVLLRINPDVDPQVHPYVATGNKNSKFGIRNEKLQWFLDAVKEHPVELKLVGAHCHLGSTITKVDIFRDAATIMVNYIDEIRAQGFEVDYLNIGGGLGIDYYHAGAVLPKPRDLIDTVRELVLSRGLKLIIEPGRSLIANTCCLVSRVTGVKTNGSKNFIVIDGSMAELIRPSLYDAYQHIELVSPAPANAEITTFDVVGPVCESADFLGKGRELPTPAKGTGLVVHDAGAYCMSMASTYNLKMRPPEYWVEDDGSLSKIRHGETFEDHMRLFDGL

SEQ ID NO: 3422 - protein, 482 aa, Populus trichocarpa
MAAATNFSHSPFISKTLTHSLNHNPLPKNPTLPFKLSKSYSLKAVISQQNPATATTQKTQFKHCFTKSQDGFLYCESLKVQEIMESVEKRPFYLYSKPQITRNVEAYKDALQGLSSIIGYAIKANNNLKILEHLRGLGCGAVLVSGNELRLALRAGFDPTRCIFNGNGKLLDDLVLAAQEGVFVNVDSEFDLENIVAAARIAGKKVNVLLRINPDVDPQVHPYVATGNKNSKFGIRNEKLQWFLDAVKAHPNELKLVGAHCHLGSTITKVDIFRDAAALMVNYIDEIRAQGFEVDYLNIGGGLGIDYYHSGAVLPTPRDLIDTVRELVLSRDLNLIIEPGRSLIANTCCLVNRVTGVKTNGTKNFVVIDGSMAELIRPSLYDAYQHIELVSPASPSAEVSTFDVVGPVCESADFLGKDRELPTPAKGAGLVVHDAGAYCMSMASTYNLKMRPPEYWVEDDGSVSKIRQGETFEDHIRFFEGL

SEQ ID NO: 3423 - protein, 493 aa, Brassica napus
MASATHLLSQPSSSLRRNLNQYQSNRSSLSRIPVLSLKSTLKPLQRLSVKAAASSPNSVKTETKGSDDDSAFNHCFKKQSDGFLYCEGTKVEEIMESVERRPFYLYSKPQITRNVEAYKEALEGVSSVIGYAIKANNNLKILEHLRSLGCGAVLVSGNELRLALRACFDPTKCIFNGNGKLLEDLVLAAQAGVFVNVDSEFDLDNIVEASRISGKQVNVLLRINPDVDPQVHPYVATGNKNSKFGIRNEKLQWFLDEVKAHPNELKLVGAHCHLGSTITKVDIFRDAAVLMVEYIDEIRRQGFEVSYLNIGGGLGIDYYHAGAILPAPMDLINTVRELVLSRGLNLIIEPGRSLIANTCCFVNHVTGVKTNGTKNFIVIDGSMAELIRPSLYDAYQHIELVSPTPPEAEVSKFDVVGPVCESADFLGKDRELPTPPKGAGLVVHDAGAYCMSMASTYNLKMRPPEYWVEDDGSITKIRHAETFEDHLRFFEGL

SEQ ID NO: 3424 - protein, 488 aa, Glycine max
MAGSNILSHSPSLPKTYSHSLNQNALSQKLFFLPLKFKATTKPRALRAVLSQNAVKTSVEDTKNAHFQHCFTKSEDGYLYCEGLKVHDIMESVERRPFYLYSKPQITRNVEAYKDALEGLNSIIGYAIKANNNLKILEHLRHLGCGAVLVSGNELKLALRAGFDPTRCIFNGNGKILEDLVLAAQEGVFVNIDSEFDLENIVEAAKRAGKKVNVLLRINPDVDPQVHPYVATGNKNSKFGIRNEKLQCFLDAVKEHPNELKLVGAHCHLGSTITKVDIFRDAATIMINYIDQIRDQGFEVDYLNIGGGLGIDYYHSGAILPTPRDLIDTVRDLVISRGLNLIIEPGRSLIANTCCLVNRVTGVKTNGSKNFIVIDGSMAELIRPSLYDAYQHIELVSPAPSNAETETFDVVGPVCESADFLGKGRELPTPAKGTGLVVHDAGAYCMSMASTYNLKMRPPEYWVEDDGSVSKIRHGETFEDHIRFFEGL

SEQ ID NO: 3425 - protein, 488 aa, Gossypium hirsutum
MAATTHHHLSHASSLPKTLNHPLKQNPFSQLPVLPLRASKNLFRRQSLSLKAVLSQNPAKTLNPTFQHCFTKSLDGFLYCEDTKVQDIMEKVEKRPFYLYSKPQITRNVEAYKEALEGLKNSIIGYAIKANNNLKILQHLRKLGCGAVLVSGNELKLALHAGFDPTKCIFNGNGKILEDLILAAQEGVFVNVDSEFDLENIVTAAKVAGRKVNVLLRINPDVDPQVHPYVATGNKNSKFGIRNEKLQWFLDAVKAHPNELKLVGAHCHLGSTITKVDIFRDAAVLMVNYIDEIRAQGFEVDYLNIGGGLGIDYYHSGAVLPTPRDLIDTVRELVLSRNLNLVIEPGRSLIANTCCLVNRVTGVKTNGTKNFIVIDGSMAELIRPSLYDAYQHIELVSPTPPDAEVSTFDVVGPVCESADFLGKERELPTPAKGTGLVVHDAGAYCMSMASTYNLKMRPPEYWVEEDGSVTRIRHGETFEDHIRFFEGL

SEQ ID NO: 3426 - protein, 488 aa, Gossypium hirsutum
MAATTHHHLSHASSLPKTLNHPLKQNPFSQLPVLPLRASKNLFRRQSLSLKAVLSQNPAKTLNPTFQHCFTKSPDGFLYCEDTKVQDIMEKVEKRPFYLYSKPQITRNVEAYKEALEGLKNSIIGYAIKANNNLKILQHLRKLGCGAVLVSGNELKLALHAGFDPTKCIFNGNGKILEDLILAAQEGVFVNVDSEFDLENIVTAAKVAGRKVNVLLRINPDVDPQVHPYVATGNKNSKFGIRNEKLQWFLDAVKAHPNELKLVGAHCHLGSTITKVDIFRDAAVLMVNYIDEIRAQGFEVDYLNIGGGLGIDYYHSGAVLPTPRDLIDTVRELVLSRNLNLVIEPGRSLIANTCCLVNRVTGVKTNGTKNFIVIDGSMAELIRPSLYDAYQHIELVSPTPPDAEVSTFDVVGPVCESADFLGKERELPTPAKGTGLVVHDAGAYCMSMASTYNLKMRPPEYWVEEDGSVTRIRHGETFEDHIRFFEGL

SEQ ID NO: 3427 - protein, 484 aa, Arabidopsis thaliana
MAAATQFLSQPSSLNPHQLKNQTSQRSRSIPVLSLKSTLKPLKRLSVKAAVVSQNSSKTVTKFDHCFKKSSDGFLYCEGTKVEDIMESVERRPFYLYSKPQITRNLEAYKEALEGVSSVIGYAIKANNNLKILEHLRSLGCGAVLVSGNELRLALRAGFDPTKCIFNGNGKSLEDLVLAAQEGVFVNVDSEFDLNNIVEASRISGKQVNVLLRINPDVDPQVHPYVATGNKNSKFGIRNEKLQWFLDQVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPPAEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 3428 - protein, 488 aa, Tropaeolum majus
MAATAHTLSPAPSLSRTLNRPSTRTLFSQVSILPRNLSKRKPLSIKAVISQTPAKTPAQPQEGTNSFNHCFSKSNDGFLYCEGVKVQEVMENVEKRPFYLYSKPQITRNVEAYKDALEGLSSVIGYAIKANNNLKILQHLRGLGCGAVLVSGNELRLAISAGFDPAKCIFNGNGKLLEDLVLAAQEGVFVNVDSEFDLDNIVAASKIAGKRVSVLLRINPDVDPQVHPYVATGNKNSKFGIRNEKLQWFLDAVKAHPNELKLVGAHCHLGSTITKVDIFRDAAALMVNYIDEIRAQGFVVNYLNIGGGLGIDYHHAGAVLPTPRDLIDTVRETVLSRDLNLIIEPGRSLIANTCCFVNRVTGVKTNGTKNFIVIDGSMAELIRPSLYDAYQHIELVSPVTPGAEITKFDVVGPVCESADFLGKERELPTPDQGTGLVVHDAGAYCMSMASTYNLKMRPPEYWVEEDGGLAKIRHGETFEDHLRFFEGL

SEQ ID NO: 3429 - protein, 488 aa, Glycine max
MAGSHLLSHSPSLPKTYNYSLNQNPLSQNLFFPPLKFKSTTKPRVLRAVLSQNAAKTAVEDTKNAHFQHCFTKSEDGYLYCEGLKVHDIMESVERRPFYLYSKPQITRNVEAYKDALEGLSSIIGYAIKANNNLKILEHLRHLGCGAVLVSGNELRLALRAGFDPTRCIFNGNGKILEDLVLAAQEGVFVNIDSEFDLENITEAAKRAGKKVNVLLRINPDVDPQVHPYVATGNKNSKFGIRNEKLQWFLDAVKELPNELKLVGAHCHLGSTITKVDIFRDAATIMINYIDQIRDQGFEVDYLNIGGGLGIDYYHSGAILPTPRDLIDTVRDLVISRGLNLIIEPGRSLIANTCCLVNRVTGVKSNGSKNFIVIDGSMAELIRPSLYDAYQHIELVSPAPSNAETTTFDVVGPVCESADFLGKGRELPTPAKGTGLVVHDAGAYCMSMASTYNLKMRPPEYWVEDDGSVSKIRHGETFEDHIRFFEGL

SEQ ID NO: 3430 - protein, 488 aa, Ricinus communis
MAATTTHLAHPPTLSKNITFHHLKQNPFLKTSTLPVKFTRTSPKPLSLTLKAVLSQNPTLTQETAQFKHCFTKSNDGFLYCENLKVQDVMESVEKRPFYLYSKPQITRNVEAYKSALEGLNSIIGYAIKANNNFKILEHLRQLGCGAVLVSGNELRLALRAGYDPKKCIFNGNGKLLEDLVLAAEEGVFVNVDSEFDLENIVAASRIAGEKINVLLRINPDVDPQVHPYVATGNKNSKFGIRNEKLQWFLDAVKAHPNELKLVGAHCHLGSTITKVDIFRDAAVLMVNYIDEIRAQGFEIDYLNIGGGLGIDYYHAGAVLPTPRDLIDTVRELVLSRNLNLIIEPGRSLIANTCCLVNRVTGVKTNGTKNFIVIDGSMAELIRPSLYDAYQHIELVSPAQPIVEVSTFDVVGPVCESADFLGKGRELPTPSKGAGLVVHDAGAYCMSMASTYNLKMRPPEYWIEEDGSVTKIRHGETFEDHMRFFEGL

SEQ ID NO: 3431 - protein, 492 aa, Eucalyptus grandis
MAAAATSHLLSSPACRRHRRTLTNHRLSQNPVARIPVAPLKAAAAGPLKRLLLRAAVSQNPAVDQQATAFKHCFSKSRDGFLYCEDVKVEDVMESVERRPFYLYSKRQITRNVEAYREALEGLEGAVIGYAIKANNNLKILEHLRGLGCGAVLVSGNELRLALRAGFDPTRCIFNGNGKLLEDLVLAAQAGVFVNVDSEFDLENIVAAARIAGKKVNVLLRINPDVDPQVHPYVATGNKNSKFGIRNEKLQWFLDAVKSHPNELKLVGAHCHLGSTITKVDIFRDAAVLMVNYIDLIREQGFEVNYLNIGGGLGIDYYHTGAVLPMPRDLIDTVRELVLSRNLKLIIEPGRSLIANTCCLVNRVTGVKTNGTKNFIVIDGSMAELIRPSLYDAYQHIELISPTPPDADTSTFDVVGPVCESADFLGKDRELPTPAKGAGLVVHDAGAYCMSMASTYNLKMRPPEYWVEEDGSIRKIRHAETFEDHLRFFEGL

SEQ ID NO: 3432 - protein, 488 aa, Prunus persica
MAATQLPFQTSSSSFSKPLRHSLTRNPFSQNPILPLRPASLKPLVLRAVVSQNPSKSLTQDPQTTPFKHCFSKSSDGFLYCEGLKVQEVIDSVERRPFYLYSKPQITRNVEAYKEALEGLSSVIGYAIKANNNYKILEHLRQLGCGAVLVSGNELRLALRAGFDPTKCIFNGNGKLLEDLVLAAQEGVFINVDSEFDLENIVAAARIAGKRVNVLLRINPDVDPQVHPYVATGNKNSKFGIRNEKLQWFLDAVKAHPNELKLVGAHCHLGSTITKVDIFRDAAVLMVKYIDEIRSQGFQVDYLNIGGGLGIDYYHAGAVLPTPRDLIDTVRDVVQSQGLNLIIEPGRSLIANSCCLVNRVTGVKTNGTKNFIVIDGSMAELIRPSLYDAYQHIELVSPASPDAEISTFDVVGPVCESADFLGKDRELPTPPKGAGLVVHDAGAYCMSMASTYNLKMRPPEYWVEEDGSVAKIRHAETFEDHMRFFDGL

SEQ ID NO: 3433 - protein, 487 aa, Populus trichocarpa
MATATDLSQSRFISKTLTHSLNQNLFSKKSILPFKLTKKNYLKPLSLKAVISQQNPATTTAQETTQFKHCFTKSKDGFLCCENLKVQEIMENVEKRPFYLYSKPQITRNVEAYKDALQGLNSIIGYAIKANNNLKILEHLRGLGCGAVLVSGNELRLALRAGFDPTRCIFNGNGKLLDDLVLAAQEGVFVNVDSEFDLENIVAAARIAGKKVNVLLRINPDVDPQVHPYVATGNKNSKFGIRNEKLQWFLDAVKAHRDELKLVGAHCHLGSTITKVDIFRDAAVLMVNYIDEIRAQGFEVDYLNIGGGLGIDYYHSGAVLPTPRDLIDTVRELVLSRDLNLIIEPGRSLIANTCCLVNRVTGVKTNGTKNFVVIDGSMAELIRPSLYDAYQHIELVSPASPKAEVSTFDVVGPVCESADFLGKDRELPTPAKGAGLVVHDAGAYCMSMASTYNLKMRPPEYWVEDGTVSKIRHGETFEDHIRFFEGL

SEQ ID NO: 3434 - protein, 487 aa, Manihot esculenta
MAATTTHLSHPPSLSKTRTFPLSQNPFLKTPLLTVKSTKSSLKSLSLKAVLSQNPASTLPQESAPFKHCFTKSPDGFLYCENLKVQDIMENVEKRPFYLYSKPQITRNFEAYRDALEGLRSIIGYAIKANNNLKILEHLRQLGCGAVLVSGNELRLALHAGFDPTRCILNGNGKLLEELVLAAQEGVFINVDSEFDLENIVAAARIAGKKVNVLLRINPDVDPQVHPYVATGNKNSKFGIRNEKLQWFLDAVKAHPNELKLVGAHCHLGSTITKVDIFRDAAVLMVNYIDQIRAQGFEVDYLNIGGGLGIDYYHTGAVLPSPRDLIDTVRELVLSRNLNLIIEPGRSVIANTCCLVNKVTGVKTNGTKNFIVIDGSMAELIRPSLYDAYQHIELVSPQPANAEVSTFDVVGPVCESADFLGKNRELPTPAKGAGLVVHDAGAYCMSMASTYNLKMRPPEYWVEEDGSVAKIRHGETFEDHIRFFKGL

SEQ ID NO: 3435 - protein, 488 aa, Brassica napus
HLLSQPSSSLRRNLNQYQSNQSPLSRIPVLSLKSTLKPLQRLSVKAAASPPNSVKTVTKDSSDQSAFNHCFKKSSDGFLYCEGTKVEDIMESVERRPFYLYSKPQITRNVEAYKEALEGVSSVIGYAIKANNNLKILEHLRGLGCGAVLVSGNELRLALRAGFDPTKCIFNGNGKLLEDLVIAAQAGVFVNVDSEFDLDNIVEASRISGKQVNVLLRINPDVDPQVHPYVATGNKNSKFGIRNEKLQWFLDEVKAHPNELKLVGAHCHLGSTITKVDIFRDAAVLMVEYIDDIRRQGFEVSYLNIGGGLGIDYYHAGAILPTPMDLINTVRELVLSRGLNLIIEPGRSLIANTCCFVNHVTGVKTNGTKNFIVIDGSMAELIRPSLYDAYQHIELVSPPAPEAEVSKFDVVGPVCESADFLGKDRELPTPPKGAGLVVHDAGAYCMSMASTYNLKMRPPEYWVEDDGSITKIRHAETFEDHLRFFDGL

SEQ ID NO: 3436 - protein, 481 aa, Helianthus annuus
  misc_feature (14)..(14): Xaa can be any naturally occurring amino acid
  misc_feature (43)..(43): Xaa can be any naturally occurring amino acid
  misc_feature (417)..(417): Xaa can be any naturally occurring amino acid
MAAASSPSSAHPQXISFTKTLNNKSPFTSKSLISFKPTFKPFXIKAITSEKPTQTHKFDHCFTKQDDGYLYCEGLKVQEVMEAVEKRPFYLYSKPQITRNVEAYKDALEGLNSIIGYAIKANNNFVILKHLRELGCGAVLVSGNELRLALAAGFDPTRCVFNGNGKLLEDLVLAAQEGVFVNIDSEFDLDNIVSAARIAGKKVNVLLRINPDVDPQVHPYVATGNKNSKFGIRNEKLQWFLDAVKSYPDELKLVGAHCHLGSTITKVDIFRDAAAIMVKFIDEIRAQGFDISYLNIGGGLGIDYYHTGTVLPTPRDLIDTVRELVKSRNLNLIIEPGRSLIANTCCFVNRVTGVKTNGTKNFIVIDGSMAELIRPSLYDAYQHIELVSPPPSDSAVSTFDVVGPVCESADFLGKNRXLPAPARGSGLVVHDAGAYCMSMASTYNLKMRPPEYWVEEDGSVAKIRHGETFDDHMRFFEGLSV

SEQ ID NO: 3437 - protein, 465 aa, Saccharum officinarum
MGGCFSQEEHRLQSRPAEAAGPDGLRKSKSDSKAIASVLAPPKDVVDLQVEGYGNVNIFTYDEMRAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVDWARPLLVHNRKLFRIIDPRMEGQYSTKAAIEVASLAYRCLSQNPKGRPTMSQVVETFEAVQNMPECQDILLQNSITGAVTLYEVPKEPADRVELEKAKQEPAVKTAAMPPVNGKPVPQSRRTRPGNGRSKSEPSLECKMYIPSPDSDGQQLGLEALASPNGSIKDPPDEDLYKI

SEQ ID NO: 3438 - protein, 465 aa, Zea mays
MGGCLSQEEHRLQSRPAEAAGADGLRKSKSDSKAVASVLAPPKDVVDLQVEGYGNVNIFTYDELRAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVDWARPLLVHNRKLFRIIDPRMEGQYSTKAATEVASLAYRCLSQNPKGRPTMSQVVETFEAVQNMPECQDILLQNSITGAVTLYEVPKEPADRVELEKAKQEPAVKSAAMPPMNGKPVPQSRRTRPGNGRSKSEPSLECKMYIPSPDSDGHQLGLEAVASPDGSIRDPPDEDLYKI

SEQ ID NO: 3439 - protein, 467 aa, Setaria italica
MGACFSQEEHRLQSRPAEAAGPDGLRKSKSDSKAIASVLAPPKDVVDLQVEGYGNVNIFTYNELRAATKNFRPDQILGEGGFGVVYKGVIDENVRVGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPTREHNLVDWARPLLVHNRKLFRIIDPRMEGQYSTKAAIEVASLAYRCLSQNPKGRPTMSQVVETFEAVQNMPECQDILLQNSITGAVTLYEVPKEPAESVEKEKAKQEPAVKTAAVPPVNGKPVPQSRRTRPGNGRSKSEPSLECKMYIPSPDSDGQQLGLETLASPSRNGSMQDPPDEDLYKI

SEQ ID NO: 3440 - protein, 465 aa, Zea mays
MGGCFSQEEHRLQSRPAEAAGPDGLQKSKSDSKATASVLAPPKAVVDLQVEGYGNVNIFTYDELSAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHRAERSIIYRDFKTSNILLDADYNAKLSDFGLARTGPSGDQTHVSTRVMGTYGYAAPEYVMTGHLTARSDVYGFGVVLLEMIIGRRAVDDSRPSREHNLVDWARPLLVHNRKLFRIIDPRMEGQYSTKAATEVASLAYRCLSQNPKGRPTMSQVVETFEAVQNMPECQDILLQNGITGAVTLYEVPKEPADRVELEKAKQEPAVKTAAIPPVNGKPAPQSRRTRPGNGRSKSEPSLECKMYIPSPDSDEQQLGLEALASPNGSMKDHPDEDLYKI

SEQ ID NO: 3441 - protein, 469 aa, Oryza sativa
MGGCFSLEEHRLQGKTEAGGPDGLRKCKSDSKATASVLAPPKDVEDLQIEGYGNVNIFTYNELRAATKNFRPDQILGEGGFGVVYKGVIDENVRAGFPSTQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVAGLAYRCLSQNPKGRPTMSQVVETFEAVQNMPECQDILLQNCMTGAVTLYEVAKDPTESVEPEKIKQEQPAAKTVTVAPAPVNGKPVPQSRRTRPGNGRSKSEPSLECKLYIPSPDSDGQQPGLEALSSPSRDGSIKDPPDEDLYKI

SEQ ID NO: 3442 - protein, 473 aa, Brachypodium distachyon
MGGCFSLEEQRLQSRTGTSAEAGGPDGLRKCKSDSKAISSVLAPPKDVEDLQTEGYGNVNIFTYNELRAATKNFRPDQILGEGGFGVVYKGVIDENVRVGFPSTQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVASLAYRCLSQNPKGRPTMSQVVETFEAVHSMPECQDILLQNCMTGAVTLYEVPKEPVEHVEAEKVKQEPTAKTEAVAVVPANGKPVPQSRRTRPANGRSKSEPSLECKMYIPSPDSDGLQPGLEALASPSRTGSMRDPPPDEDLYKI

SEQ ID NO: 3443 - protein, 477 aa, Triticum aestivum
MGGCFSLEEQRLQSRTGTSAEAGGPDGLRKCKSDSKAISSVLAPPKDVEDLQTEGYGNVNIFTYNELRAATKNFRPDQILGEGGFGVVYKGVIDENVRIGFPSRQVAVKELNPEGFQGDKEWLAEVNYLGQLSHANLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVASLCYRCLSQNPKGRPTMSQVVETFEEVQSMPECQDILLQNCMTGSVTLYEVPKEPVEHVETEKAKQEPTAKTDAVAVAVPPTNGKPVPQSRRTRPANGRSKSEPPLECKLYIPSPDSDGHQLGLEALASPPSRNSSRDDPPPVDEDLYKI

SEQ ID NO: 3444 - protein, 477 aa, Triticum aestivum
  misc_feature (70)..(71): Xaa can be any naturally occurring amino acid
MGGCFSLEEQRLQSRTGTSAEAGGPDGLRKCKSDSKAISSVLAPPKDVEDLQTEGYGNVNIFTYNELRAXXKNFRPDQILGEGGFGVVYKGVIDENVRIGFPSRQVAVKELNPEGFQGDKEWLAEVNYLGQLSHANLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVASLCYRCLSQNPKGRPTMSQVVETFEEVQSMPECQDILLQNCMTGSVTLYEVPKEPVEHVETEKAKQEPTAKTDAVAVAVPPANGKPVPQSRRTRPANGRSKSEPPLECKLYIPSPDSDGHQLGLEALASPPSRNSSRDDPPPVDEDLYKI

SEQ ID NO: 3445 - protein, 466 aa, Hordeum vulgare
SSTRTGTSAEAGGPDGLRKCKSDSKAISSVLAPPKDVEDLQTEGYGNVNIFTYNELRAATKNFRPDQILGEGGFGVVYKGVIDENVRIGFKSTQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPSREHNLVEWARPLLVHNRKLFRIIDPRMEGQYSTKAAIEVASLCYRCLSQNPKGRPTMSQVVETFEEVQSMPECQDILLQNCMTGSVTLYEVPKEPVEHVETEKAKQEPTAKTDAVSVAVPPTNGKPVPQSRRTRPANGRSKSEPPLECKLYIPSPDSDGHQLGLETLASPPSRNSSRDDPPPVDEDLYKI

SEQ ID NO: 3446 - protein, 418 aa, Pennisetum glaucum
VEGYENVNIFTYNERRAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDADYNAKLSDFGLARTGPSGDQTHVSTRVMGTYGYAAPEYVMTGHLTARSDVYGFGVVLLEMIIGRRAVDKSRPTREHNLVDWARPLLVHNRKLFRIIDPRMEGQYSTKAAIEVASLAYRCLSQNPKGRPTMSQVVETFEAVQNMPECQDILLQDSITGAVTLYEVPKEPAESVEKDKPKEEPAVKTAAVPPVNGKPVPQSRRTRPGNGRSKSEPKLECKMYIPSPDSDGQQLGLDALASPSRNGSMQDPPDEDLYKI

SEQ ID NO: 3447 - protein, 132 aa, Triticum aestivum
MSFARADLSAAGGVNPPHHHPRATETALVLAGRVYAGFVDTGGRLFAKVLVEGEVMVFPRGMVHFQLNVGDQPATVYGTFNSENPGIVRIPATVFGSGIRDAVLERAFGLSPEELRRIEKRFGVPKKAELED

SEQ ID NO: 3448 - protein, 229 aa, Triticum aestivum
MATHHRALLLLLAVLLPAAAIGADPDAVQDFCVPDPGRGRPVELNLIRSYPCRSPANLTAGDFAFSGVRAAGNFSADTGFAGVSVTPAQFPGLHTLGMSFARADLSAAGGVNPPHHHPRATETALVLAGRVYAGFVDTGGRLFAKVLVEGEVMVFPRGMVHFQLNVGDQPATVYGTFNSENPGIVRIPATVFGSGIRDAVLERAFGLSPEELRRIEKRFGVPKKAELED

SEQ ID NO: 3449 - protein, 229 aa, Oryza sativa
MAHRRRCLLLLLAVLLPAMAARGDPDAVQDFCVPDAGRGRPVELAMLPAYPCRSPANLTAGDFAFSGVRAAGNFSPETGFAGVSVTPAQFPGLHTLGMSFARADLSAAGGVNPPHYHPRATETALVLAGRVYAGFVDSGGRLFAKVLEQGEVMVFPRAMVHFQLNVGDTPATVYGAFNSENPGIVRIPATVFGSGIREAVLERAFGLTPAELRRLEKRFGPPKKAEMED

SEQ ID NO: 3450 - protein, 230 aa, Setaria italica
MAAHHLLLLLLAVLLPAAATADPDAVQDYCVPDAGGRGRPLELSLLRTYPCRSPVNLTASDFAFAGVRAAGNFSADTGFAGVSVTPAQFPALHTLGVSFARADLSAAGGVNPPHYHPRATETALVLAGRVYAGFVDSGGRIFAKVLEKGEVMVFPMGMVHFQMNVGDEPATVYGTFNSENPGIVRIPATVFGSGIKGGVLERAFGLSPAELRRLEKRFGPPKTKLSEMED

SEQ ID NO: 3451 - protein, 230 aa, Pennisetum glaucum
MAAHHLLLLLLAVLLPAAATADPDAVQDYCVPDAGGSGRPLELSLLRTYPCRSPANLTASDFAFAGVRAAGNFSADTGFAGVSVTPAQFPALHTLGVSFARADLSAAGGVNPPHYHPRATETALVLAGRVYAGFVDSGGRIFAKVLEKGEVMVFPKGMVHFQMNVGDEPATVYGTFNSENPGIVRIPATVFGSGIKGGVLERAFGLSPAELRRLEKRFGPPKTKLSEMED

SEQ ID NO: 3452 - protein, 229 aa, Brachypodium distachyon
MLRHHHVLLLLLAVLLLPAAATADPDALQDFCVPDPGRGRPVELALLRTYPCKNPSNLTAGDFTFSGARAAGNFSADLGFAGVSVTPAQFPGLNTLGMSFARADLSAAGGVNPPHYHPRATETALVLAGRVYAGFVDTGGRLFARVLAKGDVMVFPRGMVHFQLNVGDAPATVYGSFNSENPGIVRIPATVFGSGIRAAVLERAFGLTAAELRRIEEKFGPPKKAEMEE

SEQ ID NO: 3453 - protein, 234 aa, Zea mays
MATRHLLLLLLAALLPAAATADPDAVQDYCVPDTGGGRGRGRAVDLALLPSYPCRSPANLTAADFAFAGVRAAGNFSADTGFAGVSVTPAQFPALHTLGVSFARADLSAAGGVNPPHYHPRATETALVLAGRVYAGFVDSGGRVFAKVLEKGEVMVFPRAMVHFQMNVGDEPATVYGTFNSENPGIVRIPATVFGSGIKDAVLERAFGLEPEELRRLQKRFGPPPKTKTAEMDD

SEQ ID NO: 3454 - protein, 107 aa, Eragrostis curvula
MSGVVTKFAVTSMVMWIVPVAIVYGFYYEMIPGVSQLSSSTQTLVSGFLAVISVNLVIGFYICMAMKETPHQEPQPDPTFLANAKASINQPTSSQPSDDSKGKGKVE

SEQ ID NO: 3455 - protein, 107 aa, Panicum virgatum
MSGVITKFAVTSMVMWMAPVAIMYGFYYQVFPGVSQMSSSAQTLASGFLAVISVNLVIGFYICMAMKETPHQEPQPDPTFLADAKASINQPTSSQVNDDSKGKGKVE

SEQ ID NO: 3456 - protein, 106 aa, Setaria italica
MGRITKFAVASMVMWMAPVAIVYGFYYQVFPGVSQMSSSAQTLASGFLAVISVNLVIGFYICMAMKETPHQEPQPDPTFLANAKASINQPTSSQVSDDSKGKGKVE

SEQ ID NO: 3457 - protein, 107 aa, Sorghum bicolor
MSGVITKFAVTSMVMWMAPVAIMYGFYYQVFPGVSQMSSSAQTLASGFLAVISVNLVIGFYIFMAMKETPHQEPQPDPTFLANAKASINQPTSSQVSDDSKGKGKVE

SEQ ID NO: 3458 - protein, 107 aa, Panicum virgatum
MSGVITKFAVTSMVMWMAPVAIMYGFYYQVFPGVSQMSSSAQTLASGFLAVISVNLVIGFYICMAMKETPHQEPQPDPTFLANAKASVNQPTSSRVNDDSKGKGKVE

SEQ ID NO: 3459 - protein, 107 aa, Pennisetum glaucum
MSGVITKFAVASMVMWMAPVAIVYGFYYQVFPGVSQMSSSAQTLASGFLAVISVNLVIGLYIWMAMKETPHQEPQPDPTFLADAKASINQPTSSQVSDDSKGKGKVE

SEQ ID NO: 3460 - protein, 107 aa, Cynodon dactylon
MSAVVTKFAITSMAMWIVPVAIVYGFYYEMIPGVSQLSSSTQTLISGFLAVISVNLVIGLYICMAMKETPHQEPQPDPTFLANAKASINEPTSSQPSDDSKGKGKVE

SEQ ID NO: 3461 - protein, 71 aa, Pennisetum glaucum
MSSSAQTLASGFLAVISVNLVIGLYIWMAMKETPHQEPQPDPTFLADAKASINQPTSSQVSDDSKGKGKVE

SEQ ID NO: 3462 - protein, 124 aa, Saccharum officinarum
MSGVITKFAITSMVMWMAPVAIMYGFYYELFPGVSQMSSSAQTLASGFLAVISVNLVIGFYIFMAMKETPHQEPQPDPTFLANAKASINQPTSSQVSDDSRGRERSIKLVAWWAWSCVCKVHAI

SEQ ID NO: 3463 - protein, 107 aa, Cynodon dactylon
MSAVVTKFAVTSMAMWIVPVAIVYGFYYEMIPGVSQLPSSTQTLISGFLAVISVNLVIGFYICMAMKETPHQEPQPDPTFLANAKASINEPTSSQPSDDSKGKGKVE

SEQ ID NO: 3464 - protein, 107 aa, Brachypodium distachyon
MSAVITKFAVTSMVMWMAPVAIVYGFYYQIFPGVSKLSPSAQTMASGFLAVISVNLVIGFYIYMAMKETPHQEPQPDPAFLANAKASINQPTSSQVSDDSHGKGKVE

SEQ ID NO: 3465 - protein, 107 aa, Avena sativa
MSTVITKFAVTSMVMWMVPVAVIYGFNHQIFPGVSQLSPSTQTLASGFLAVISVNLVIGFYIYMAMKETPHQEPQPDPTFLANAKASINQPTSSQVSDDSHGKGKVE

SEQ ID NO: 3466 - protein, 107 aa, Zea mays
MSGVITKFAVTSMVMWMAPVAIMYGFYYQVFPGVSQMSSSAQTLASGFLAVISVNLVIGFYIFMAMKETPHQEPQPDPTFLEKAKASINQPTSSRVSDDSKGKGKVE

SEQ ID NO: 3467 - protein, 107 aa, Zea mays
MPGVITKFAVTSMVMWMAPVAIVYGFYYQAFPGVSRMSSSTQTLASGFLAVISVNLVIGLYIFMAMKETRHQEPQPDPTFLANAKASINQPTSSQPSDDSKGKGKVE

SEQ ID NO: 3468 - protein, 107 aa, Unknown
  Sequence found in Organisms: Zea mays, Triticum aestivum
MSAVITKFAVTSMVMWMAPVAIMYGFIYQIFPGVGQLSPSAQTMASGFLAVISVNLVIGFYIYMAMKETPHQEPQPDPTFLANAKASINQPTSSQVSDDSHGKGKVE

SEQ ID NO: 3469 - protein, 107 aa, Zea mays
MPGVITKFAVTSMVMWMAPVAIVYGFYYQAFPGVSRMSSSAQTLASGFLAVISVNLVIGLYIFMAMKETRHQEPQPDPTFLANAKASINQPTSSQPSDDSKGKGKVE

SEQ ID NO: 3470 - protein, 107 aa, Hordeum vulgare
MSAVITKFAVTSMVMWMAPVAIMYGFIYQIFPGVGQLSPSAQTMASGFLAVISVNLVIGFYIYMAMKEAPHQEPQPDPTFLANAKASINQPTSSQVSDDSHGKGKVE

SEQ ID NO: 3471 - protein, 107 aa, Lolium multiflorum
MSTVITKFAVTSMLMWMVPVAIVYGFNHQIFPGVGQLSPSAQTLASGFLAVISVNLVIGFYIYMAMKETPHQEPQPDPTFLANAKASINQPTSSQVSDDSHGKGKVE

SEQ ID NO: 3472 - protein, 272 aa, Hordeum vulgare
MAMARTTALLLVAAALLAASSSAWEVNIQMPASAAVDDAVAPLIHALRPLLGSGKQAGVACDSWRLGVEAYNVRDWKTVPANCEGYVGHYMLGNHFRRDCKVVIDQAIAYVDGLKLAGNGKDVWVFDIDETTLSNLPYYATHGFGARPYNATSFDAYVMEGSAPVLPETKRLYYKLLKVGIKPVFITGRTEDKRAVTVGNLRSQGFSGWMSLTLKQHGFKGSAISYKSAERKKLEDAGYVIVGNIGDQWSDILGAPEGARTFKLPDPMYYIA

SEQ ID NO: 3473 - protein, 272 aa, Triticum aestivum
MAMARTPTLLLIVAAALLAASCSAWEANIRMPTSVDEAVVAPLIHALRPLLGSGKHAGVECDSWVLGVEAHNVRDWKTVPASCEGYVGHYMLGKHFRRDSKIVIDQAVAYVDSLKLAGNGKEVWVFDIDETTLSNLPYYAKHGFGATPFNATSFNAYVLEGSAPALPETKRLYNKLRSVGIKPVFLTGRTEDQRAITVTNLRRQGISGWMNLLLKQPGFKGSAVTYKSGERQKLQDAGYIIVGNIGDQWSDILGAPEGARTFKLPDPMYYIG

SEQ ID NO: 3474 - protein, 272 aa, Leymus cinereus x Leymus triticoides
MAMARTTTLLLLVAAALLAASCSAWEVDIQMPTSVDEAVVAPLIHALRPLLGSGKHAGVECDSWVLGVEAHNVRDWKTVPASCEGYVGHYMLGKHFRRDSKVVIEQALAYVDTLKLSGNGKEVWVFDIDETTLSNLPYYAKHGFGATPFNATSFNAYVLEGSAPALPETKRLYNKLLSVGVKPVFLTGRTEDQRAITVTNLRHQGISGWMNLLLKQPGFKGSAVTYKSGERQKLQDAGYIIVGNIGDQWSDILGAPEGARTFKLPDPMYYIG

SEQ ID NO: 3475 - protein, 270 aa, Triticum aestivum
MARTPTLLLIVAAALLAASCSAWEANIRMPTSVDEAVVAPLIHALRPLLGSGKHAGVECDSWVLGVEAHNVRDWKTVPASCEGYVGHYMLGKHFRRDSKIVIDQAVAYVDSLKLAGNGKEVWVFDIDETTLSNLPYYAKHGFGATPFNATSFNAYVLEGSAPALPETKRLYNKLRSVGIKPVFLTGRTEDQRAITITNLRRQGISGWMNLLLKQPGFKGSAVTYKSGERQKLQDAGYIIVGNIGDQWSDILGAPEGARTFKLPDPMYYIG

SEQ ID NO: 3476 - protein, 476 aa, Zea mays
MAKKPVEEALLAAADEQESLSVREELKKQLWLAGPMIAGALLQNVIQMISVMYVGHLGELPLAGASMANSFATVTGLSLLLGMASALDTLCGQAFGARQYYLLGIYKQRAMFLLTLVSVPLSVVWFYTGEILLLFGQDPDIAAEAGTYARWMIPLLFAYGLLQCHVRFLQTQNIVVPVMASAGAAAACHVVVCWALVYALGMGSKGAALSNSISYWVNVAVLAVYVRVSSACKETWTGFSTEAFRDALGFFRLAVPSALMVCLEMWSFELIVLLSGLLPNPKLETSVLSISLNTAAFVWMIPFGLSSAISTRVSNELGAGRPRAARLAVRVVVLLSVAEGLGVGLILVCVRYVWGHAYSNVEEVVTYVANMMLVIAVSNFFDGIQCVLSGVARGCGWQKIGACINLGAYYIVGIPSAYLIAFVLRVGGTGLWLGIICGLIVQLLLLAIITLCTNWDSEATKAKNRVFNSSSPASGT

SEQ ID NO: 3477 - protein, 479 aa, Brachypodium distachyon
MGNESVEEALLHTDGSGGRLGLGVGEEVKKQLWLAGPLIAGALLQNLIQMISVMYVGHLGELALAGASMASSFASVTGFSLLLGMASALDTLCGQAFGARQYHLLGIYKQRAMVILTLVSIPLAVVWFYTGEILLLFGQDPDIAAEAGTFARWMLPMLFAYGLLQCHVRFLQTQNIVLPVMASAGATAAFHLLLCWLLVYAAGMGSKGAALSNAISYWINVVILAVYVRVSGSCSKTWTGFSTEAFHDVLSFFRLAVPSALMVCLEMWSFELIVLLSGLLPNPKLETSVLSISLNTAAFVWMIPFGLGSAISTRVSNELGAGRPNAARLAVRIVVFLAIAEGLIMGLVLVCVRYVWGHAYSNVEEVVTYVAKMLLIISVSNFFDGIQCVLSGVARGCGWQKIGAWINLGAYYIAGVPSAYLIAFVLHVGGMGLWFGIICGLMVQVLLLMAITICTDWDKEAAKAKNRVFSSSLPIDFAT

SEQ ID NO: 3478 - protein, 490 aa, Sorghum bicolor
MAKRPVEEALLAAAGEPEEEEILSVREELKKQLWLAGPMIGGALLQNVIQMISVMYVGHLGELPLAGASMANSFATVTGLSLLLGMASALDTLCGQAFGARQYYLLGIYKQRAMFLLTLVSLPLAVVWFYTGEILLLFGQDADIAAEAGTYARWMIPLLFAYGLLQCHVRFLQTQNIVVPVMASAGATAACHLVVCWVLVYPLGMGSKGAALSNAVSYWVNVAILAVYVRVSSACKETWTGFSTEAFHDALSFFRLAIPSALMVCLEMWSFELIVLLSGLLPNPQLETSVLSISLNTATIVWMIPFGLGSAISTRVSNELGAGRPQAARLAVRVVVLLAVSEGLAVGLILVCVRYIWGHAYSNVEEVVTYVAKMMLVIAVSNFFDGIQCVLSGVARGCGWQKIGACINLGAYYIVGIPSAYLFAFVMRVGGTGLWLGIICGLMVQVLLLMIITVCTNWDNETSGAAGVLGVSQAKAQLILLSRRGECALL

SEQ ID NO: 3479 - protein, 479 aa, Oryza sativa
MEKASCLEEALLLPESCKEEEITASDEVKRQLRLAGPLIAGSLLQNLIQMISVMFVGHLGELPLAGASMASSFAAVTGFSLLLGLASALDTLCGQAFGARQYHLLGVYKQRAMLLLTAVSVPLAVAWYYTGDILLLFGQDADIAAEAGAYARWMIPALFAYGPLQCHVRFLQTQNMVVPVMAAAGAAALCHLGVCWALVHAAGMGSRGAALGNAVSYWINVGVLAVYVRVSRSCKKTWTGFSMEAFRDPLSFFRLAIPSALMVCLEWWSFELLVLLSGLLPNPKLETSVLSITLNTANCLFMIPFGLGAAISTRVSNELGAGRPRAARLAVRVVTLLATLEGLGMALVLACVRYVWGHAYSNEEEVVAYVAKMMLVLAVSNFLDGIQCVLSGVARGCGWQKIGACINLGAFYVVGVPAAYLAAFVLRAGGLGLWMGIICGVAVQTLLFLAITSRTDWQKEAKMAKDRVFSSSLPTDLAT

SEQ ID NO: 3480 - protein, 340 aa, Arabidopsis lyrata
MAPTLQGEWIKMEQKGGKGPGPRCSHGIAMVGDKLYSFGGELIPNMHIDKDLYVFDFNTHTWSIAPANGDPPRISCLGVRMVAVGTKLYIFGGRDAKRAFNDFYSYDTVQKEWTFLTKLDEEGGPEARTFHSMTSDENHVYVFGGVSKGGLQTTPKRFRTIEAYNIADGGWVQLPDPGENFEKRGGAGFAVVQGKIWVVYGFATSIIPGGKNDYESNAIQYFDPASGKWTQVKTTGAKPSARSVFAHAVVGKYIIIFGGEVWPDLKGHLAPGTLSNEGYVLDTETLVWDKLAEGGEPAMPLGWTSYTTATVYGKKGLLMHGKLPTNERTGDLYFYAVNSA

SEQ ID NO: 3481 - protein, 308 aa, Glycine max
MRSIASCYNEHAIRVSDSYCSRPSTQAYLGPKLHPSTRDSVTCMYKLTLIETQKQLFITLTWSKKLLGQGFTITIANSEHSLSPSKSNARQLRKIKGNETLQSQNFKVQVLWDLSDAKYEEGPEPVGAFYVVVLVDSELGLRLGDKNSLIEELLSNLDAKEANFSLVSRSETFSGTAVYATKAKFSETGISHEILIKCGAEVVEGGEAKKGHVLSVCVDKKTIFQVKRLRWNFRGNQTIFVDGLVVDMMWDVHDWLFNSNSASSAVFMFRTRSGLDSRLWLEEKSLHAHKEQDKIGFSLLICACKNND

SEQ ID NO: 3482 - protein, 637 aa, Panicum virgatum
MLRRAAAALALALGLLAAAPAAAFYLPGVAPNDFQKKDQLLVKVNKLTSTKTQLPYSYYSLPFCKPDTIVDSAENLGEVLRGDRIENSPYVFEMREPKMCQIVCRASIDDKQAKELKEKIEDEYRVNMILDNLPLVVPIARQDRDAIVYQGGYHVGVKGQYAGSKDEKFFIHNHLTFLVKYHKDETTELSRIVGFEVKPFSINHQFEGQWNDKNTRLITCDPHASKLVTNSDTPQEVESGKEIIFTYDVGFEESDVKWASRWDTYLLMTDDQIHWFSIVNSLMIVLFLSGMVAMIMLRTLYRDISRYNQLETEEEAQEETGWKLVHGDVFRPPVNSDLLCVCVGTGVQFFGMLLVTMIFAVLGFLSPSNRGGLMTAMLLTWVLMGLFAGYASSRFYKMFKGSEWKSITLRTAFLFPGIAFGIFFILNALIWGEKSSGAVPFTTMFALVLLWFGISVPLVFVGSYLGFKQPAIEAPVKTNKIPRQVPEQAWYMNPAFTILIGGILPFGAVFIELFFILTSIWLHQFYYIFGFLFLVFIILIITCAEITIVLCYFQLCSEDYNWWWRSYLTSGSSAIYLFLYAGFYFFTKLQITKLVSGILYFGYMLLASFAFCVLTGTIGFCACFWFTRLIYSSVKID

SEQ ID NO: 3483 - protein, 634 aa, Setaria italica
MLRWATVALVALLAAAPAAAFYLPGVAPNDFQKKDPLLVKVNKLTSTKTQLPYSYYSLPFCKPNTIVDSAENLGEVLRGDRIENSPYVFEMREPKMCQIVCKASIDDKQAKELKEKIEDEYRVNMILDNLPLVVPIPRQDRDAVVYQGGYHVGVKGQYAGSKDEKVFIHNHLTFLVKYHKDETTELSRIVGFEVKPFSINHQFEGQWNDKNTRLITCDPHASKLVRSSDTPQEVEAGKEIIFTYDVGFEESDVKWASRWDTYLLMTDDQIHWFSIVNSLMIVLFLSGMVAMIMLRTLYRDISRYNQLETEEEAQEETGWKLVHGDVFRPPENSDLLCVCVGTGVQFFGMLLVTMIFAVLGFLSPSNRGGLMTAMLLTWVLMGLFAGYASSRFYKMFKGSEWKSITLKTAFLFPGIAFSIFFILNALIWGEKSSGAVPFTTMFALVLLWFGISVPLVFVGSYLGFKQPAIEAPVKTNKIPRQIPEQSWYMNPAFTVLIGGILPFGAVFIELFFILTSIWLHQFYYIFGFLFLVFIILIITCAEITIVLCYFQLCSEDYNWWWRSYLTSGSSAIYLFLYAGFYFFTKLQITKLVSGILYFGYMLLASFAFCVLTGAIGFCACFWFTRLIYSSVKID

SEQ ID NO: 3484 - protein, 636 aa, Sorghum bicolor
MLRWAAAALVLAALLAASPAAAFYLPGVAPNDFHKKDPLLVKVNKLTSTKTQLPYSYYSLPFCKPNTIVDSAENLGEVLRGDRIENSPYVFEMGEPKMCQIICRAKIDDKQAKELKEKIEDEYRVNMILDNLPLVVAIARQDRGAPVYQAGYHVGVKGQYAGNKDEKSFIHNHLTFLVKYHKDETADLSRIVGFEVKPFSINHQFEGPWNDKNTRLITCDPHASKLVVNSDTPQEVEAGKEIIFTYDVAFEESDVKWASRWDTYLLMTDDQIHWFSIVNSLMIVLFLSGMVAMIMLRTLYRDISRYNQLETEEEAQEETGWKLVHGDVFRPPANSDLLCVCVGTGVQFFGMLLVTMIFAVLGFLSPSNRGGLMTAMLLTWVLMGLFAGYASSRLYKMFKGSEWKSITLRTAFLFPGIAFGIFFILNALIWGEKSSGAVPFTTMFALVLLWFGISVPLVFVGSYLGFKQPAIEAPVKTNKIPRQVPEQAWYMNPAFTILIGGILPFGAVFIELFFILTSIWLHQFYYIFGFLFLVFIILIITCAEITIVLCYFQLCSEDYMWWWRSYLTSGSSAIYLFLYAGFYFFTKLQITKVVSGILYFGYMLLASCAFCVLTGAIGFCACFWFTRLIYSSVKID

SEQ ID NO: 3485 - protein, 634 aa, Zea mays
MLRWAAAALAALLAASPAAAFYLPGVAPNDFHKKDPLLVKVNKLTSTKTQLPYSYYSLPFCKPNTIVDSAENLGEVLRGDRIENSPYVFEMGEPKMCQIICKAKIDDKQAKELKEKIEDEYRVNMILDNLPLVVPIARQDRGATVYQAGYHVGVKGQYTGNNDEKSFIHNHLAFLVKYHKDETTDLSRIVGFEVKPFSINHQFEGPWNDKNTRLITCDPHASKLVVNSDTPQEVEAGKEIIFTYDVGFEESDIKWASRWDTYLLMIDDQIHWFSIVNSLMIVLFLSGMVAMIMLRTLYRDISRYNQLETEEEAQEETGWKLVHGDVFRPPANSDLLCVCVGTGVQFFGMLLVTMIFAVLGFLSPSNRGGLMTAMLLTWVLMGLFAGYASSRLYKMLKGSEWRSITLRTAFLFPGIAFGIFFILNALIWGEKSSGAVPFTTMFALVLLWFGISVPLVFVGSYLGFKQPAIEAPVKTNKIPRQVPEQAWYMNPAFTILIGGILPFGAVFIELFFILTSIWLHQFYYIFGFLFLVFIILIITCAEITIVLCYFQLCSEDYLWWWRSFLTSGSSAIYLFLYAGFYFFTKLQITKVVSGMLYFGYMLLASFAFCVLTGTIGFYACFCFTRLIYSSVKID

SEQ ID NO: 3486 - protein, 634 aa, Zea mays
MLRWAAAALAALLAASPAAAFYLPGVAPNDFHKKDPLLVKVNKLTSTKTQLPYSYYSLPFCKPNMIVDSAENLGEVLRGDRIENSPYVFEMGEPKMCQIICKAKIDDKQAKELKEKIEDEYRVNMILDNLPLVVPLARQDRGATVYQAGYHVGVKGQYAGNNDKKSFIHNHLAFLVKYHKDETTDLSRIVGFEVKPFSINHQFEGPWNDKNTRLITCDPHASKLLVNSDTPQEVEAGKEIIFTYDVGFEESDIKWASRWDTYLLMIDDQIHWFSIVNSLMIVLFLSGMVAMIMLRTLYRDISRYNQLETEEETQEETGWKLVHGDVFRPPANSDLLCVCVGTGVQFFGMLLVTMIFAVLGFLSPSNRGGLMTAMLLTWVLMGLFAGYASSRLYKMLKGSEWKSITLRTAFLFPGIAFGIFFVLNALIWGEKSSGAVPFTTMFALVLLWFGISVPLVFVGSYLGFKQPAIEAPVKTNKIPRQVPEQAWYMNPAFTILIGGILPFGAVFIELFFILTSIWLHQFYYIFGFLFLVFIILIVTCAEITIVLCYFQLCSEDYLWWWRSFLTSGSSAIYLFLYAGFYFFTKLQITKVVSGMLYFGYMLLASFAFCVLTGTIGFYACFCFTRLIYSSVKID

SEQ ID NO: 3487 - protein, 156 aa, Zea mays
MHRWAAAALAAFLVALPAAAFYLPGVAPNDFHKKDPLLVKVNKLTSTKTQLPYSYYSLPFCKPNMIVDSAENLGEVLRGDRIENSPYVFEMGEPKMCQIICKTKIDDKQTKELKEKIEDEYRVNMILDNLPLVVSIARQDRGATVYQAGCQGPICW

SEQ ID NO: 3488 - protein, 636 aa, Avena sativa
MLRWALAAAALAALLCAPPAAAFYLPGVAPTDFGKGDDLMVKVNKLTSIKTQLPYTYYSLPFCKPNTIVDSAENLGEVLRGDRIENSPYAFQMREPKMCQIVCKLTVTEKEAKELKEKIEDEYRVNMVLDNLPLVVPVTRQDKNTIAYQGGYHVGVKGQYAGSKEEKHFIHNHLSFLVKFHKDDESELSRIVGFEVKPYSIKHQFEGKWNEANTRLSTCDPHDNKIVTNSETPQEVEVGKDIIFTYDVRFEESDIKWASRWDTYLLMSDDQIHWFSIVNSLMIVLFLSGMVAMIMMRTLYRDISRYNQLETQEEAQEETGWKLVHGDVFRPPVNSDLLCVYVGTGVQFFGMLLVTMIFAVLGFLSPSNRGGLMTAMLLVWVLMGLLAGYSSSRLYKMFKGSEWKQITLRTAFLFPGIAFVIFFILNALIWGEKSSGAVPFTTMFALVLLWFGISVPLVFVGSYLGFKKPAMEPPVKTNKIPRQVPEQAWYMNPLFTILIGGILPFGAVFIELFFILTSIWLHQFYYIFGFLFLVFVILIITCAEITVVLCYFQLCSEDYNWWWRSYLTSGSSALYLFLYAGFYFFTKLQISKLVSGILYFGYMLLASFSFFVLTGTIGFCACFWFTRLIYSSVKID

SEQ ID NO: 3489 - protein, 635 aa, Oryza sativa
MLRWLAAAAALVALLAAAPAAGFYLPGVAPTDFGKGDSLPVKVNKLTSVKTQLPYAYYSLPFCKPETIVDSAENLGEVLRGDRIENSPYVFQMREPKMCQIVCKLTVGEKEAKELKEKIEDEYRVNMILDNLPLVVSVLRQDKNIAYQGGYHVGVKGQYTGSKEEKYFIHNHLSFLVKYHKDDDSELSRIVGFEVKPYSIKHQLDDKWDGVNTRLSTCDPHANKLVTSSDSPQEVEAGKEIIFTYDVHFEESDIKWASRWDTYLLMTDDQIHWFSIVNSLMIVLFLSGMVAMIMLRTLYRDISRYNQLETQEEAQEETGWKLVHGDVFRPPTNSDLLCVYVGTGVQFFGMLLVTMIFAVLGFLSPSNRGGLMTAMLLVWVLMGLLAGYASSRLYKMFKGSEWKRITMRTAFLFPGIAFVIFFILNALIWGEKSSGAVPFTTMFALVLLWFGISVPLVFVGSYLGFKKPALEPPVKTNKIPRQIPEQAWYMNPIFTILIGGILPFGAVFIELFFILTSIWLHQFYYIFGFLFLVFVILIITCAEITVVLCYFQLCSEDYMWWWRSYLTSGSSALYLFLYAAFYFFTKLQITKLVSGILYFGYMLLASLAFFVLTGTIGFCACFWFTRLIYSSVKID

SEQ ID NO: 3490 - protein, 636 aa, Triticum aestivum
LRWAAAGLALVALLAAAPPAAAFYLPGVAPTDFGKGDELLVKVNKLTSIKTQLPYTYYSLPFCKPNTIVDSAENLGEVLRGDRIENSPYVFQMREPKMCQIICKITVTEKEAKELKEKIEDEYRVNMVLDNLPLVVPVQRPDRNTVAYQGGYHVGVKGQYAGSKDEKHFIHNHLSFSVKFHKDDDSELSRIVGFEVKPFSIKHQFDGNWNDANTRLTTCDPHNSKFVVNSETPQEVEVGKDIIFTYDVRFEESEIKWASRWDTYLLMSDDQIHWFSIVNSLMIVLFLSGMVAMIMMRTLYRDISRYNQLETQEEAQEETGWKLVHGDVFRPPVNSDLLCVFVGTGVQFFGMLLVTMIFAVLGFLSPSNRGGLMTAMLLVWVLMGLIAGYSSSRLYKMFKGAEWKQITLRTAFLFPGIAFVIFFILNALIWGEKSSGAVPFTTMFALVLLWFGISVPLVFVGSYLGFKKPAMEPPVKTNKIPRQIPEQAWYMNPLFTILIGGILPFGAVFIELFFILTSIWLHQFYYIFGFLFLVFVILIITCAEITIVLCYFQLCSEDYNWWWRSYLTSGSSALYLFLYAGFYFWTKLQISKLVSGILYFGYMLLASFSFFVLTGTIGFCACFWFTRMIYSSVKID

SEQ ID NO: 3491 - protein, 637 aa, Triticum aestivum
MLRLAAAGIALVALLAAAPPAAAFYLPGVAPTDFAKGDELLVKVNKLTSIKTQLPYTYYSLPFCKPNTIVDSSENLGEVLRGDRIENSPYVFQMREPKMCQIICKITVTEKEAKELKEKIEDEYRVNMVLDNLPLVVPVQRPDRNTVAYQGGYHVGVKGQYAGSKDEKHFIHNHLSFSVKFHKDEDSELSRIVGFEVKPFSIKHQFDGNWNDANTRLTTCDPHNSKFVVNSETPQEVEVGKDIIFTYDVRFEESEIKWASRWDTYLLMSDDQIHWFSIVNSLMIVLFLSGMVAMIMMRTLYRDISRYNQLETQEEAQEETGWKLVHGDVFRPPVNSDLLCVFVGTGVQFFGMLLVTMIFAVLGFLSPSNRGGLMTAMLLVWVLMGLIAGYSSSRLYKMFKGAEWKQITLRTAFLFPGIAFVIFFILNALIWGEKSSGAVPFTTMFALVLLWFGISVPLVFVGSYLGFKKPAMEPPVKTNKIPRQIPEQAWYMNPLFTILIGGILPFGAVFIELFFILTSIWLHQFYYIFGFLFLVFVILIITCAEITIVLCYFQLCSEDYNWWWRSYLTSGSSALYLFLYAGFYFWTKLQISKLVSGILYFGYMLLASFSFFVLTGTIGFCACFWFTRMIYSSVKID

SEQ ID NO: 3492 - protein, 636 aa, Hordeum vulgare
MLRWAAAGLALLALLAPTPAAAFYLPGVAPTDFAKEDELLVKVNKLTSIKTQLPYTYYSLPFCKPNTIVDSAENLGEVLRGDRIENSPYVFQMREPKMCQIICKITVTEKEAKELKEKIEDEYRVNMVLDNLPLVVPVQRPDRNTVAYQGGYHVGVKGQYAGSKDEKHFIHNHLSFSVKFHKDEDSELSRIVGFEVKPYSIKHQYDGNWNDANTRLSTCDPHNSKFVINSETPQEVEVGKDIVFTYDVRFEESEIKWASRWDTYLLMSDDQIHWFSIVNSLMIVLFLSGMVAMIMMRTLYRDISRYNQLETQEEAQEETGWKLVHGDVFRPPVNSDLLCVFVGTGVQFFGMLLVTMIFAVLGFLSPSNRGGLMTAMLLVWVLMGLIAGYSSSRLYKMFKGAEWKQITLRTAFLFPGIAFVIFFILNALIWGEKSSGAVPFTTMFALVLLWFGISVPLVFVGSYLGFKKPAMEPPVKTNKIPRQIPEQAWYMNPLFTILIGGILPFGAVFIELFFILTSIWLHQFYYIFGFLFLVFVILIITCAEITIVLCYFQLCSEDYNWWWRSYLTSGSSALYLFLYAGFYFWTKLQISKLVSGILYFGYMLLASFSFFVLTGTIGFCACFWFTRMIYSSVKID

SEQ ID NO: 3493 - protein, 636 aa, Brachypodium distachyon
MLRWAAAAVALAVLLAAAPAAGFYLPGVAPTDFMKGDELLVKVNKLTSIKTQLPYTYYSLPFCKPNTIVDSAENLGEVLRGDRIENSPYVFQMREPKMCQIACKLAVTEKEAKELKEKIEDEYRVNMVLDNLPLVVPVTRQDKNTIAYQGGYHVGVKGQYTGSKDEKHFIHNHLSFLVKYHRDDDSELSRIVGFEVKSYSIKHQFDGKWNDANTRLSTCDPHDNKFVTTNESPQEVEVGKDIIFTYDVHFEESEIKWASRWDTYLLMSDDQIHWFSIVNSLMIVLFLSGMVAMIMMRTLYRDISRYNQLETQEEAQEETGWKLVHGDVFRPPTNSDLLCVYVGTGVQFFGMLLVTMIFAVLGFLSPSNRGGLMTAMLLVWVLMGLLAGYSSSRLYKMFKGSEWKQITLRTAFLFPGIAFVIFFILNALIWGEKSSGAVPFTTMFALVLLWFGISVPLVFVGSYLGFKKPAMEPPVKTNKIPRQIPEQAWYMNPLFTILIGGILPFGAVFIELFFILTSIWLHQFYYIFGFLFLVFVILIITCAEITIVLCYFQLCSEDYMWWWRSYLTSGSSALYLFLYAAFYFFTKLQISKLVSGILYFGYMLLASFSFFVLTGTIGFCACFWFTRMIYSSVKID

SEQ ID NO: 3494 - protein, 634 aa, Zea mays
MLRWAAALAVLLAVAAPAAGFYLPGVAPSDFAKGDPLPVKVNKLTSIKTQLPYTYYSLPFCKPDTIVDSAENLGEVLRGDRIENSPYVFKMGEPKMCQIVCRAPITEKEAKELKEKIEDEYRVNMILDNLPLVVPVTRQDKNSIAYQGGYHVGAKGLYSGTKDEKYFIHNHLSFTVKYHKDDNLEHSRIVGFEVNPHSVKHQVDDKWNGVDTRLSTCDPHASKFVINSDSPQEVEVGKEIIFTYDVRFEESEIKWASRWDTYLLMTDDQIHWFSIVNSLMIVLFLSGMVAMIMLRTLYRDISRYNQLETQEEAQEETGWKLVHGDVFRPPTYSDLLCVYVGTGVQFFGMLVVTMIFAVLGFLSPSNRGGLMTAMLLVWVLMGLLAGYSSSRLYKMFKGSEWKKITLQTAFLFPGVAFVIFFILNALIWGEKSSGAVPFTTMFALVLLWFGISVPLVFVGSYLGFKKPAMEPPVKTNKIPRQIPEQAWYMNPLFTILIGGVLPFGAVFIELFFILTSIWLHQFYYIFGFLFLVFVILIITCAEITIVLCYFQLCSEDYMWWWRSYLTSGSSALYLFLYAGFYFFTKLQITKLVSGILYFGYMLLASYAFFVLTGTIGFCACFWFTRLIYSSVKID

SEQ ID NO: 3495 - protein, 634 aa, Sorghum bicolor
MLRWAAALAVLLAVAAPAAGFYLPGVAPSDFAKGDLLPVKVNKLTSIKTQLPYTYYSLPFCKPDTIIDSAENLGEVLRGDRIENSPYVFKMGEPKMCQIVCKAKIGEKEAKELKEKIEDEYRVNMILDNLPLVVPVKRQDKNSIAYQGGYHVGLKGLYSGTKDEKYFIHNHLSFAVKYHRDENSGLSRIVGFEVNPHSVKHQVDDKWNGVDTRLSTCDPHASKFVTNSDNPQEVETDKEIIFTYDVHFEESEIKWASRWDTYLLMTDDQIHWFSIVNSLMIVLFLSGMVAMIMLRTLYRDISRYNQLETQEEAQEETGWKLVHGDVFRPPTYSDLLCVYVGTGVQFFGMLLVTMIFAVLGFLSPSNRGGLMTAMLLVWVLMGLLAGYSSSRLYKMFKGSEWKKITLQTAFLFPGVAFVIFFILNALIWGEKSSGAVPFTTMFALVLLWFGISVPLVFVGSYLGFKKPAMEAPVKTNKIPRQIPEQAWYMNPLFTILIGGVLPFGAVFIELFFILTSIWLHQFYYIFGFLFLVFVILIITCAEITIVLCYFQLCSEDYMWWWRSYLTSGSSALYLFLYAAFYFFTKLQITKLVSGILYFGYMLLASYAFFVLTGTIGFCACFWFTRLIYSSVKID

SEQ ID NO: 3496 - protein, 625 aa, Setaria italica
AWRAGAGPGAGFYLPGVAPSDFGKGDPLQVKVNKLTSIKTQLPYTYYSLPFCKPATIVDSAENLGEVLRGDRIENSPYVFQMREPKMCQIVCKATINEKEAKELKEKIEDEYRVNMILDNLPLVVPVIRQDRNGIAYQGGYHVGAKGQYAGSKDEKYFIHNHLSFTVKYHKDDDSELSRIVGFEVHPYSVKHQFDDKWNGVDTRLSTCDPHASKLVTSSESPQEVEADKEIIFTYDVKFEDSEIKWASRWDTYLLMTDDQIHWFSIVNSLMIVLFLSGMVAMIMLRTLYRDISRYNQLETQEEAQEETGWKLVHGDVFRPPTNSDLLCVYVGTGVQFFGMLLVTMVFAVLGFLSPSNRGGLMTAMLLVWVLMGLLAGYSSSRLYKMFKGSEWKKITLQTAFLFPGVAFVIFFILNALIWGEKSSGAVPFTTMFALVLLWFGISVPLVFVGSYLGFKKPAMEPPVKTNKIPRQIPEQAWYMNPIFTILIGGILPFGAVFIELFFILTSIWLHQFYYIFGFLFLVFVILIITCAEITIVLCYFQLCSEDYMWWWRSYLTSGSSALYLFLYAAFYFSTKLQITKLVSGILYFGYMLLASYAFFVLTGTIGFCACFWFTRLIYSSVKID

SEQ ID NO: 3497 - protein, 634 aa, Zea mays
MLRWAAALAVLLAVAAPAAGFYLPGVAPTDFAKGGPLPVKVNKLTSIKTQLPYTYYSLPFCKPDAIVDSAENLGEVLRGDRIENSPYVFKMREPKMCQIVCKAKITEKEAKELKEKIEEEYRVNMILDNLPLVVPVNRQDKNSIAYQGGYHVGLKGVYSGTKNEKYFIHNHLSFTVKYHRDDNSELSRIVGFEVNPLSVKHQIDDKWNGVDTRLSTCDPHASKFVINSDSPQEVEADKEIIFTYDVHFEESEIKWASRWDTYLLMTDDQIHWFSIVNSLMIVLFLSGMVAMIMLRTLYRDISRYNQLETQEEAQEETGWKLVHGDVFRPPTHSDLLCVCVGTGVQFFGMLLVTMIFAVLGFLSPSNRGGLMTAMLLVWVLMGLLAGYSSSRLYKMLKGSEWKKITLQTAFLFPGVAFVIFFILNALIWGEKSSGAVPFTTMFALVLLWFGISVPLVFVGSYLGFKKPAMEPPVKTSKIPRQIPEQAWYMNPLFTILIGGVLPFGAVFIELFFILTSIWLHQFYYIFGFLFLVFVILVITCAEIAVVLCYFQLCSEDYMWWWRSYLTSGSSALYLFLYAAFYFFTKLQITKLVSGILYFGYMFLASYAFFVLTGTIGFCACFWFTRLIYSSVKID

SEQ ID NO: 3498 - protein, 616 aa, Pennisetum glaucum
AGFYLPGVAPSDFGKGDPLQVKVNKLTSIKTQLPYTYYSLPFCKPATIVDSAENLGEVLRGDRIENSPYVFQMREPKMCQIVCKATISEKEAKELKEKIEDEYRVNMILDNLPVVVPVVRQDRNGIAYQGGYHVGAKGQYAGSKDEKYFIHNHLSFTVKYHKDDDSELSRIVGFEVHPYSVKHQFDGKWNGVDTRLSTCDPHASKFVTSSESPQEVEADKEIIFTYDVKFEDSEIKWASRWDTYLLMTDDQIHWFSIVNSLMIVLFLSGMVAMIMLRTLYRDISRYNQLETQEEAQEETGWKLVHGDVFRPPTNSDLLCVYVGTGVQFFGMLLVTMVFAVLGFLSPSNRGGLMTAMLLVWVLMGLLAGYSSSRLYKMFKGSEWKKITLQTAFLFPGIAFVIFFILNALIWGEKSSGAVPFTTMFALVLLWFGISVPLVFVGSYLGFKKPAMEPPVKTNKIPRQIPEQAWYMNPIFTILIGGILPFGAVFIELFFILTSIWLHQFYYIFGFLFLVFVILIITCAEITIVLCYFQLCSEDYMWWWRSYLTSGSSALYLFLYAAFYFSTKLQITKLVSGLLYFGYMLLASYAFFVLTGTIGFCACFWFTRLIYSSVKID

SEQ ID NO: 3499 - protein, 639 aa, Sorghum bicolor
MAPSAWAVALAALCIVALAPPAAGFYLPGVAPNDFEKKDPLPVKVNKLTSIKTQLPYSYYSLPFCKPDTIVDSAENLGEVLRGDRIENSPYTFEMREPQMCQIVCKISVGEKEAKLLKEKIEDEYRVNMILDNLPLVVPIQRVDQEGAYFYQHGFHVGAKGKYSGSKDEKYFIHNHLSFTVKYHRDEQRDISRIVAFEVKPYSVKHEYEGQWNDKKTRLTTCDPHAQRIITSSESPQEVEVGKDIIFTYDVDFKESDIKWASRWDSYLLMTDDQIHWFSIVNSLMIVLFLSGMVAMIMLRTLYRDISKYNQLETQEEAQEETGWKLVHGDVFRPPSNSDWLCVYVGTGVQFFGMLLVTMVFAVLGFLSPSNRGGLMTAMLLLWVFMGLLAGYSSSRLYKLFKGSEWKNIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLHQFYYIFGFLFLVFLILIVTCAEISIVLCYFQLCSEDYLWWWRSYLTSGSSALYLFLYATFYFFTKLEITKFVSAVLYFGYMLIASYAFFALTGTIGFYACFLFTRLIYSSVKIE

SEQ ID NO: 3500 - protein, 639 aa, Saccharum officinarum
MAPSAWAVALAALCIVALAPPAAGFYLPGVAPNDFEKKDPLPVKVNKLTSIKTQLPYSYYSLPFCKPDTIVDSAENLGEVLRGDRIENSPYTFEMREPQMCQIVCKISVGEKEAKLLKEKIEDEYRVNMILDNLPLVVPIQRVDQEGAYFYQHGFHVGAKGKYSGSKDEKYFIHNHLSFTVKYHRDEQRDVSRIVAFEVKPYSVKHEYEGQWNDKKTHLTTCDPHAQRIITSSESPQEVEVGKDIIFTYDVDFKESDIKWASRWDSYLLMTDDQIHWFSIVNSLMIVLFLSGMVAMIMLRTLYRDISKYNQLETQEEAQEETGWKLVHGDVFRPPSNSDWLCVYVGTGVQFFGMLLVTMVFAVLGFLSPSNRGGLMTAMLLLWVFMGLLAGYSSSRLYKLFKGSEWKNIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLHQFYYIFGFLFLVFLILIVTCAEISIVLCYFQLCSEDYLWWWRSYLTSGSSALYLFLYATFYFFTKLEITKFVSAVLYFGYMLIASYAFFALTGTIGFYACFLFTRLIYSSVKIE

SEQ ID NO: 3501 - protein, 641 aa, Brachypodium distachyon
MAISPAEASALAVALVVLCLAAPAAGFYLPGVAPNDFDQKDLLPVKVNKLTSIKTQLPYSFYSLPFCKPDTIVDSAENLGEVLRGDRIENSPYVFEMREPQMCQIVCKISVGEKEAKVLKEKIEDEYRVNMILDNLPLVVPIQRVDQEGAYFYQHGFHVGAKGQYSGSKDEKYFIHNHLSFTVKYHRDAQRDVSRIVAFEVKPYSVKHEYEGQWNDKKTRLTTCDPHAKRIITSSDSPQEVEAGKDIVFTYDVDFKESDIKWASRWDSYLLMTDDQIHWFSIVNSLMIVLFLSGMVAMIMLRTLYRDISKYNQLETQEEAQEETGWKLVHGDVFRPPANSDWLCVYVGTGVQFFGMMLVTMVFAVLGFLSPSNRGGLMTAMLLLWVFMGLLAGYSSSRLYKLFKGSEWKNIALRTAFTFPGSVFAIFFFLNILIWGQKSSGAVPFTTMFALVLLWFGISVPLVFVGSFLGFKKPAIEDPVKTNKIPRQVPEQAWYMNPIFSILIGGILPFGAVFIELFFILTSIWLHQFYYIFGFLFLVFLILIVTCAEISIVLCYFQLCSEDYLWWWRSYLTSGSSALYLFLYATFYFFTKLEITKFVSAVLYFGYMLIASYAFFALTGTIGFYACFMFTRLIYSSVKIE

SEQ ID NO: 3502 - protein, 639 aa, Zea mays
MEPSAWAVAFAALCIVALAPPASGFYLPGVAPNDFEKKDPLPVKVNKLTSIKTQLPYSYYSLPFCKPDTIVDSAENLGEVLRGDRIENSPYTFEMREPQMCQVVCKISVGEKEAKLLKEKIEDEYRVNMILDNLPLVVPIQRVDQEGAYFYQHGFHVGAKGKYSGSKDEKYFIHNHLSFTVKYHRDEQRDVSRIVAFEVKPYSVKHEYEGQWNDKKTRLTTCDPHAQRIITSSESPQEVEVGKDIIFTYDVDFKESDIKWASRWDSYLLMTDDQIHWFSIVNSLMIVLFLSGMVAMIMLRTLYRDISKYNQLETQEEAQEETGWKLVHGDVFRPPSNSDWLCVYVGTGVQFFGMLLVTMVFAVLGFLSPSNRGGLMTAMLLLWVFMGLLAGYSSSRLYKLFKGSEWKNIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLHQFYYIFGFLFLVFLILIVTCAEISIVLCYFQLCSEDYLWWWRSYLTSGSSALYLFLYATFYFFTKLEITKFVSAVMYFGYMLIASYAFFALTGTIGFYACFLFTRLIYSSVKIE

SEQ ID NO: 3503 - protein, 639 aa, Pennisetum glaucum
MATPAWAVALTALCLVALAPPAAGFYLPGVAPNDFEKKDPLPVKVNKLTSIKTQLPYSYYSLPFCKPDTIVDSAENLGEVLRGDRIENSPYTFEMREPQMCQIVCKISVGEKEAKLLKEKIEDEYRVNMILDNLPLVVPIQRVDQEGAYFYQHGFHVGAKGKYTGSKDEKYFIHNHLSFTVKYHRDEQRDVSRIVAFEVKPYSVKHEYEGQWNDKKTRLTTCDPHAQRVITSSESPQEVEVGKEIIFTYDVDFKESDIKWASRWDSYLLMTDDQIHWFSIVNSLMIVLFLSGMVAMIMLRTLYRDISKYNQLETQEEAQEETGWKLVHGDVFRPPSNSDWLCVYVGTGVQFFGMLLVTMLFAVLGFLSPSNRGGLMTAMLLLWVFMGLLAGYSSSRLYKLFKGSEWKSIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLHQFYYIFGFLFLVFLILIVTCAEISIVLCYFQLCSEDYLWWWRSYLTSGSSALYLFLYATFYFFTKLEITKFVSAVLYFGYMLIASYAFFALTGTIGFYACFLFTRLIYSSVKIE

SEQ ID NO: 3504 - protein, 184 aa, Hordeum vulgare
MTISLPATAVALFVVLAALCLLVVPSAGFYLPGVAPNDFEKKDHLPVKVNKLTSIKTQLPYSFYSLPFCKPDTIVDSAENLGEVLRGDRIENSPYVFEMRVPQMCQIVCKISVGEKEGKGLKEKIEDEYRVNMILDNLPLVVPIQRVDQEGAYFYQHGFHVGAKGQYSGSKDEKYFIHNHCPLR

SEQ ID NO: 3505 - protein, 639 aa, Panicum virgatum
MAPPGWAVALAALCLAALAPLAAGFYLPGVVPHDFEMKDPLPVKVNKLTSIKTQLPYSYYSLPFCKPDTIVDSAENLGEVLRGDRIENSPYTFEMKEPQMCQIVCKISVGEKEAKLLKEKIEDEYRVNMILDNLPLVVPIQRMDQEDAYFYQHGFHVGAKGKFLGSKDEKYFIHNHLSFTVKYHRDEQRDVSRIVAFEVKPYSVKHEYEGQWNDKKTRLTTCDPHAQRVITSSESPQEVEVGKDIIFTYDVDFKESDIKWASRWDSYLLMTDDQIHWFSIVNSLMIVLFLSGMVAMIMLRTLYRDISKYNQLETQEEAQEETGWKLVHGDVFRPPSNSDLLCVYVGTGVQFFGMLLVTMVFAVLGFLSPSNRGGLMTAMLLLWVFMGLLAGYSSSRLYKLFKGSEWKNIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLQQFYYIFGFLFLVFLILIVTCAEISIVLCYFQLCSEDYLWWWRSYLTSGSSALYLFLYATFYFFTKLEITKFVSAVLYFGYMLIASYAFFALTGTIGFYACFLFTRLIYSSVKIE

SEQ ID NO: 3506 - protein, 642 aa, Hordeum vulgare
MTISLPATAVALFVVLAALCLLVVPSAGFYLPGVAPNDFEKKDHLPVKVNKLTSIKTQLPYSFYSLPFCKPDTIVDSAENLGEVLRGDRIENSPYVFEMRVPQMCQIVCKISVGEKEGKGLKEKIEDEYRVNMILDNLPLVVPIQRVDQEGAYFYQHGFHVGAKGQYSGSKDEKYFIHNHLSFTVKYHRDAQRDVSRIVAFEVKPYSVKHEYGQWNDKKTHLTTCDPHAKRIITSSDSPQEVEVGKDIVFTYDVDFKESDIKWASRWDSYLLMTDDQIHWFSIVNSLMIVLFLSGMVAMIMLRTLYRDISKYNQLETQEEAQEETGWKLVHGDVFRPPANSDWLCVYVGTGVQFFGMMLVTMVFAVLGFLSPSNRGGLMTAMLLLWVFMGLLAGYSSSRLYKLFKGSEWKNIALRTAFTFPGSVFTVFFFLNILIWGQKSSGAVPFTTMFALVLLWFGISVPLVFVGSYLGFKKPAIEDPVKTNKIPRQVPEQAWYMNSIFSILIGGILPFGAVFIELFFILTSIWLHQFYYIFGFLFLVFLILIVTCAEISIVLCYFQLCSEDYLWWWRSYLTSGSSALYLFLYATFYFFTKLEITKFVSAILYFGYMLIASYAFFALTGTIGFYACLMFTRLIYSSVKIE

SEQ ID NO: 3507 - protein, 642 aa, Triticum aestivum
MTISLPATAAALSVVLAALCLLVVPAAGFYLPGVAPNDFEKKDHLPVKVNKLTSIKTQLPYSFYSLPFCKPDTIVDSAENLGEVLRGDRIENSPYVFEMRVPQMCQIVCKISVGEKEGKVLKEKIEDEYRVNMILDNLPLVVPIQRVDQEGAYFYQHGFHVGAKGQYSGSKDEKYFIHNHLSFTVKYHRDAQRDVSRIVAFEVKPYSVKHEYGQWNDRKTHLTTCDPNAKRIITSSDSPLEVEAGKDIVFTYDVDFKESDIKWASRWDSYLLMTDDQIHWFSIVNSLMIVLFLSGMVAMIMLRTLYRDISKYNQLETQEEAQEETGWKLVHGDVFRPPANSDWLCVYVGTGVQFFGMMLVTMVFAVLGFLSPSNRGGLMTAMLLLWVFMGLLAGYSSSRLYKLFKGSEWKNIALRTAFTFPGSVFTVFFFLNILIWGQKSSGAVPFTTMFALVLLWFGISVPLVFVGSYLGFKKPAIEDPVKTNKIPRQVPEQAWYMNSIFSILIGGILPFGAVFIELFFILTSIWLHQFYYIFGFLFLVFLILIVTCAEISIVLCYFQLCSEDYLWWWRSYLTSGSSALYLFLYATFYFYTKLEITKFVSAILYFGYMLIASYAFFALTGTIGFYACLMFTRLIYSSVKIE

SEQ ID NO: 3508 - protein, 572 aa, Pennisetum glaucum
MLRWATVALALALAALLAAAPAAAFYLPGVAPNDFQKKDQLLVKVNKLTSTKTQLPYSYYSLPFCKPNTIVDSAENLGEVLRGDRIENSPYVFEMREPKMCQIVCKASIDEKQAKELKEKIEDEYRVNMILDNLPLVVPIARQDRDATVYQGGYHVGVKGQYAGNKDEKVFIHNHLTFLVKYHKDETTELSRIVGFEVKPFSINHQFEGQWNDKNTRLITCDPHANKLVTSSDTPQEVEAGKEIIFTYDVGYEESDVKWASRWDTYLLMTDDQIHWFSIVNSLMIVLFLSGMVAMIMLRTLYRDISRYNQLETEEEAQEETGWKLVHGDVFRPPENSDLLCVCVGTGVQFFGMLLVTMIFAVLGFLSPSNRGGLMTAMLLTWVLMGLFAGYASSRFYKMFKGSEWKSITLKTAFLFPGIAFGIFFILNALIWGEKSSGAVPFTTMFALVLLWFGISVPLVFVGSYLGFKQPAIEAPVKTNKIPRQVPEQAWYMHPAFTVLIGGILPFGAVFIELFFILTSIWLHQFYYIFGFLFLVFIILIITCAEITIVLCYFQLCSEDYNWWWRSYLTSG

SEQ ID NO: 3509 - protein, 638 aa, Gossypium hirsutum
MAGHRFDVAWTFSLVALFFLRAHCFYLPGVAPEDFKKGDPLLVKVNKLTSTKTQLPYSYYSLPFCRPEHIVDSAENLGEVLRGDRIENSPYVFKMREPQMCNIVCRKILDKKAAKAFKEKINDEYRVNMILDNLPLVVPIRRPDQENAVVYQYGYHVGLRGQYAGSKEEKHFIHNHLTFTVKYHKDPLSGSARIVGFEVKPFSVKHEHEGEWNEKTRLTTCDPHAKRAVTSSESPQEVEEKKEIIFTYDVEFQESDIKWASRWDTYLLMADDQIHWFSIVNSLMIVLFLSGMVAMIMLRTLYRDISKYNQLETQEEAQEETGWKLVHGDVFRPPANSDLLCVYVGTGVQFFGMILVMMIFALLGFLSPSNRGGLMTAMLLLWVFMGLFAGYSSARLYKLFKGTEWKKITLKTAFMFPATVFAIFFVLNALIWGQKSSGAVPFGTMFALVLLWFGISVPLVFVGSYFGFKKPATEDPVKTNKIPRQIPEQAWYMNPAFSILIGGILPFGAVFIELFFILTSIWLHQFYYIFGFLFIVFVILIITCAEITVVLCYFQLCSEDYLWWWRSYLTSGSSAFYLFLYAAFYFFTKLEITKAVSGVLYFGYMLIISYSFFVLTGTIGFYACFWFTRLIYSSVKID

SEQ ID NO: 3510 - protein, 330 aa, Phaseolus coccineus
MGKQSTQFSALNCIDLSNSDINQSVHLLKQACLDSGFFYVVNHGISQEFMDEVFAQSKRFFSLPHQEKMKILRNEKHRGYTPVLDELLDPENQVRGDYKEGYYIGVEKAEDDPESKKPFYGQNKWPAPDVLPGWRETMEKFHRDTLEVGKSVAKIIALALDLDEKFFDQPKMFGEPIATLRLLHYGGQISDPSKGLYGAGAHTDYGLITLLATDDVAGLQICKNRDAKPQIWEDVAPLKGAFIVNLGDMLERWSNCIFKSTLHRVLGNGQERYSIAYFLEPSHDCLVECLPTCKSDSNPPKFPPILCQDYLTQRYEDTHADLKIYKKQQA

SEQ ID NO: 3511 - protein, 330 aa, Vigna unguiculata
MGKQSTQFSVLNCIDLSNSDIDQSVRLLKQACLDSGFFYVVNHGISQEFMDEVFTQSKKFFSLPLEEKMKILRNEKHRGYTPVLDELLDPENQVRGDYKEGYYIGVEKGEDDPESKKPFYGQNKWPAPDVLPGWRETMEKFHRETLEVGKAVAKIIALALDLDETFFDQPKMFGEPIATLRLLHYGGQISDPSKGLYGAGAHTDYGLITLLATDDVSGLQICKNRDAKPQIWEDVAPLKGAFIVNLGDMLERWSNCVFKSTLHRVLGNGQERYSIAYFLEPSHDCLVECLPTCKSDSNPAKFPPILCQDYLTQRYKDTHADLKIYKKQQA

SEQ ID NO: 3512 - protein, 337 aa, Lotus japonicus
MGKQSTPSPEATAKFSALNCINLSNPDINQSVKLLKQACLDSGFFYVVNHGISQEFMDEVFEQSKRFFTLPLKEKMKILRNEKHRGYTPVLDELLDPENQVHGDYKEGYYIGVEVAEDDPESQKPFYGPNKWPAPDILPGWRETMEKFHREALEVGKAVAKVIALALDLDANFFHQPEMLGEAIATLRLLHYEGQISDPSKGLYGAGAHTDFGLITLLATDDVSGLQICKDRDAKPQIWEDVAPLKGAFIVNLGDMLERWSNGVFKSTLHRVLGNGQERYSIAYFLEPSHDCLVECLPTCKSDSNPPKFPPILCRDYLSQRYNDTHADLNVYKKQQA

SEQ ID NO: 3513 - protein, 341 aa, Medicago truncatula
MGKQSKETESPVSDPTKFSILNLIDLSNSNINQSVNLLKQACLDSGFFYVVNHGISEEFMDEVFEQSKRFFTLPLKEKMKILRNEKHRGYTPVLDELLDPENQLHVGDYKEGYYIGVEVDEDDPESNKPFYGPNKWPAPDILPGWRETMEKFHREALEVGKAVGKIIALALDLDADFFDKPEMLGESIATLRLLHYGGQVSDPLKGLFGAGAHTDYGLITLLATDHVSGLQICKDRDAKPQKWEDVAPLKGAFVVNLGDMLERWSNGVFKSTLHRVLGNGQERYSIAYFLEPSHDCLVECLPTCKSDTNPPKYPPILCRDYLSQRYNDTHADLKIYKKQQS

SEQ ID NO: 3514 - protein, 106 aa, Arachis hypogaea
MVNADSLTSSLNCVDLSNPDINQSVNSLKQACLDSGFFYVVNHGISQEFMDEVFAESKKFFSLPHKEKMKLLRNEKHRGYTPVLDELLDPEKPSSWRLQRGILYWS

SEQ ID NO: 3515 - protein, 512 aa, Sorghum bicolor
MGWLTKFFRGSTHNISEGQYHSRPAEDTAWNEPSSSPVVTDIFSEFNNEDIDRAIALSLSEEEQRKAKTIDKDMHLEEDEQLARAIQESLNVESPPRRNGSANGGTTYHLPRETGNGGNAYQPSRENGSANGGNAYHPLPFMFSSGFRACAGCHREIGHGRFLSCMGAVWHPECFRCHACSQPIYDYEFSMSGNHPYHKTCYKEQFHPKCDVCKQFIPTNMNGLIEYRAHPFWLQKYCPSHEVDGTPRCCSCERMEPRESRYVLLDDGRKLCLECLDSAVMDTNECQPLYLEIQEFYEGLNMKVEQQVPLLLVERQALNEAMEGEKAGHHHLPETRGLCLSEEQTVSTILRRPRMAGNKIMGMITEPYRLTRRCEVTAILILYGLPRLLTGSILAHEMMHAWLRLKGYRTLSPDVEEGICQVLAHLWIESEIMAGSGSGAASSSSGSSSSMSSKKAGRSQFEHKLGDFFKHQIETDTSMAYGEGFRAGNRAVLQYGLKRTLEHIRLTGTFPF

SEQ ID NO: 3516 - protein, 514 aa, Panicum virgatum
MGWLTKFFRGSTHNISEGQYHSRPAEETTWNEPSSSPVVTDFLSDFNNEDIDRAIALSLSEEEQRKAKAIDKDMHLEEDELLARAIQESLNVESPPRRNGSANGGNTYHLPREPGITNGGNTYQPPRENGTANGGNAYQPLPFMFSSGFRACAGCHREIGHGRFLSCMGAVWHPECFCCHACSQPIYDYEFSMSGNHPYHKTCYKEQFHPKCDVCKQFIPTNMNGLIEYRAHPFWLQKYCPSHEVDGTPRCCSCERMEPRESKYVLLDDGRKLCLECLDSAVMDTSECQPLYLEIQEFYEGLNMKVEQQVPLLLVERQALNEAMEGEKAGHHHLPETRGLCLSEEQTVSTILRRPRMAGNKIMEMITEPYRLTRRCEVTAILILYGLPRLLTGSILAHEMMHAWLRLRGYRTLSPDVEEGICQVLAHMWIESEIMAGSGSSAASSSSGSSTSRSSKKGGRSQFERKLGDFFKHQIETDTSMAYGEGFRAGNRAVMQYGLKRTLEHIRLTGTFPF

SEQ ID NO: 3517 - protein, 509 aa, Pennisetum glaucum
LSKFFRGSTLNIAEGQYHSRPAEETSWNEPSSSHVVTDFHSEFNNEDIDRAIALSLLEEEQRKAKNIDKHTHLEDDELLARAIQESLNAESPPHRNASASGGNTYHPPREPGAANGGSTYQPFRENGTANGGNAYQPLPFMFSSGFRECAGCQREIGHGRFLSCMGAVWHPECFRCHACSQPIYDYEFSMSGNHPYHKTCYKEQFHPKCDVCKQFIPTNMNGLIEYRAHPFWLQKYCPSHEVDGTPRCCSCERMEPRESRYVLLDDGRKLCLECLDSAVMDTSECQPLYLEIQEFYEGLNMKVEQQVPLLLVERQALNEAMEGEKAGHHHLPETRGLCLSEEQTVSTILRRPRMAGNKIMEMITEPYRLTRRCEVTAILILYGLPRLLTGSILAHEMMHAWLRLRGYRTLSPDVEEGICQVLAHMWIESEIVAGSGSSAASSSSGSSTSSKKGGRSQFERKLGDFFKHQIESDTSMAYGDGFRAGNRAVMQYGLKRTLEHIRLTGTFPF

SEQ ID NO: 3518 - protein, 486 aa, Oryza sativa
MGWLTKFFRGSTHKISEGQYHSKPAEETIWNGPSNSAVVTDVPSEFDNEDIARAISLSLLEEEQRKAKAIEKDMHLEEDEQLARAIQESLNVESPPRARENGNANGGNMYQPLPFMFSSGFRTCAGCHSEIGHGRFLSCMGAVWHPECFRCHACNQPIYDYEFSMSGNHPYHKTCYKERFHPKCDVCKQFIPTNMNGLIEYRAHPFWLQKYCPSHEVDGTPRCCSCERMEPRESRYVLLDDGRKLCLECLDSAVMDTSECQPLYLEIQEFYEGLNMKVEQQVPLLLVERQALNEAMEGEKTGHHHLPETRGLCLSEEQTVSTILRRPRMAGNKVMEMITEPYRLTRRCEVTAILILYGLPRLLTGSILAHEMMHAWLRLKGYRTLSPDVEEGICQVLAHMWIESEIIAGSGSNGASTSSSSSASTSSKKGGRSQFERKLGDFFKHQIESDTSMAYGDGFRAGNRAVLQYGLKRTLEHIRLTGTFPF

SEQ ID NO: 3519 - protein, 504 aa, Triticum aestivum
MGWLTKFFRGSTHNISEGREQSKPAEETRWNEPSTSTVVIDPLSEFDNEDIDRAIALSLLEEEHRKPKETGKDLHLDEDEQLARAIQESLNVESPPRAHENASPPRPRENSAHPRARENGNANGGNSYQQLPFMFSSGFRTCAGCHNEIGHGRFLSCMGAVWHPECFCCHACNQPIYDYEFSMSGNHPYHKTCYKERFHPKCDVCKQFIPTNMNGLIEYRAHPFWLQKYCPSHEVDGTPRCCSCERMEPRESRYVLLDDGRKLCLECLDSAVMDTNECQPLYLEIQEFYEGLNMKVEQQVPLLLVERQALNEAMEGEKTGHHHLPETRGLCLSEEQTVSTILRRPRMTGNKIMEMITEPYRLTRRCEVTAILILYGLPRLLTGSILAHEMMHAWLRLKGYRTLTPDIEEGICQVLAHLWIESEIMAGSGSNAASTSSSSSSSTSSKKGGRSQFERKLGDFFKHQIESDTSVAYGDGFRAGNRVVQQYGLKRTLEHIRLTGTLPF

SEQ ID NO: 3520 - protein, 504 aa, Triticum aestivum
MGWLTKFFRGSTHNISEGREQSKPAEETRWNEPSTSTVVIDPLSEFDNEDIDRAIALSLLEEEHRKPKETGKDLHLDEDEQLARAIQESLNVESPPRPHENASPPRPRENSAHPRARENGNANGGNSYQQLPFMFSSGFRTCAGCHNEIGHGRFLSCMGAVWHPECFCCHACNQPIYDYEFSMSGNHPYHKTCYKERFHPKCDVCKQFIPTNMNGLIEYRAHPFWLQKYCPSHEVDGTPRCCSCERMEPRESRYVLLDDGRKLCLECLDSAVMDTNECQPLYLEIQEFYEGLNMKVEQQVPLLLVERQALNEAMEGEKTGHHHLPETRGLCLSEEQTVSTILRRPRMTGNKIMEMITEPYRLTRRCEVTAILILYGLPRLLTGSILAHEMMHAWLRLKGYRTLTPDIEEGICQVLAHLWIESEIMAGSGSNAASTSSSSSSSTSSKKGGRSQFERKLGDFFKHQIESDTSVAYGDGFRAGNRVVQQYGLKRTLEHIRLTGTLPF

SEQ ID NO: 3521 - protein, 491 aa, Brachypodium distachyon
MGWLTKFFRGSTHNISEGQDQSKPAEETVWNEPSSSTAVNYALSEFDNEDIDRAIALSLSEEEQRKSKGTGKDQHLDEDEQLARAIQESLNVESPPRAREKSSHPRARENGSANGGNSYQLPLMFSSGFRTCAGCHSEIGHGRFLSCMGAVWHPECFCCHGCSQPIYDYEFSMSGNHPYHKTCYKERFHPKCDVCQQFIPTNTNGLIEYRAHPFWLQKYCPSHEVDGTPRCCSCERMEPRESRYVLLDDGRKLCLECLDSAVMDTTECQPLYLEIQEFYEGLNMKVEQQVPLLLVERQALNEAMEGEKTGHHHLPETRGLCLSEEQTVSTILRRPRMAGNKIMEMRTEPYRLTRRCEVTAILILYGLPRLLTGSILAHEMMHAWLRLKGYRTLSPDIEEGICQVLAHMWIESEITAGSGSNAASTSSSSTSSKKGGRSQFERKLGDFFKHQIESDTSVAYGDGFRAGNQAVLQYGLKRTLEHIRLTGTLPF

SEQ ID NO: 3522 - protein, 512 aa, Brachypodium distachyon
MGWLTKIFRGSTYKISEGQRQSRPAEEAVWNEPSSSTVVTDVLSEFDNEDIDRAIALSLSEEQRKSKGTGKDLHLDEDEQLARAIHESLNVESPPCARDNGSPPHARDNSSPPHARENSSHPRARENGIANGGNSIQHSPFMFSSGFRTCAGCHSEIGHGRFLSCMGAVWHPECFCCHACSQPIYDYEFSMSGNHPYHKTCYKERFHPKCDVCKQFIPTNMNGLIEYRAHPFWLQKYCPSHEVDGTPRCCSCERMEPRESRYVLLDDGRKLCLECLDSAVMDTTECQPLYLEIQEFYEGLNMKVEQQVPLLLVERQALNEAMEGEKTGHHHLPETRGLCLSEEQTVSTILRRPRMTGNKIMEMITEPYRLTRRCEVTAILILYGLPRLLTGSILAHEMMHAWLRLKGYRTLSPEIEEGICQVLAHMWIESEIMAGSSSNAASTSSSSSSSISSKKGGRSQFERKLGDFFKHQIESDTSVAYGNGFRSGNQAVLQYGLKRTLEHIWLTGTWPF

SEQ ID NO: 3523 - protein, 381 aa, Zea mays
MSCFSHLFKRKRGPQQQDDPSDNYFTGSENITRFSYRELVRATSNFDQGNKIGEGGYGPVYKGTLKDGTLIAVKVLSLHSRQGAKEFLNELLAISDVTHENLVKLYGCCVEGNHRILVYNYLENNSLAHTLLDSRHSNIQFNWRTRVNICIGVAQGLAFLHGSVSPHIVHRDIKASNILLDKDMTPKISDFGLAKLLPPDVSHVSTRVAGTLGYLAPEYAIRGHVTRKADVYSYGVLLIEIVSGRCNTDTKLPYDDQILLEKTWRYYGRGNLEKIIDSSLGDDLDVDEACRFLKIGLLCTQDGTKRRPGMSAVVAMLRGEADVDTETISKPDVIRDFGDLKLRSRATSSTLLTSIMARSSPLSSEETTRTSITFTEISERD

SEQ ID NO: 3524 - protein, 240 aa, Panicum virgatum
MSCFSHFFKRKTGPQRQDDPASDDFTGSENITRYSYRELVRATSNFDQANKIGEGGYGPVYKGTLKDGTAIAVKVLSLHSRQGAKEFLSELLAISDVAHENLVKLYGCCVEGNHRILIYNYLENNSLSHTLLGSGHSNIQFNWRTRVNICIGVAQGLVFLHDNARPHIVHRDIKASNILLDKDLTPKISDFGLAKLLPSDVSHVSTRAAGTLGYLAPEYAIRGQVTRRQMSTAMVFCSWK

SEQ ID NO: 3525 - protein, 340 aa, Pennisetum glaucum
MSCFSHFFKRKRGTEQQDDPSSDYFTGSENITRYSYRELARATSNFDQTNKIGEGGYGPVYKGTLRDGTAIAVKVLCLHSRQGAKEFLNELLAISDVAHENLVKLYGCCVEGNHRILVYNYLENNSLARTLLGSGHSGIQFNWRTRVNICIGVAQGLTFLHDSVRPHIVHRDIKASNILLDTDLTPKISDFGLAKLLPSDVSHVSTRVAGTLGYLAPEYAIRGQVTRKADVYSYGVLLIEIVSGRCNTDTKLPYDDQILLEKTWRYYDQGNLEEIIDSSLGDDLDVEEACRFLKVGLLCTQDVTKRRPGMSAVVAMLKGEADVHTEMISKPDVIRDFKEL

SEQ ID NO: 3526 - protein, 467 aa, Pennisetum glaucum
FGTASSAYQYEGAVKEDGRGKTTWDTFAHTFGKVADFSNADVAVDHYHRFEEDIQLMADMGMDAYRFSIAWSRILPNGIGQVNQAGIDHYNKLIDALLAKGIQPYVTLYHWDLPQVLEDRYNGWLDRQIIHDFAAYAEICFKAFGDRVKHWITINEPHTVAVQGYDDGLQAPGRCSLLLHLYCKAGNSGTEPYIVAHNFILAHATASDIYRRNYKATQNGELGIAFDVMWFEPMTNTTIDIEAAKRGQEFQLGWFADPFFFGDYPASMRSRVGDRLPKFTPEEAALVKGALDFVGINHYTTYYTRHNSTNIIGRLLHNTLADTGTISLPFRNGKAIGDRANSIWLYIVPSGMRSLMNYVKERYNSPPIYITENGMDDGNSPFTSIKDALKDSKRIKYHNDYLTNLAASIKEDGCDVRGYFAWSLLDNWEWTAGYSSRFGLYFVDYKDNLKRYPKSSVQWFKTLLSSS

SEQ ID NO: 3527 - protein, 305 aa, Hordeum vulgare
MKKTVVLYPGVGVGHLVPMVEVAKLFIKHGQSVIVAVVDPQVESTDFSDAVVRARASNPSVAFHVLPPPPADSNSDSAPTHPVVQIFRLLKAMNAPLLDFLRSLPSVDALVLDMFCVDAQDVASELGLPVYYFYASAAADLALFLNLPSKLAGVKAKIKELGDSVIKFPGVPPFKATDLPEVMHNDEVLKAILGMFDRMPDSDGILINSVESLETRAVRALKDGLCVPGRATPPVYCIGPLVSGGGGKEHECLRWLDAQPDQSVVFLSFGSMGTFPVKQLQEIATGLEKSGQRFLWGRAEPAQSR

SEQ ID NO: 3528 - protein, 242 aa, Triticum aestivum
MKNTVVLYPGIGVGHLVPMVEVAKLFLKHGLAVTVVLIDPSGESTDFSSALARARSSKPSVAFHVLPPSPADSISDTVPTNPVIQIFRLLKSMNAPLLDFLRSMASIDALVLDMFCVDAQDVAADLKLPVYYFYASAVVDLALFLNLTSKLAGSKVKELGESIMTFPGCPPLRDPYLAEVTQHDEILRAILGMFDRMPDAKEISSVPASRGEPGGARSQGRVSIPGCAMHRLILWAFVCGRR

SEQ ID NO: 3529 - protein, 432 aa, Glycine max
RNAEAKQQQQKNAPFNSISGTVQFGASSLSRTHVPLSSTRTCPSFSFLFVFVAAAAKKQQRRGGAELAVMDGGFDDGDFYDAYDDDEEEEEFDDDDDEEEGMLPLDDMNKWFEKKPRGFGEGKVYDTSVEDKLLEEMRQSRIAQAENLTKLKSNPVKHASNESVQKKKDSELVPIGGRVCLVNLPKKKNIHKDLKSALQGIPGITNIVPAVTGNKKTRDPICKGFAYVDFECEEDAIRFVELYTGQAITFGKIQKQIKCELLNVQSSSSSLKLSKNLNAAPQLVARFEEVSNEDSNLDGSALSSWDEANSSDDLDDLDYQMNGEEQEDDEDNQESVSTLGVDHDDSVEMRIDPEICSLPSEQVDRNHAAEQKSSAKVKQENARKKKPTSKDRDKKVLGVPGSSRRLKIREKAVLSDVFSKYGLKATLASKDN

SEQ ID NO: 3530 - protein, 158 aa, Panicum virgatum
VFERVTKNSVRGIWSRRSKLNLVGAHINVFTGEWTQKDAGIGTSIDSFYEYLLKAYLLFGDEEYLYIFQEAYKAAMHHLHHDPWYVEVNMNSGATVWPLFNSLQAFWPGLQPEMLILLFEHMMPSSAFGKSMVSPLKVLILLHQLSRMDNAATRYGQS

SEQ ID NO: 3531 - protein, 382 aa, Citrus sinensis
  misc_feature (259)..(259): Xaa can be any naturally occurring amino acid
  misc_feature (331)..(331): Xaa can be any naturally occurring amino acid
  misc_feature (364)..(364): Xaa can be any naturally occurring amino acid
  misc_feature (367)..(367): Xaa can be any naturally occurring amino acid
SSVSSSDPGTSPFFISGINGDLKKESSVIREDRNLEDSSSDTDSENLSVSSASMRFQPWMTEFLRSHHQSSHQMEEECSRRTNNKTQASTTKALLEKFSRLDRDAGVGMSSYRTDLEFSGNVREAISLSRNAPPGPPPLCSICQHKAPVFGKPPRWFSYAELELATGGFSQANFLAEGGFGSVHRGVLPDGQAVAVKQHKLASSQGDHEFCSEVEVLSCAQHRNVVMLIGFCIEDRRRLLVYEYICNGSLDSHLYGCHXEPLEWSARQKIAVGAARGLRYLHEECRVGCIVHRDMRPNNILLTHDFEPLVGDFGLARWQPDGDMGVETRVXGTFGYLAPEYAQSGQITEKADVYSFGVVLVELXTRXKSSGPQPTKGPTVSY

SEQ ID NO: 3532 - protein, 750 aa, Aquilegia formosa
MTSLQQKRGKSEKGGNVAEKVVVAVKASMKEIPKTALVWALTHVVQPGDCITLLVVVPAISSGKKLWGFPRFAGDCASGHKRSLIGTSSEQKFDLTDSCSQMMLQLHDVYDPNKINIKIKIVSGSPCGAVAVESKRAQPSWVVLDRQLKHEEKRCMEELQCNIVVMKRSQAKVLRLNLVGSPKSDAEETCPLPSELEEASENYLKDNNVPINSIRGPLVTPNSSPELGTPFTVTEAGTSSVSSSDPGTSPFFTSEVSSGLKKVSLATKESQILDDSCSDIDSENMSPPSTSLSFQPWMAEIISKSRSSLKHADESSQRRRDNIRSSTANALADKFSKLDHEVGFRRLNYRQDLEFSGNVREAVSLSRTAPPGPPPLCSICQHKAPVFGKPPRWFSYAELELATGGFSQANFLAEGGFGSVHRGVLPDGQAVAVKQHKLASSQGDLEFCSEVEVLSCAQHRNVVMLIGFCVEDKRRLLVYEYICNGSLDSHLYGRNRQPLEWAARQKVAVGAARGLRYLHEECRVGCIVHRDMRPNNILITHDFEPLVGDFGLARWQPDGDMGVDTRVIGTFGYLAPEYAQSGQITEKADVYSFGVVLVELVTGRKAVDITRPKGQQCLTEWARPLLEEYAIDELIDPSLENSYAENEVYCMLHAASLCIRRDPHSRPRMSQVLRILEGDMIFDSNYVSTPGHDSGSRSGRSWAEQHHQHFSGPIMNEASEGLSGKLSHEAIKAAYWEREQARRTPSNGHL

SEQ ID NO: 3533 - protein, 750 aa, Aquilegia formosa
MTSLQQKRGKSEKGGNVAEKVVVAVKASMKEIPKTALVWALTHVVQPGDCITLLVVVPAISSGKKLWGFPRFAGDCASGHKRSLIGTSSEQKFDLTDSCSQMMLQLHDVYDPNKINIKIKIVSGSPCGAVAVESKRAQPSWVVLDRQLKHEEKRCMEELQCNIVVMKRSQAKVLRLNLVGSPKSDAEETCPLPSELEEASENYLKDNNDPINSIRGPLVTPNSSPELGTPFTVTEAGTSSVSSSDPGTSPFFTSEVSSGLKKVSLATKESQILDDSCSDTDSENMSPPSTSLSFQPWMAEIISKSRSSLKHADESSQRRRDNIRSSTANALADKFSKLDHEVGFRRLNYRQDLEFSGNVREAVSLSRTAPPGPPPLCSICQHKAPVFGKPPRWFSYAELELATGGFSQANFLAEGGFGSVHRGVLPDGQAVAVKQHKLASSQGDLEFCSEVEVLSCAQHRNVVMLIGFCVEDKRRLLVYEYICNGSLDSHLYGRNRQPLEWAARQKVAVGAARGLRYLHEECRVGCIVHRDMRPNNILITHDFEPLVGDFGLARWQPDGDMGVDTRVIGTFGYLAPEYAQSGQITEKADVYSFGVVLVELVTGRKAVDITRPKGQQCLTEWARPLLEEYAIDELIDPSLENSYAENEVYCMLHAASLCIRRDPHSRPRMSQVLRILEGDMIFDSNYVSTPGHDSGSRSGRSWAEQHHQHFSGPIMNEASEGLSGKLSHEAIKAAYWEREQARRTPSNGHL

SEQ ID NO: 3534 - protein, 720 aa, Populus trichocarpa
MSREQKKGKQEKGGSDVAVKVVVAVKASKEIPKTALVWALTHVVQPGDCITLLVVVPSHAPGRRLWGFPRFAADCANGHRKSHSGATSDQRCDITDSCSQMILQLHDVYDPNKINVKIKIVSGSPCGAVSAEAKKAQANWVVLDKQLKHEEKRCMEELQCNIVVMKRSQAKVLRLNLVGTSKEPEVVGPSPSKLNEASEQHSKNKNNSSGSIRGPVVTPTSSPELGTPFTVTEAGTSSVSSDPGASPFFISETNGELKKEEPLVIKENRDLDESSSDTDTEHLSLASSLRFEPWVGELLGSHIKSSRHVEESSQRSNCMAQTSTTEALLEKFSKLDRQTGIGMSNYRTDLDLSVNVREAISLSRNTPPGPPPLCSICQHKAPVFGKPPRWFSYAELELATGGFSQANFLAEGGFGSVHRGVLPDGQAVAVKQHKLASSQGDVEFCSEVEVLSCAQHRNVVMLIGFCIEDRRRLLVYEYICNGSLDSHLYGHHREPLEWSARQKIAVGAARGLRYLHEECRVGCIVHRDMRPNNILITHDFEPLVGDFGLARWQPDGDTGVETRVIGTFGYLAPEYAETGQITEKADVYSFGVVLVELVTGRKAVDLNRPKGQQCLTEWARPLLEEYAIVELIDPQLGNHYSEQEVYCMLHAASICIRRDPHSRPRMSQVLRILEGDMHVDTNYMSAPGYDVGNRSGRIYIDRTAAAAAAIKTLWCSAVNE

SEQ ID NO: 3535 - protein, 719 aa, Manihot esculenta
MSREQKRGKQEKGGSDVAEKVVVAVKASKEIPKTALVWALTHVVQAGDCITLFVVVPSQSSGRKLWGFPRFAGDCASGQRKSHSGASSEQNCDITDSCSQMFLQLHDVYDPNKINMKIKIFSGSPCGAVAAEAKRAQANWVVLDKQLKHEEKCCMEELQCNIVVMKRSQPKILRLNLVGSSKEAETTGQLPCELDEASDKCTKHKNDSLVSIRGPVVTPTSSPELGTSFTATEAGTSSVSSDPGTSPFFTSEMNGDLKKEGSLIIKENMDVDESSSDTDREHLSSASASLRFEPWMGEFISSYIQSSRHMEEGSRRNTNMAQESTTKALLDKFSRPDRKTGTGMRNYRTDVDLSGNVREAISLSRNAPPGPPPLCSICQHKAPVFGKPPRWFSYAELELATGGFSQANFLAEGGFGSVHRGVLPDGQVVAVKQHKLASSQGDLEFCSEVEVLSCAQHRNVVMLIGFCIEEKRRLLVYEYICNGSLDSHLYGRHREPLQWSARQKIAVGAARGLRYLHEECRVGCIIHRDMRPNNILITHDFEPLVGDFGLARWQPDGDMGVETRVIGTFGYLAPEYAQSGQITEKADVYSFGIVLVELVTGRKAVDLNRPKGQQCLAEWARPLLEEYAIDELIDPQLGNRYSEQEVYCMLHAASLCIQRDPHSRPRMRQVLRILEGDMLMDASYTSTPGYDVGNQSGQIWAEQQQQQHYSGPPFKGRVQ

SEQ ID NO: 3536 - protein, 516 aa, Gossypium hirsutum
LGTPFTATEAGTSSVSSSDLGTSPFFNSAGNGDLKKDESLVIKEIQDLDESGSDPESENLSLSSTSLRFQPWITEYLTSQHQSSRHLEETSVRAHDRVQASTTKALLEKFSKLDREAGIGISSFRSDSEFSGNVREAVSLSRNAPPGPPPLCSICQHKAPIFGKPPRWFTYAELELATGGFSQANFLAEGGFGSVHRGVLPDGQAIAVKQHKLASCQGDHEFCSEVEVLSCAQHRNVVMLIGFCIEDRRRLLVYEYICNGSLDAHLYGHHQEPLEWSARQKIAVGAARGLRYLHEECRVGCIVHRDMRPNNILITHDFEPLVGDFGLARWQPDGDTGVETRVIGAFGYLAPEYAQSGQVTEKADIYSFGVVLVELVTGRKAVDLNRPKGQQCLTEWARPLLEEYAIDELVDPRLEDCYSEHEVYCMLHAASLCIRQDPHSRPRMSQVLRILEGDMLMDSNYSLPRYDIGNRSGRVCADQKYYSGSLENEALEEFNGKLYLDGLRSGTRRTSCADHL

SEQ ID NO: 3537 - protein, 750 aa, Glycine max
MSQEQQKRGKQEKGSDGVEKVIVAVKASKEIPKTALVWSLSHVVQPGDCITLLVVVPSQSSGRRLWGFPRFAGDCASGIKKYPPGTISEQKSDITDSCSQMILQLHNVYDPNKINVRIKIVSGSPCGAVAAEAKKAQANWVVLDKQLKHEEKRCMEELQCNIVVMKRSQPKVLRLNLIGPQKKEVEEAGPSPSEQDDMPENRTKIKLDSLNSIKGPAVTPTSSPELGTPFTATEAGTSSVSSSDPGTSPFFISEMNGEFKKEETIKESQELVDTNSDTESESLSTSSASMRYQPWITELLLHQPSTQCNEERSEMSHGMPQASTTRAFLEKYSRLDRGAGFEISTYRNDMDFSGNLREAIALSGNAPPGPPPLCSICQHKAPVFGKPPRWFSYAELELATGGFSQANFLAEGGFGSVHRGVLPEGQVIAVKQHKLASSQGDLEFCSEVEVLSCAQHRNVVMLIGFCIEDKRRLLVYEYICNGSLDSHLYGRQRDPLEWSARQKIAVGAARGLRYLHEECRVGCIIHRDMRPNNILITHDFEPLVGDFGLARWQPDGDTGVETRVIGTFGYLAPEYAQSGQITEKADVYSFGVVLVELVTGRKAVDLTRPKGQQCLTEWARPLLEEDAIEELIDPRLGNHYSEHEVYCMLHAASLCIQRDPQCRPRMSQVLRILEGDMVMDSNYISTPGYDAGNRSGRLWSEPLQRQHHYSGPLLEESLESFSGKLSLDKYKPSYWGDRDKARRASCVDDI

SEQ ID NO: 3538 - protein, 750 aa, Glycine max
MSREQQKRGKQEKGSDGAEKVIVAVKASKEIPKTALVWSLSHVVQPGDCITLLVVVPSQSSGRRLWGFPRFAGDCASGIKKYPPGTISEQKSDLTDSCSQMILQLHNVYDPNKINVRIKIVSGSPCGAVAAEAKKTQANWVVLDKQLKHEEKRCMEELQCNIVVMKRSQPKVLRLNLIGPQKKDVEEAGPSPSEQDDMPENRTKIKLDSLNSIKGPTVTPTSSPELGTPFTATEAGTSSVSSSDPGTSPFFISEMNGEFKKEETIKESQELVDTNSDTESESLSTSSASMRYQPWITELLLHQQSSQRNEERSDISHGIPQASTTRAFLEKYSRLDRGAGFEISTYRNDMDFSGNLREAIALSGNAPPGPPPLCSICQHKAPVFGKPPRWFTYSELELATGGFSQANFLAEGGFGSVHRGVLPEGQVIAVKQHKLASSQGDLEFCSEVEVLSCAQHRNVVMLIGFCIEDKRRLLVYEYICNGSLDSHLYGRQRDTLEWSARQKIAVGAARGLRYLHEECRVGCIIHRDMRPNNILITHDFEPLVGDFGLARWQPDGDTGVETRVIGTFGYLAPEYAQSGQITEKADVYSFGVVLVELVTGRKAVDLTRPKGQQCLTEWARPLLEEYAIEELIDPRLGKHYSEHEVYCMLHAASLCIQRDPQCRPRMSQVLRILEGDMVMDSNYISTPGYDAGNRSGRLWSEPLQRQQHYSGPLLEESLESFSGKLSLDKYKPSYWGDRDKARRASCEDDI

SEQ ID NO: 3539 - protein, 737 aa, Lotus japonicus
MSQEQQKRGKQEKGSDGAEKVIVAVKASREIPRTALVWSLTHVVQPGDCITLLVVVPSQNSGRRLWGFPRFAGDCASGIKKYPPGTILEQKSDITDSCSQMILRLHDVYDPNKINVRIKIVSGSPCGAVAAEAKKAEANWVVLDKHLKQEEKRCMEELQCNIAVMKHSQPKVLRLNLIGPQKKDVGEASPSPSEQDDMPEKGTRNKIDSLNSIKGPTVTPSSSPELGTPFTATEAGTSSASSSDPGTSPFFNSEVNGQSKKEETIKENEELGDTNSDTESESLSTSSASLRFQPWITELLLHQQSSQCNEERSETYPGMPQAPTTRALVEKFSRLDRGAGIEISTYRNDSDFSGNLREAIALSGNAPPGPPPLCSICQHKAPVFGKPPRWFSYAELELATGGFSQANFLAEGGFGSVHRGVLPEGQVIAVKQHKLASSQGDIEFCSEVEVLSCAQHRNVVMLIGFCIEDKRRLLVYEYICNGSLDVHLYGRQRDPLEWSARQKIAVGAARGLRYLHEECRVGCIIHRDMRPNNILITHDFEPLVGDFGLARWQPDGDTGVETRVIGTFGYLAPEYAQSGQITEKADVYSFGVVLVELVTGRKAVDLTRPKGQQCLTEWARPLLEEYAIDELIDPRLGSHYAEQEVYCMLHAAALCIRRDPHSRPRMSQVLRILEGDMVMDTNYISTPGYDVGNRSGRIWSEPLQRQHPYSGPLLEESFSGKLSLDKYKPAYWDRDRH

SEQ ID NO: 3540 - protein, 330 aa, Vigna unguiculata
VLPEGQVIAVKQHKLASSQGDLEFCSEVEVLSCAQHRNVVMLIGFCIEDKRRLLVYEYICNGSLDSHLYGRQKDPLEWSARQKIAVGAARGLRYLHEECRVGCIIHRDMRPNNILITHDFEPLVGDFGLARWQPDGDTGVETRVIGTFGYLAPEYAQSGQITEKADVYSFGVVLVELVTGRKAVDLTRPKGQQCLTEWARPLLEDYATEELIDPRLGNHYSENEVYCMLHAASLCIQRDPQCRPRMSQVLRILEGDMVMDTNYISTPGYDAGNRSGRLWSEPLQRQHHYSGPLLEETLESFSGKLSLEKYKPSYWGDRDKARRASCEDDI

SEQ ID NO: 3541 - protein, 748 aa, Aristolochia fimbriata
MSNNLQHRRGKERDSDITEKVVVAVKASKEIPRTALVWALTHVVQPGDCITLLVVVPSHSSGRKLWSFPRFAGDCASGHKRSHSGTTTEQKCDITDSCSQLMLQLHDVYDPNKINVKIKVITGSPSGAVAAECKRAQASWVVLDKQLKQEEKRCMEELQCNIVVMKRSQPKVLRLNLAGSPQKELTDSLSNELHEPSSKPPPKISHSSMASIRGPVVTPTSSPELGTPFTATEVGTSSVSSSDPGTSPFLVSDANGSLKKEGANIMEDSRNLPTSSDSDSENLSPPSTSLDVQPWMTDILSLRHHTLKHVEDKSERVNDKTHTSTAKALLEKFSKLDLEAGIGTLNYRSELDFSGNVRDAIALSRSAPPGPPPLCSICQHKAPVFGKPPRWFSYAELELATGGFSQANFLAEGGFGSVHRGVFPDGQAVAVKQHKLGSSQGDHEFCLEVEVLSCAQHRNVVMLIGFCVEDKRRLLVYEYICNGSLDSHLYGNNRDPLAWAARQKIAVGAARGLRYLHEECRVGCIVHRDMRPNNILITHDFEPLVGDFGLARWQPDGDMGVETRVIGTFGYLAPEYAQSGQITEKADVYSFGVVLVELVTGRKAVDINRPKGQQCLTEWARPLLEEYAIDELVDPRLENHYCEHEVYCMLHAAALCIRRDPQSRPRMSQVLRILEGDLVVDSNYASTPVYEPGSRSRRMWPEQQQHSGPITTDAEGFSGKLSYEALRAAYWGKEKARQESCNRDDGCF

SEQ ID NO: 3542 - protein, 429 aa, Gossypium hirsutum
RAGSTRAYVRAQGSTSKALLEKFSKLDREAGIGMSSFKSDIGFSGNVREAVALSRNSPLGPPPLCSICQHKAPIFGKPPRWFTYAELELATGGFSQANFLAEGGFGSVHRGVLPDGQVIAVKQHKLASCQGDHEFCSEVEVLSCAQHRNVVMLIGFCIEDRRRLLVYEYICNGSLDAHLYGHHQEPLEWSARQKIAVGAARGLRYLHEECRVGCIVHRDMRPNNILITHDFEPLVGDFGLARWQPDGDAGVETRVIGAFGYLAPEYAQSGQVTEKADIYSFGVVLVELVTGRKAVDLNRPKGQQCLTEWARPLLEEYAIDELVDPRLEDCYSEHEVYCMLHAASLCIRQDPHSRPRMSQVLRILEGDMLMDSNYSSPRYDIGNRSGRVCADQKYYSGSLVNEALEEFNGKLYLDGLRSGTSRTSCADHL

SEQ ID NO: 3543 - protein, 645 aa, Medicago truncatula
MSREQQKRGKQEKGCDGAEKVIVAVKASTKEIPKTALVWSLTHVVQPGDCITLLVVVPSQSSGRKWGFPRFAGDCASGIKKYPPGTILEQKSDITDSCSQMILQLHDVYDPNKINVRIKIVSGSPCGSVAAEAKKGQASWVVLDKHLKPEEKKCMEELQCNIVVMKRAQPKVLRLNLIGPKKKEVEEACTSPSVQDDMLEKQTKNKIDSLVDSIKGPNVTPTSSPELGTPFTTTTEAGTSSASSSDPGTSPFFISMNSESKKEETIKESQELCDTNSDTESESLSTSSASFRYQPWITELLLHQQSSQHNEERSEPYHGMPQATTTKALLEKFSRLDRGAGIEMSAAYRKDSDFSGNLREAIALSGNAPLGPPPLCSICQHKAPVFGKPPRWFSYAELELATGGFSQANFLAEGGYGSVHRGVLPEGQVIAVKQHKLASSQGDVEFCSEVEVLSCAQHRNVVMLIGFCIEDKRRLLVYEYICNGSLDSHLYGRQRDPLEWSARQKIAVGAARGLRYLHEECRVGCIIHRDMRPNNILITHDFEPLVGDFGLARWQPDGDMGVDTRVIGTFGYLAPEYAQSGQITEKADVYSFGVVLVELVTGRKAVDLTRPKGQQCLAEWARPLLEEYAIDELIDPRAGRSLFRT

SEQ ID NO: 3544 - protein, 727 aa, Artemisia annua
MGSVSKEANMGKTEKGSDAAAEKIVVAVKASKEIPKTALVWALTHVVQPGHCITLLVVLPAQTSGRKLWGFPRFTGDCASGYRKSLLGTTLDQKTDITDSCSQMILQLHDVYDPNKINVKIKIVSGSPCGAVAAEAKKIQATWVVLDKKLKHEQKRCMEDLQCNIVIMKKSQPKVVRLNLVETPKTRPGAGCPLPSKDKPSEKQTKNTSSSLGSSSGPVVTPTSSPEVFTTTEAGTSSVSSSDPGTSPFFVPVTNGSLKKEKSIMGKESQDLIESSSDSESEHLSSTSSSLRFQPWMVDRITSSCQSSHNLAQTSTTQDMFRRLSKLDRDSEHGSHRSDVDFSINVRDAISLSRNVPSGPPPLCSICQHKAPIFGKPPRWFTYAELELATGGFSKANFLAEGGYGSVHRGVLPDGQAVAVKQHKLASSQGDQEFCSEVEVLSCAQHRNVVMLIGFCIEDGRRLLVYEYICNGSLDTHLYGRQRDPLEWAARQKVAVGAARGLRYLHEECRVGCIVHRDMRPNNILITHDFEPLVGDFGLARWQPDGDTGEETRVIGTFGYLAPEYAQSGQITEKADVYSFGVVLVELVTGRKAVDLNRPKGQQCLTEWARPLLEEDAIDELIDPRLGNSYSEDEVYCMLQAASLCIKRDPQLRPRMSQVLRILEGDMIMDSSLDVGNRSGRIYLDHHQLSPMRETLEVFDSKLSLDSMRTPYWQRDKAKRTSCEDRR

SEQ ID NO: 3545 - protein, 741 aa, Solanum phureja
MSREMKKGKQDMSSDAAEKVMVAVKASKEIPKTALVWSLTHVVQPGDCITLLVVVPSQSSGRKLWGFPRFAGDCASGHWKLHSGNSSEHKSDITDYCSQMILQLHDVYDPNKINVKIKIVSGTPHGAVAAEAKKSQANWVVLDKHLKHEKKRCMEELQCNIVIMKRSQPKVLRLNLVGSPKKEPDVMGTLSSDQTQICGKESNKKDSLDSSRGPLVTPSSSPEMFSTTEAGTSSVSSSDPGTSPFFVAEVNRDLKKANLLAAKEDVDESSSESESENLSASSSLRFQPWIVDIINSHSELSQIKGKSSLRTHDRPQDSTNKTFLRKFSKLDEESDFGSPSYRADLEYSGNVREAVSLSRSAPLGPPPLCSLCQHKAPVFGKPPRWFTYAELELATGGFSQANFLAEGGYGSVHRGVLPDGQVVAVKQHKLASSQGDQEFCSEVEVLSCAQHRNVVMLIGFCIEDSRRLLVYEYICNGSLDSHLYGRTRDPLEWSARQKIAVGAARGLRYLHEECRVGCIVHRDMRPNNILITHDFEPLVGDFGLARWQPDGDTGVETRVIGTFGYLAPEYAQSGQITEKADVYSFGVVLVELVTGRKAVDLTRPKGQQCLTEWARPLLQECAVDELIDPRLENCYSEHEIYCMLHAASLCIRRDPQNRPRMSQVLRILEGDLIMESGKLSTTPGYDVGNHSGRIWSDAQQQYQRFSGSLLNDGSEEFSAKLSFDKRNPSNIWDRDQSRTTY

SEQ ID NO: 3546 - protein, 751 aa, Cucumis sativus
MSRDLKRGKQDKGSDDVQKVIVAVKASKEIPKTALVWALTHVVQIGDCITLLVVVPSQSSGRKFWGFPRFAGDCASGHKKAHSGTSSELKCDITDSCSQMILQLHDVYDPNKINVKIKIVSGSPSGAVAAEAKRAQASWVVLDKQLKHEEKCCMEELQCNIVVMKRSQPKVLRLNLVGSPKKEPEVPSPSPSDIYEGSESHQKENNDPLDFIRGPVVTPSSSPELGTPFTATEAGTSSVSSSDPGTSPFFNSEMNGDTKKEELFVIKENKELDAASSDSDIENLSVSSASLRFQPWMTEFLSSHLQSSQHISGRSQRCDDRNQASTRNSFLLKSSKLDRESSIGMSSHRSDNDFHGDVRDAVSLSRNTPPGPPPLCSICQHKAPVFGKPPRWFSYAELELATGGFSQANFLAEGGYGSVHRGVLPDGQVVAVKQHKLASSQGDLEFCSEVEVLSCAQHRNVVMLIGFCIEEKRRLLVYEYICNGSLDSHLYGRQQEPLEWSARQKIAVGAARGLRYLHEECRVGCIVHRDMRPNNILITHDFEPLVGDFGLARWQPDGDTGVETRVIGTFGYLAPEYAQSGQITEKADVYSFGVVLVELITGRKAVDLSRPKGQQCLTEWARPLLDEFLIDELIDPRLVNSFAEHEVYCMLHAASLCIRRDPNARPRMSQVLRILEGDLVMDANYFSTPGYDVGNRSGRMWTEQQQQPQNYSGLLSDETVERFNEKVCVESLRPGYWERDKTRRTSSGSEL

SEQ ID NO: 3547 - protein, 236 aa, Cajanus cajan
MLIGFCIEDKRRLLVYEYICNGSLDSHLYGRQREPLEWSSRQKIAVGAARGLRYLHEECRVGCIIHRDMRPNNILITHDFEPLVGDFGLARWQPDGDTGVETRVIGTFGYLAPEYAQSGQITEKADVYSFGVVLVELVTGRKAVDLNRPKGQQCLTEWARPLLEEYAIEELIDPRLGSHYSEHEVYCMLHAASLCIRRDPYSRPRMSQVLRILEGDTVMDLNCISTPSYDVGNRSG

SEQ ID NO: 3548 - protein, 746 aa, Solanum lycopersicum
MSREMKKGKQDMSSDAAEKVMVAVKASKEIPKTALVWSLTHVVQPGDCITLLVVVPSQSSGRKLWGFPRFAGDCASGHWKLHSGNSSEHKSDITDYCSQMILQLHDVYDPNKASIQILFISTAINVKIKIVSGTPHGAVAAEAKKSQANWVVLDKHLKHEKKRCMEELQCNIVVMKRSQPKVLRLNLVGSPKKEPDVTGTLSSEQTQICGKESNKKDSLDSSRGPLVTPSSSPEMFSTTEAGTSSVSSSDPGTSPFFVSEVNRDLKKANLSSAQEDVDESSSESESENLSASSSLRFQPWIADIINSHSELSQIKGKSSLRTHDRPQDSTNKTLLRKFSKLDEESDFGSPSYRADLDYSGNVREAVALSRSAPLGPPPLCSICQHKAPVFGKPPRWFTYAELELATGGFSQANFLAEGGYGSVHRGVLPDGQVVAVKQHKLASSQGDQEFCSEVEVLSCAQHRNVVMLIGFCIEDSRRLLVYEYICNGSLDSHLYGRTRDPLEWSARQKIAVGAARGLRYLHEECRVGCIVHRDMRPNNILITHDFEPLVGDFGLARWQPDGDTGVETRVIGTFGYLAPEYAQSGQITEKADVYSFGVVLVELVTGRKAVDLTRPKGQQCLTEWARPLLQECAVDELIDPRLENCYSEHEIYCMLHAASLCIRRDPQARPRMSQVLRILEGDLIMESGKLSTTPGYDVGNHSGRIWSDAQQQCQRFSGSSDGSEEFSAKLSFDKRNPSNVWDRSTY

SEQ ID NO: 3549 - protein, 737 aa, Eucalyptus grandis
MSREQKRGKLEKGNGDVAEKVVVAVKASKEIPKTALVWALTHVVQPGDCITLLVVVSSQSSGRKLWGFPRFAGDCASGHRKSHLGSSTEQKIDITDSCSQMILQLHDVYDPNKINVKIRIVSGSPCGAVAAEAKKAHASWVVLDKQLKPEEKRCMEELQCNIVVMKRSQAKVLRLNLTGSPKKEIEAQPPPSELDEASDKHRKIQHEATNSVRGPVVTPTSSPELGTPFTSTEAGASSVSSSDPGTSPCLIQYVNADIKKNAPSVVKETRDVDECSSSDSDNENLSLASTSWRFQPLMAELLNSNCHDSVHFGQNFQRANDTVQALMTKDMPSKFARSNEDDLIQLPDYRDNMDIGGNLRGAISLSRNKPSGPPPLCSICQNKSPVFGKPPRWFSYAELELATGGFSRANFLAEGGFGSVHRGVLPDGQIVAVKQHKLASSQGDHEFCSEVEVLSCAQHRNVVMLIGFCIEDKRRLLVYEYICNGSLDSHLYGCHQETLEWSARQKIAVGAARGLRYLHEECRVGCIVHRDMRPNNILITHDFEPLVGDFGLARWQPDGRTGVETRVIGTFGYLAPEYAQSGQITEKADVYSFGVVLVELVTGRRAVDVDRPKGQQFLTEWARPLLEEFAMDQLIDPRLENHYSEDEVCCMLHAASLCIRRDPHSRPRMSQVLRILEGDMLVDINYMSTPGSDAGSRSGRLWAEQQPQHYHSSSLLNEATEAFSGKLSHKTRRLSIK

SEQ ID NO: 3550 - protein, 442 aa, Glycine max
MSREQQKRGKQEKGSDGAEKVIVAVKASKEIPKTALVWSLTHVVQPGDCITLLVVVPSQSAGRRLWGFPRFAGDCANGQKKSTSGSSSSEHKSDITDSCSQMILQLHDVYDPNKINVKIKIVSGSPCGAVAAEAKKSQANWVVLDKQLKHEEKQCMEELQCNIVVMKRSQPKVLRLNLVGTQKKDFEELCPLPSEQNEMPGKQIKKKNDSLNSIKGPVVTPTSSPELGTPFTTTEAGTSSVSSSDQGTSPFFISEMNGESKKEETIKENPELDDSISDTDSENLSTSSTSLRFQPWITDLLLHQQSSQPKEERTERSYNRLQSSTTRALLEKFSRLDREAEIEISTYKTDYDFSGNVREAVALSRNTPPGPPPLCSICQHKAPVFGKPPRWFSYAELELATGGFQKPISWQKEDLDLFTEGFCQMDKSLLSSNINWLVLRVI

SEQ ID NO: 3551 - protein, 328 aa, Amaranthus tuberculatus
GGFGSVHRGILPEGQAIAVKQHKLASSQGDVEFCAEVEVLSCAQHRNVVMLIGYCIEDKRRLLVYEYICNGSLDAHLYGRNQPPLEWFARQKIAVGAARGLRYLHEECRVGCIVHRDMRPNNILLTHDYEPLVGDFGLARWQPDGDTGVETRVIGTFGYLAPEYAQSGQITEKADVYSFGVVLVELLTGRKAVDLTRPKGQQCLTEWARPLLEDGAIDELIDPRLGNRYLEPEVHCLMHAASLCIRRDPHSRPRMSQVLRVLEGDMFMDSSVMSTPRHDVGSRSGRMRLQDRESFSGPIRNEETEVYTGSLSLESLRSALWERERVRN

SEQ ID NO: 3552 - protein, 318 aa, Helianthus annuus
VHRGILPDGQVVAVKQHKLASSQGDQEFCSEVEVLSCAQHRNVVMLIGFCIEDGRRLLVYEYICNGSLDSHLYGRHRDPLEWAARQKIAVGAARGLRYLHEECRVGCIVHRDMRPNNILITHDFEPLVGDFGLARWQPDGDTGEETRVIGTFGYLAPEYAQSGQITEKADVYSFGVVLVELVTGRKAVDLNRPKGQQCLTEWARPLLEEDAIDELIDPRLGNAYSEQEVYCMLQAASLCIKRDPQLRPRMSQVLRILEGDMMMDSSNDVGNRSGRIYMDRQLSPMREMMDGLSSKVAVDSMRHWQREKTRRTTCDDRR

SEQ ID NO: 3553 - protein, 330 aa, Helianthus annuus
AANFLAEGGFGLVHRGILPDGQVVAVKQHKLASSQGDQEFCSEVEVLSCAQHRNVVMLIGFCIEDGKRLLVYEYICNGSLDSHLYGRHRDPLEWAARQKIAVGAARGLRYLHEECRVGCIVHRDMRPNNILITHDFEPLVGDFGLARWQPDGDTGEETRVIGTFGYLAPEYAQSGQITEKADVYSFGVVLVELVTGRKAVDLNRPKGQQCLTEWARPLLEEDAIDELIDPRLGNAYSEQEVYCMLQAASLCIKRDPQLRPRMSQVLRILEGDMMMDSSNDVGNRSGRIYMDRQLSPMREMMDGLSSKVSVDSMRHWQREKTRRTTCDDRR

SEQ ID NO: 3554 - protein, 749 aa, Solanum phureja
MSKEVKKGKQEGKSSGDVAEKVMVAVKASKEIPKNALVWALTHVVQPGDYITLLVVVPSQSSGRKMWGFPMFAGDCANGPQKSHSGNSSEQKSDLTDSYSQMILQLQDVYDPTKINLKIKVVSGSPHGAVAAEAKKSQANWVVLDKHLKHEKKCCMQELHCNIVVMKRSQPKVLRLNLVGSPKKEPDVSGSLSSEKAQSCGPELEKNYSLASSRGPLVTPTSSPEIFSVTEAGTSSVSSSDPGTSPFFVAEVNRDLHKAELLALKEDQDVDDSSSESESENLSCSSSRFQPWVVDSVSSHCQLSQRQQISSMRSFDRPQTSTTNSLLEKFTKLDTEGGSGSPSYRDDMDYNRNLRESGTLTRSAPLGPPPLCSICQHKAPVFGKPPRWFTYTELELATGGFSQANFLAEGGYGSVHRGVLPDGQVVAVKQHKLASSQGDQEFCSEVEVLSCAQHRNVVMLIGFCIEDRRRLLVYEYICNGSLDSHLYGRNKEPLEWSARQKIAVGAARGLRYLHEECRVGCIVHRDMRPNNILITHDFEPLVGDFGLARWQPDGDTCVETRVLGTFGYLAPEYTQSGQITEKADVYSFGVVLVELVTGRKAVDLNRPKGQQCLTEWARPLLEECAIDELIDARIGSSYKEHEVYCMVHAASLCIRQDPQTRPRMSQVLRILEGDLMMDSGKMSTTPRYDVGSQSGRILSNHLMQYERYSGSIRNDELEGLSPKLSFDKRNPSIIWDRNSSHRTAFSNHL

SEQ ID NO: 3555 - protein, 741 aa, Solanum lycopersicum
MSKEVKKGKQEGKSSCDVAEKVMVAVKASNEIPKNALVWALTHVVQPGDYITLLVVVPSQNSGRKIWGFPMFAGDCANGPRKSHSSEQKSDLTYSYSQMILQLQDVYDPTKINLKIKIVSGSPHGAVAAEAKKSQANWVVLDKHLKHEKKCCMQELHCNLVVMRRSQPKVLRLNLVGSPKKEPDVSGSLSSEKAQSCGPELEKNYSLASSRGPLVTPTSSPEIFSVTEAGTSSVSSSDPGTSPFFVTEVNRDLHKAELLALKEDQDVDDSSSESESENLSCSSSRFQPWVVDSVSSHCQLSQHQQISSMRSLDRPQTSTTNSLSEKFTKLDKEGDSGSLSYRDDMDYNRNMRGSGTLTRHAPLGPPPLCSICQHKAPVFGKPPRWFTFTELELATGGFSQANFLAEGGYGSVHRGVLPDGQVVAVKQHKLASSQGDQEFCSEVEVLSCAQHRNVVMLIGFCIEDRRRLLVYEYICNGSLDSHLYGRNREPLEWSARQKIAVGAARGLRYLHEECRVGCIVHRDMRPNNILITHDFEPLVGDFGLARWQPDGDTCVETRVLGTFGYLAPEYTQSGQITEKADVYSFGVVLVELVTGRKAVDLNRPKGQQCLTEWALPLLEECAIVELIDARLGSSYKEHEVYCMVHAASLCIRQDPQTRPRMSQVLRILEGDLMMDSGKMSTTQPRYDVGSQSGRILYERYSGSIRKDELEGLSPKLSFDKRSPSIIRDRDSSHRTAFSDHL

SEQ ID NO: 3556 - protein, 403 aa, Triphysaria pusilla
KKDKLISIKQEHDHEPDSESDTENESLSSSSMRFQNIDYGGSLREAISFSRAGPCGHPPLCSICQHKTPVFGKPPRWFTYAELEHATGGFSKANFLAEGGYGSVHRGVLSDGQTIAVKQHKLASSQGDQEFCSEVEVLSCAQHRNVVMLIGFCIEDGRRLLVYEYICNGSLDSHLYGRHQNTLSWSARQKIAIGAARGLRYLHEECRVGCIVHRDMRPNHILITHDFEPLVGDFGLARWQPDGETGVDTRVIGTFGYLAPEYAQSGQITEKADVYSFGVVLVELVTGRKAVDLNRPKGQQCLTEWARPLLEAYDIDELVDPRLGSNFSEGEVYSMLHAASLCIRRDPQVRPRMSQVLRVLEGDGMDSGQLTPGFDVGSRSGRIMSGHTINELSGRFSSKLCPN

SEQ ID NO: 3557 - protein, 224 aa, Phaseolus coccineus
QGDLEFCSEVEVLSCAQHRNVVMLIGFCIEDKRRLLVYEYICNGSLDSHLYGRQKDPLEWSARQKIAVGAARGLRYLHEECRVGCIIHRDMRPNNILITHDFEPLVGDFGLARWQPDGDTGVETRVIGTFGYLAPEYAQSGQITEKADVYSFGVVLVELVTGRKAVDLTRPKGQQCLTEWARPLLEEYATEELIDPRLDNHYSENEVYCMLHAASIMHTARSSM

SEQ ID NO: 3558 - protein, 318 aa, Triticum aestivum
MAMAEQQQQIEHSHLAIRGLNLHVAQAGTGELGTVLFLHGFPEIWYSWRHQMLAVAAAGYRAIAPDWRGYGLSDQPPEPEAAVYRDLEEDLLAVLDALSVPKAYLVAKDFGAMPAYDFALRHPNRTCGVMCLGIPFLHGGSSFTAMPEGFYILRWREPGRAEADFGRYDVKRVVRTIYILFSRSEIPTAKEDQEIMDLADLSTPLPEWFTEEDLAVYTSLYEKSGFVYPLQMPYRSLHKRHPIEDPKFEVPVFVVMGEKDYVIKFPGVEAVLKNGTMEKFAPDLKITYIPEGSHFVQEQFPDKVNELLLGFLKDHPVA

SEQ ID NO: 3559 - protein, 318 aa, Pseudoroegneria spicata
  misc_feature (58)..(58): Xaa can be any naturally occurring amino acid
MAMVEQQQQIEHSHLAIRGLNLHVAQVGTGELGTVLFLHGFPEIWYSWRHQMLAVAAXGYRAVTPDWRGYGLSDQPPEPEAAAYSDLIEDLLAVLDALSVPKAYLVAKDFGTMLAYDFALRHPNRTCGVICLGIPFLHGGSSFTAMPEGFYILRWREPGRAEADFGRYDIKRVVRTIYILFSRSEIPIAKEDQEIMDLADLSTPLPEWFTEEDLAVYTSLYEKSGFVYPLQMPYRSLHKGQPIEDPKFEVPVFVVMGEKDYVIKFPGVEAVLKNGTMEKFAPDLKITYIPEGSHFIQEQFPDKVNELLVGFLKDHPVA

SEQ ID NO: 3560 - protein, 318 aa, Leymus cinereus x Leymus triticoides
  misc_feature (264)..(264): Xaa can be any naturally occurring amino acid
  misc_feature (315)..(315): Xaa can be any naturally occurring amino acid
MAMVEQQQQIEHSYLAIRGLNLHGAQVGTGELGTVLFLHGFPEIWYSWRHQMLAVAAAGYRAVAPDWRGYGLSDQPPEPEAAAYSDLEEDLLAVLDALSVPKAYLVAKDFGAMPAYEFALRHPNRTCGVMCLGIPFLHGGSSFTGMPEGFYILRWREPRRAEADFGRYDVKRVVRTIYILFSRSDIPIAKEDEEIMDLADLSTPLPEWFTEEDLAVYTSLYEKSGFVYPLQMPYRSLHKRQPIEDPKFEVPVFVVMGEKDYVFXFPGVEAVLKNGTMEKFAPDLKITYIPEGGHFVQEQFPDKVNELLVGFLKDXPVA

SEQ ID NO: 3561 - protein, 317 aa, Avena sativa
MATVEQPQIKQSHLAIRGLNLHVAQAGTGELGTVLFLHGFPEIWYSWRHQMLAVAAAGYRAVAPDWRGYGLSDQPPEAEEASYADLQEDLLALLDALSVPKVFLVAKDFGTMPAYDFALCNPNRTCGVMCLGIPFLHGGSSFTTLPEGFYILRWREKGRAEADFGRYDVKRVVRTIYILFSRSEIPIANEDQEIMDLADLSTPLPEWFTEEDLAVYTSLYEKSGFRYPMEMPYRSLHKRQPLEDPKFQVPVFVVMGEKDYVFKFPGIEAVLKDGTMAKFAPDLKVTYIPEGSHFVQEQFPEMVNELLLSFLKDHPVA

SEQ ID NO: 3562 - protein, 318 aa, Oryza sativa
MATAEQRQIEHVHLPVRGLTLHVAQAGKGELGTVVFLHGFPEIWYSWRHQMLAVAAAGYRAVAPDWRGYGLSDQPPEPEAAVYDDLIEDLLAILDALAVPKAFLVGKDFGAMPAYDFALRHPNRTCGVMCLGIPLGTAGLSFDTLPEGFYILRWAQPGRAEADFGKYDVKRVVRTIYILFSRSEIPIAKENQEIMDLADLSTPLPEWFSEEDLDVYSSLYENSGFRYPLQMPYRSLHQRKPIGDAKFQVPVFIVMGEKDYVFKFPGIESAMKDGTMEKHAPNIKITYIPEGGHFVQEQFRDYVNELLLGFLKDHPVVI

SEQ ID NO: 3563 - protein, 224 aa, Pseudoroegneria spicata
IRLRNYRFFYMFVFSTTLLCLYVFGFSWVYIIKIRDAEQITIWKAMAKTPASIALVVYTFIAVWFVGGLSVFHLYLMSTNQTTYENFRYRYDQRANPYNRGVVENIKEIFFTPIPASRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 3564 - protein, 169 aa, Hordeum vulgare
VVYTFIAVWFVGGLSVFHLYLMSTNQTTYENFRYRYDQRANPYNRGVVENIKEIFFTPIPASRNDFSARVPQEQGLRPRSTNGFMSPNMGRAVGDIEMGRKPVAWDEPRMAAEIGDLGGLGNLLEDKDGRFRNTSPDLSRDALVVGGLDEQGSSVMNPPRTSWGVEAGR

SEQ ID NO: 3565 - protein, 171 aa, Hordeum vulgare
ALVVYTFIAVWFVGGLSVFHLYLMSTNQTTYENFRYRYDQRANPYNRGVVENIKEIFFTPIPASRNDFGARVPQEQGLRPRSTNGFMSPNMGRAVGDIEMGRKPVAWDEPRMAAEIGDLGGLGNLLEDKDGRFRNTSPDLSRDALVVGGLDEQGSSVMNPPRTSWGVEAGR

SEQ ID NO: 3566 - protein, 169 aa, Brachypodium distachyon
YLYMFIAVWFVGGLSVFHLYLMSANQTTYENFRYRYDQRANPYNRGVVENIKEIFFTPIPASRNNFSARVPQEQGLRPRSTNGFMSPNMGRAVGDIEMGRKPVAWDEPRMAAEIGDLGGLGNLLEDKDGRFRNTSPDLSRDALVVGGLDEQGSSVMNPPRTSWGVEAGR

SEQ ID NO: 3567 - protein, 346 aa, Pennisetum glaucum
ELMDNFSYGMGLSVMIAAVLFTAYDLSLLLLTSGRDPGIIPRNAHPPEPEGFDGNAEVGANQTPPLRLPRVKDVVVNGITVKTKYCDTCMLYRPPRCSHCSICNNCVERFDHHCPWVGQCIGLRNYRFFYMFVFSTTLLCLYVFGFCWVYIIKIRNAEQITIWKAMAKTPASIALIIYTFIAVWFVGGLSVFHLYLMSTNQTTYENFRYRYDQRANPYNRGVVENIKEIFFTPIPPSKNNFRGRVPQEHGLRPRATNGFMSPNMGRAVGDIEMGRKPVAWDEPRMAAEIGDLGAGLSNLLEDKDGRFRSASPDLSRDALAVGGGLEEQGSSAMNPGRTSWGVEAGR

SEQ ID NO: 3568 - protein, 304 aa, Saccharum officinarum
MHILQNAEGFDGNAEVGANQTPPVRLPRVKDVVVNGITVKTKYCDTCMLYRPPRCSHCSICNNCVERFDHHCPWVGQCIGLRNYRFFYMFVFSTTLLCLYVFGFCWVLIVKIRNAEQITIWKAMAKTPASIALIIYTFIAVWFVGGLSVFHLYLMSTNQTTYENFRYRYDQRANPYNRGVIENIKEIFFTTIPPSKNNFCGRVQQEHGLRPRPTNGFMSPNMGRAVGDIEMGRKPVAWDEPRMAAEIGDLGAGLSNLLEDKDGRFRSASPDLSRDALAVGGGLEEQGSSAMNPGRSSWGVEAGR

SEQ ID NO: 3569 - protein, 318 aa, Sorghum bicolor
MNGASASAGVGTGAGAAGEAPLVYKAWKGNNVFLLKGRFIFGPDARSLFVTMFLIIAPASIFCAFVAKGLMDRFSYALGLPVMIAAVLFTAYDLSLLLLTSGRDPGIIPRNAHPPEPEGFDGNAEVGANQTPPVRLPRVKDVVVNGITVKTKYCDTCMLYRPPRCSHCSICNNCVERFDHHCPWVGQCIGLRNYRFFYMFVFSTTLLCLYVFGFCWVLIVKIRNAEQITIWKAMAKTPASIALVIYTFIAVWFVGGLSVFHLYLMSTNQTTYENFRYRYDQRANPYNKGIIENIKEIFFTTIPPSKNNFCGRVHRSMV

SEQ ID NO: 3570 - protein, 157 aa, Festuca arundinacea
ARGLVPLYLMSTNQTTYENFRYRYDQRTNPYNRGVVENIKEIFFTPIPVSRNNFGARVPQEQGLRPRSMNGFMSPNMGRAVGDIEMGRKPVAWDEPRMAAEIGDLGGLGNLLEDKDGRFCNASPDLSRDALAVGGLDEQGSSAMNPPRTSWGVEAGK

SEQ ID NO: 3571 - protein, 124 aa, Zea mays
MENIKEIFFTTIPPSKNNFCGRVDQEHGLRPRPTNGFMSPNMGRAVGDIEMGRKPVAWDEPRMAAEIGDLGAGLSNLLEDKDGRFRTTSPDLSCDTLAVGGGLEEHGSSAMNPGRSSWGVEAGR

SEQ ID NO: 3572 - protein, 180 aa, Setaria italica
AKTPASIALIIYTFIAVWFVGGLSVFHLYLMSTNQTTYENFRYRYDQRANPYNRGVVENIKEIFFTPIPPSKNNFRGRVLQEHGLRPRATNGFMSPNMGRAVGDIEMGRKPVAWDEPRMAAEIGDLGAGLSNLLEDKDGRFRSASPDLSRDALAVGGGLEEQGSSAMNPGRTSWGVEAGR

SEQ ID NO: 3573 - protein, 971 aa, Brachypodium distachyon
MEAATRRRALLLLVLVASSVPAGLCATNAQDVSALRSLMGQWSNVPSSWSATAGDPCGAAWDGLMCDANGRVTSLRLSSVNLQGTLSNSIGQLSQLMFLDLSFNIGLEGTMPASVGNLAQLTTLILAGCSFTGSIPQELGNLQKMTFLALNSNKFSGGIPASLGLLSKLFWLDLADNQLTGPVPISTATTPGLNLLTGTKHFHFNKNQLSGTLTGLFNSNMTLIHILFDSNQFSGSIPAEIGSISSLQVLRLDRNKLVGAVPNITNLVKLNELNLATNRLTGLLPDLSTMSVLNVVDLSKNAFDAQVAPNWFTTLTSLTSVSISSGKLSGVVPKALFTLPQLQEVVLDNNQFNGTLEISGSISKQLQTVDLRFNSIFDTATTSYKKALVLLGNPVCADAAFSGQPFCSIQQENTIAYTTSTSKCSLTSTCRSDQSMNPANCGCAYSYNGKMVFRAPFFKDLTNSDTFQQLETSLWTQLKLRDGAVSLSKIHFNSDNYLQVQVNLFPSSGALFNVSELISIGFDLSNQTYKPPANFGPYYFIADPYVPLAVAVDGGKKSKFSTGAIAGIAAAGGLLVIALIFVGLFALRQKRRAKELAERTDPFASWGAAQKDSGGAPQLKGARFFSFEELKSCTDNFSDSQEIGAGGYGKVYKGTLVDGMRVAIKRAQSGSMQGAPEFKNEIELLSRVHHRNLVSLIGFCYEQKEQMLVYEFVSNGTLRENLVVRGSYLDWKKRLRIALGSARGLAYLHELADPPIIHRDVKSTNILLDDNLKAKVADFGLSKLVADTEKGHVSTQVKGTLGYLDPEYYMTQQLSEKSDVYSFGVVMLELVSGRQPIEKGKYIVREVRQAIDPADRDHYGLRAIVDPAIRDAARTAGFRRFVQLAMQCVDESAAARPAMGTVVKEVEAMLLNEPAGDGGVSSAGSSATEFEGAGRGAPAHPYSDVEITRGSYGGGGDTASDYMPYFEVKPK

SEQ ID NO: 3574 - protein, 418 aa, Avena sativa
VDGGKNSKFSTGAIAGIAAGGGVPVIALILVALFALRQKRKNQELKVQANPFASWGTMQKDSGGAPQLKGARFFSFEELKACTENFSDSYEIGAGGYGKVYKGTLVDGIRVAIKRAQSGSMQGAPEFKNEIELLSRVHHRNLVSLIGFCFEQGEQMLVYEYVAGGTLRENLVVRGSYLDWKKRLRITLGSARGLAYLHELADPPIIHRDIKSTNILLDENLKAKVADFGLSKLLADTEKGHVSTQVKGTLGYLDPEYYMTQQLSEKSDVYSFGVVMLEMVSGRQPIEKGKYIVREVRQVLDPADRDYYGLRAIVDPAIRDAARTAGFRRYVQLAMQCVDESAAARPAMGTVVKEVEAMLLNEPDGDGANSAGSSATEFDGAGRGAPPHPYSDVEITGSSYAGGEGASDYMPYFEVKPK

SEQ ID NO: 3575 - protein, 969 aa, Oryza sativa
MEPRVLMALALVVVAAGVPAVLCQTNAQDAAALEGLKSQWTNYPLSWNSGDPCGGGWDGIMCTNGRVTTLRLSSVSLQGTLSSSIGQLGQLTYLDLSFNINLGGPLPAEIGNLGELTTLILAGCSFTGNIPIAIGNLRKLGFLALNSNKFSGGIPSSIGVLTNLLWLDLADNQLTGSVPISTSTSPGLDQLVKTQHFHFNKNQLTGTLTGLFNSNMTLIHILFDSNKFSGSIPAEVGTVSTLEVLRLDRNGFTGAIPATIGSLVKLNELNLANNKLTGSVPDLSNMTNLNVVDLSNNTFDPSVAPSWFTSLTSLASVSIVSGSLSGQVPKGLFTLPTLQQVVLSNNQFNGTLEITGNISSSLQTVNLMDNRIVSTDTASYKKTLLLAGNPFCAEQDPNNRAFCSRQLQNASPYSTSMEKCGSAQCSDGQNVNPASCGCAFSYNGKMVFRAPFFVDLVSSTPFQLLESTMAAKLNLLPGSVALSDIHFNSDNYLQVQVKLFPTSGVTFNLSELTRIGSSLSNQIYKPPANFGPYFFIADPYAPLAVALGGKKSKMSTGAIAGIAVAGGVLVIALIFMSLFALRQKRRAKELKERADPFASWAAGQKDSGGAPQLKGARFFSFDELKICTNNFSDNHEIGSGGYGKVYRGILGDGTRVAIKRADRNSMQGAVEFKNEIELLSRVHHRNLVSLIGFCYEQGEQMLVYEYISNGTLRENLTGSGMYLDWKKRLRIALGSARGLAYLHELADPPIIHRDIKSTNILLDNNLKAKVADFGLSKLVADTEKGHVSTQVKGTLGYLDPEYYMTQQLSEKSDVYSFGVVMLELVSGRQPIEKGRYVVREVRLAIDPADHDHHYGLRGIVDPAIRDAARTPVFRRFVQLAMRCVDESAAARPAMGAVVKEIEAMLQNEPDDAGAGEGDSSADPSANEFDRHRGGGGPPAHPYSDVEISRGSYAGDGASDYMPYFEVKPK

SEQ ID NO: 3576 - protein, 974 aa, Zea mays
MEEATRRRITPTTTLLLALAVLAASVPAGFCAINPQDASALNAIQSQWTNAPLSWSSASDPCDGGWDGIMCSNGRVTSLRLSSVNIQGTLSDSVGQLTQLMYLDVSFNLGLNGRMPATIGNLAQLTTLILAGCSFTGAIPQQLGNLQQLSFLALNSNKFTGTIPPTLGLLSNLFWLDLADNQLTGSIPVSTATTPGLDQLTHTKHFHFNKNQLSGTLTGLFNSNMSLIHILFDSNQLTGPIPEELGGISSLQVLRLDRNSLKGTIPPNISNLVNLNELNLASNQLTGPLPDLSSMTKLNVVDLSNNSFAVSAAPNWFTTLTSLTSVSISSGKLSGAVPKGLFRLPQLQQVVLSNNEFNGTLEVTGNISSQLQAINLMNNGIAAANVTPSYNKTLVLLGNPGCVDPELKVFCSLKQERMIAYNTSLAKCSSTASCSSDQRLNPANCGCAYPYAGKMVFRAPLFTDLTNSATFQQLEASFTTQLSLRDGSVFLSDIHFNSDNYLQIQVALFPSSGVSFSVADLIRIGFDLSNQTYKPPSNFGPYYFIADPYALLAGASSRGSKKSHISTGAIAGIAVAGGILVIALIGMVLFALRQKRRVKEVTGRTDPFVSWGVSQKDSGGAPQLKGARLFSLNELKNCTNNFSDTHEIGSGGYGKVYKGTLVDGTRVAIKRAERGSMQGVVEFKNEIELLSRVHHRNLVSLIGFCYEQGEQMLVYEYVSSGTLRENLLVRGTYLDWKKRLRIALGSARGLAYLHELADPPIIHRDVKSTNILLDDHLKAKVADFGLSKLVADTQKGHVSTQVKGTLGYLDPEYYMTQQLSEKSDVYSFGVVMLELVSGRQPIESGKYIVREVKLAIDPNDRDHYGLRGLLDPAIRDNARTAGFRRFVQLAMLCVDESAAARPAMGEVVKDIEAMLQNEVSGPDGATSSAGSSANDFDGAGGGARSHPYSDVEITRGSYGDNASDYMPYFEVKPK

SEQ ID NO: 3577 - protein, 950 aa, Zea mays
MEEATRRRITPTTTLLLALAVLAASVPAGFCAINPQDASALNAIQSQWTNAPLSWSSASDPCDGGWDGIMCSNGRVTSLRLSSVNIQGTLSDSVGQLTQLMYLDVSFNLGLNGRMPATIGNLAQLTTLILAGCSFTGAIPQQLGNLQQLSFLALNSNKFTGTIPPTLGLLSNLFWLDLADNQLTGSIPVSTATTPGLDQLTHTKHFHFNKNQLSGTLTGLFNSNMSLIHILFDSNQLTGPIPEELGGISSLQVLRLDRNSLKGTIPPNISNLVNLNELNLASNQLTGPLPDLSSMTKLNVVDLSNNSFAVSAAPNWFTTLTSLTSVVLSNNEFNGTLEVTGNISSQLQAINLMNNGIAAANVTPSYNKTLVLLGNPGCVDPELKVFCSLKQERMIAYNTSLAKCSSTASCSSDQRLNPANCGCAYPYAGKMVFRAPLFTDLTNSATFQQLEASFTTQLSLRDGSVFLSDIHFNSDNYLQIQVALFPSSGVSFSVADLIRIGFDLSNQTYKPPSNFGPYYFIADPYALLAGASSRGSKKSHISTGAIAGIAVAGGILVIALIGMVLFALRQKRRVKEVTGRTDPFVSWGVSQKDSGGAPQLKGARLFSLNELKNCTNNFSDTHEIGSGGYGKVYKGTLVDGTRVAIKRAERGSMQGVVEFKNEIELLSRVHHRNLVSLIGFCYEQGEQMLVYEYVSSGTLRENLLVRGTYLDWKKRLRIALGSARGLAYLHELADPPIIHRDVKSTNILLDDHLKAKVADFGLSKLVADTQKGHVSTQVKGTLGYLDPEYYMTQQLSEKSDVYSFGVVMLELVSGRQPIESGKYIVREVKLAIDPNDRDHYGLRGLLDPAIRDNARTAGFRRFVQLAMLCVDESAAARPAMGEVVKDIEAMLQNEVSGPDGTTSSAGSSANDFDGAGGGARSHPYSDVEITRGSYGDNASDYMPYFEVKPK

SEQ ID NO: 3578 - protein, 975 aa, Sorghum bicolor
MEEATRRRVTSTALLLALVVLAASAPAGFCAINSQDGSALNALKSQWTNAPSSWSSASDPCDGGWDGVMCNNGRVTSLRLSSVNIQGTLSDSIGQLTQLVYLDVSFNIGLNGRMPATIGNLAELTTLILAGCSFTGSIPPELGNLQKLTFLALNSNKFTGTIPPQLGLLSSLFWLDLADNQLTGSIPVTTANTPGLDQLIHTKHFHFNKNQLSGTLTGLFNSNMSLIHVLFDSNQLTGSIPEELGGVSTLQVLRLDRNSLRGAIPPNISNLVNLNELNLASNQLTGSLPDLSSMTQLNVVDLSNNSFAVSVAPNWFSTLTSLTSVSISSGRLSGVVPKGLFTLPQLQQVVLNNNAFNGTLEVTGNINKQLQTINLMNNNIVAANVTPSYNKTLVLVGNPGCQDPDLKSFCSLKQESMIAYNTSLSKCSSTDSCSSDQSLNPANCGCAYPYAGKMVFRAPLFTDLTNSATFQQLETSLTQQLSLRDGSVSLSDIHFNSDNYLQIQVALFPSTAASFSVPDLIRIGFDLSNQTYKPPPNFGPYYFIADTYALLAGAASSGSKKSQISTGAIAGIAVAGGLLVIALIGMVLFALRQKRRVKEVTGRTDPFASWGVSHKDSGGAPQLKGARLFSLNELKTCTNNFSDTHEIGSGGYGKVYKGTLVDGTRVAIKRAERGSMQGVVEFKNEIELLSRVHHRNLVSLIGFCYEQGEQMLVYEYVSNGTLRENLLVRGTYLDWKKRLRIALGSARGLAYLHELADPPIIHRDVKSTNILLDDHLKAKVADFGLSKLVADTQKGHVSTQVKGTLGYLDPEYYMTQQLSEKSDVYSFGVVMLELVSGRQPIESGKYIVREVRMAIDANDRDHYGLRGLLDPAIRDNARTAGFRRFVQLAMRCVDESAAARPAMGEVVKEIEAMLQNEVAGADGGGATSSANSSANEFDGAGGGARSHPYSDTEITRGSYGDNASDYMPYFEVKPK

SEQ ID NO: 3579 - protein, 742 aa, Zea mays
MVQCTQPPPQLKLPESKITEPTDDENQDLPPKPEKRTRMHHIERHRSCVVTLSDIELNGLQPRHLHQPIEISPGGSQCSLHEETPTDTNASHRHAIADAAWEALKRSMVYFRGQPIGTVAAIDKSQGAALNYDQVFMRDFIPSALAFLMKGEHLIVKNFLVETARLQSREKMVDLFKLGQGVMPASFKVHHRNPTQKTESLLADFGETAIGRVAPVDSGLWWIILLRAYTKWTGDNSLAESTNCQRAMHLILRLCLSEGCDTSPALLCADGCSMIDRRMGIYGYPIEIQALFFMAMRCALSLLKQESDADFVNHITKRIQALSYHLHSYYWLDFQRLNDIYRYKTEEYSQTALNKFNVMPESIPDWIFDFMPSRGGYFIGNVSPARMDFRWFCLGNFIAILSSLATGEQAEAILDLVEERWQELIGEMPLKICYPAMENQEWQIVTGCDPKNTRWSYHNGGSWPVLLWLLVAVSVKLGRPHLARRAVELMEQRLAKDDFPEYYDGKAGRYPLRARAKPAGLQLHLLPFPRLRVACATAAGEAPPVEQRDEVEPASAAASNGTAVKVEASAAKPESPPAPAPVPAFRDARWVNGTWDLTKFDKGGGVDWDAVIDAEARRRKWLEDYPEATSTDDAVVFDTSIIPWWAWMKRFHLPEAEKLNGRAAMVGFFMAYFVDSLTGVGLVDQMGNFFCKTLLFVAVAGVLLVRKNEDVESLKKLIDETTFYDRQWQATWQDDPTEGPKN

SEQ ID NO: 3580 - protein, 407 aa, Triticum aestivum
CPGTAPSPSPTPPPSVPSKPKKSFWKRIRTGVLIAIAAAGGVLLLLLILVVCICIFKRKKHAEPTAASSSKGKAIAGGRTDTPKEDYSSSVQEAERNKLVFFEGSSYNFDLEDLLRASAEVLGKGSFGTTYKAVLEDSTTVVVKRLKEMVVGKKDFEQQMEIVGRIGQHQNIVPLRAYYYSKDEKLLVYDYVPAGSLAAVLHGNKATGRAALDWETRVKISLGMARGLAHLHAEGSGKFIHGNLKSSNILLSQNLDGCVSEFGLAQLMTTLPAPARLIGYRAPEVLETKKPTQKSDVYSFGVLLLEMLTGKAPLRSPGREDSVEHLPRWVQSVVREEWTAEVFDVDLLRHPNIEDEMVQLLQVAMACVAVAPDQRPKMDEVIRRIAEIRNSYSGPASPPEETGAQAP

SEQ ID NO: 3581 - protein, 320 aa, Setaria italica
VQEAERNKLVFFEGSSYNFDLEDLLRASAEVLGKGSYGTTYKAVLEDGTTVVVKRLKEVVVSKKDFEQQMEIIGRVGQHQNVVPLRAYYYSKDEKLLVFDYVPSGSLAAVLHGNKSAGRAPLDWETRVKISLDVARGIAHLHAEGGGKFIHGNIKASNVLLSQNQDGCVSEFGLAQLMTTPQAAPRLVGYRAPEVLETKKSTQKSDVYSFGVLLLEMLTGKAPLRSPGREDSIEHLPRWVQSVVREEWTAEVFDVDLLRHPNVEDEMVQMLQIAMACVAAVPDQRPKMEEVIRRITEIRNSYSSGTRTPLEDKPETAQAP

SEQ ID NO: 3582 - protein, 189 aa, Pennisetum glaucum
LAGKELDSELLYKLSHQNFNPLRQAEKSRNGRLPLPKLRHLNLSNNNLSGPIPPTLQKFPASSFLGNAFLCGYPLDPCSGTAPSPSPVSPPAPSKTKKSSWKKIKTIVIIAIAAIGGVLLLILILMLLICIFKRKKHTEPTTASSKGKAVAGGRAENPKEDYSSGVQEAERNKLVFSREVHIILTWKIY

SEQ ID NO: 3583 - protein, 251 aa, Pennisetum glaucum
MEIIGRVGQHQNVVPLRAYYYSKDEKLLVFDYVPSGSLAAVLHGNKSAGRAPLDWETRVKISLDVARGIAHLHAEGGGKFIHGNIKASNVLLSQNQDGCVSEFGLAQLMTTPQAAPRLVGYRAPEVLETKKSTQKSDVYSFGVLLLEMLTGKAPLRSPSREDSIDHLPRWVQSVVREEWTAEVFDVDLLRHPNVEDEMVQMLQIAMACVAAVPDQRPKMEEVIRRITEIRNSYSSGTRTPLEDKPETAQAP

SEQ ID NO: 3584 - protein, 633 aa, Sorghum bicolor
MWHLKLIAFLYGSLFFMHLPYARGSDLNTDKQALLAFAASLPHGRKVNWTSTTQVCTSWVGITCTLDGTRVREVRLPAIGLFGPIPSGTLGKLDALEVLSLRSNRLTINLPPDVPSIPSLRSLYLQHNNLSGIIPSSLSSSLTFLDLSYNSFNGEIPSEVQAITELTALLLQNNSLSGPIPDLRLPKLRHLDLSNNNLSGPIPPSLQKFPATSFLGNAFLCGFPLEPCPGTPAPSPSPPSPQNGKRSFWKKLSRGVKIAIAAGGGAVLLILILILLVCIFKRKRDAEHGAASSSSKGKSIAGGRGEKSKGEYSSGVQEAERNKLFFFEGCSYNFDLEDLLRASAEVLGKGSYGTTYKAVLEDGTTVVVKRLKEVVAGKREFEQQMELIGKVCQHQNTVPLRAYYYSKDEKLLVYDYVPLGSLCAALHGNKAAGRTPLDWETRVKIALGAARGMAYLHAEGGGKFIHGNIKSSNILISQELSACVTEFGLAQLMATPHVHPRLIGYRSPEVLETRKPTQKSDVYSFGVLLLEMLTGKAPLRSPGRDDSIEHLPRWVQSVVREEWTSEVFDVDLLRHPNVEDEMVQMLHVAMACVAVVPDERPRMEEVVSRIEEIRSSYSETKTSPEDNPREGAF

SEQ ID NO: 3585 - protein, 186 aa, Triticum aestivum
LVFNTYLWWCTGLRFRVMNGPIAEAREEDAVWVSTEEAYGMAFRDMLQWVRDKMDFNTTRVFFTSMSPTHGKSQDWGDAPGGNCYNETAMIEDAGYWGTDGRRSVMRVIREILDGDGADVPLTFLNVTQLSMYRKDAHTSIYKKQWNPLTPEQVADPRTYADCVHWCLPGLQDTWNELLYSKLFYP

SEQ ID NO: 3586 - protein, 458 aa, Brachypodium distachyon
MKAPLHPSSPASAAFLCKKARLSPLLLVSLLFMLLFSFLYGEELTALISQQARAWPRLNIHNDDSDHQPVAPPPPARHNDDSDHLRKKKWEGRLPFAVNDEDEDEECELFSGSWVWDEEAHPLYREEDCPYIQPQLACQAHGRPDKAYRSWRWQPHDCTLPVFNATLMLETLRDKRMMFVGDSLNRGQFTSMVCLLQSAIPSADAKSFEMSPDQQHTVFTARAYNATVEFYWAPFLLQSNADDAVVHRISDRTVRNGSIAHHGRHWKGAHVLVFNTYLWWCSGLRFRIMNGPIEEAANTESTVWVSTEEAYGMAFRDMLQWTRDNMDFNKTRVFFTSMSPTHGKSQDWGGAAGGNCYNETAMVQDAEYWGTDSRRSVMRVIGDILDGDGADVPLTFLNITQLSMYRKDAHTSIYKKQWNPLTAEQLADPKSYADCVHWCLPGLQDTWNELLYTKLFYP

SEQ ID NO: 3587 - protein, 458 aa, Sorghum bicolor
MKAPLSSSSTVSSIAKKARSSPLLLALALCLLCFSFLYGEDLKELLARHGEEASRLIANTYSTNIFEHEQSTAPPPSEVAATTKRKWKGRLAFALNDEDEDEECDVFSGTWVRDDAEHPLYREEACPYIHPQLTCQARGRPDTAYQRWRWQPDDCTLPAFDAVRMLEALRDKRMLYVGDSLGRGQFASMVCLLQSAIPDAGAGARSSFEMSADQQHTVFTAREYNATVEFYWAPFLLESNSDNAAVHRISERMVRRGSIGYHGRHWEGVHVIVFNTYLWWCTGLRFRILNGPWEDAGKETAWEWVSTEEAYGMAFRDMLQWVRDNMDFNSTRVFFTSMSPTHQKSQDWGDAPGGNCYNETTMIEDRGYWGSDGRRSVMQVIREILDGDGADVPLTFLNITQMSMYRKDAHTSIYKKQWSQPTAAQLADPKTYADCVHWCLPGLQDTWNELLYSKLFYP

SEQ ID NO: 3588 - protein, 454 aa, Oryza sativa
MKAPPPPSPVAKRARVSPFVFLLVLFLLLFSFLYGEDLKELLGSQAQARPSLHFNAAAAGDGIELPAATAATTEGRTTTRRWRGRLPFAANGDGEEEEEECDVFSGRWVRDEAARPLYREADCPYIPAQLACEAHGRPETAYQRWRWQPRGCALPAFDAAAMLDRLRGKRVMFVGDSLGRGQFTSLVCLLLAAVPDPAARSFATSPDQQRSVFTAAAYNATVEFYWAPFLLQSNADNAAVHRISDRMVRRGSIGHHGRHWEGADVIVFNTYLWWCTGLQFRILEDGPFDAGGNSSTTTWVSTEEAYAMAFREMLQWAREHMDFATTRVFFTSMSPTHGKSQDWGGGEPGGNCYGETEMIGDAAYWGSDSRRGVMRAIGEVLDGDGADVPVTFLNVTQLSLYRKDAHTSVYKKQWTPPTPEQLADPKTYADCVHWCLPGLQDTWNELLYTKLFYP

SEQ ID NO: 3589 - protein, 272 aa, Hordeum vulgare
YPLLIPSRVRRLLGIPSNTMTSVAAAVALLRLPLARLSSHLRSLPAPPVPSARLRLSAPHRPLCSLLTGHGLAVAAVSEAVAAADEEEFEATEEQQEEEAPPSFVLPRLPRPKLDVKERKELASYAHGLGKKLKSQQVGKGGVTPNLVTAFTDNLESNELLKLKIHGNCPGELPDVIRQLEESTGSIAVDQIGRSVILYRPSSSKMKKREEVARNREEYARNNPRFGKSENAFEERPRNNSAGRRFVKSGSTFRTQQKRRPVASKGSSYSRG

SEQ ID NO: 3590 - protein, 191 aa, Hordeum vulgare
SSTSAPAGTSSRSSPPAAAASPSARPRAGRAARVRARRLPPPRGRAPRRQARQPPLRAATGALKLADFGSAEWFGDGRPMSGLVGTPYYVAPEVVAWREYGEKVDVWSAGVVLYMMLSGAVPFYGATAPEIFEAVLRGNLRFPPRAFAGVSPEAKDLMRRMLCKDVSRRFSTEQVLRHPWIASCGGDAVAG

SEQ ID NO: 3591 - protein, 145 aa, Setaria italica
MGRPSPNHPADPKSPSLSAPPASKKRLSGLTSRCATPRRWHPASASASCAARSAASGSGSGPRAETREKRSPPSQRSSTRWTASASSKAAWSATTWRLAGGGADTRRCTLGSCSARARSSGSASSSRSGSLGVDLSAKGAPVAAA

SEQ ID NO: 3592 - protein, 265 aa, Panicum virgatum
  misc_feature (69)..(69): Xaa can be any naturally occurring amino acid
FGTVRRCHAAATGAPFALKSTPKAPLRALEADPLDLALAEQEPKVHLLVSAPPPASRHLVALHAAFEDXDAVHLVLDLCEGGDLFSLVSARGPLPEPEAADLAAQLADALAGCHRRGVAHRDVKPDNLFFDASGALRLGDFGSAAWFGDGRPMTGLVGTPYYVAPEVVAGTEYTEKVDVWSAGVVLYVMLSGTVPFYGATAGEIFEAVLRGNLRFPPRAFAGVSPEAKDLMRRMLSKDVSRRFSAEQVLRHPWIVSRGGSAAVAC

SEQ ID NO: 3593 - protein, 239 aa, Pennisetum glaucum
MWFEPMTNTTIDIEAAKRGQEFQLGWFADPFFFGDYPASMRSRVGDRLPKFTPEEAALVKGALDFVGINHYTTYYTRHNSTNIIGRLLHNTLADTGTISLPFRNGKAIGDRANSIWLYIVPSGMRSLMNYVKERYNSPPIYITENGMDDGNSPFTSIKDALKDSKRIKYHNDYLTNLAASIKEDGCDVRGYFAWSLLDNWEWTAGYSSRFGLYFVDYKDNLKRYPKSSVQWFKTLLSSS

SEQ ID NO: 3594 - protein, 359 aa, Pennisetum glaucum
RGDLPQALEDRYKGWLDRQIVNDFAAYAETCFKAFGDRVKHWITINEPHTVAVQGYDAGLHAPGRCSVLMHLYCRSGNSATEPYIVAHNFILAHATVSDIYRRKYKANQNGQVGIAFDVIWYEPMTNSTIDIEATKRAQEFQLGWFADPFFFGDYPATMRTRVAERLPKFTAEESALVKGALDFVGINHYTTFYTRHNDTNIIGLLLNNTLADTGTISLPFDKNGKPIGDRANSIWLYIVPSGMRKLMNYVKERYNTPTVYITENGMDDGNSPFTSIKDALKDSKRIKYHNDYLTNLAASIKEDGCDVRGYFAWSLLDNWEWAAGYTSRFGLHFVDYKDNLKRYPKNSVQWFKSLLSSS

SEQ ID NO: 3595 - protein, 960 aa, Sorghum bicolor
MGALRAMLLRRLALLAVAVAVPTVTAAAAPPSEVAVGALFTYDSTIGRAARLAMELAVDDVNADRTVLAGTHLSLLFQDTNCSGFLGTIEALQLMERNVVAVIGPQSSGIGHVISHVVNELHVPLLSFAATDPTLSASEYPYFIRTTISDYFQMNAVASIVDYYQWKEVTAIFVDDDYGRGGVSALGDALAAKRARISYKAAIPPNSNTDVINDVLFKANMMESRVMVVHVNPDTGMRIFSVANKLQMMASGYVWIVTDWLAAVLDSSMPRDRKDMSHLQGLIVLRQHTPESDAKKKFISKWNNAARNRSITYGLNSYGFYAYDSVWAVARGIDQFLNSGQQINFSPDPMLHDSNGSTLHLSTLKIFDGGEQMLQQLLLTNFTGLTGPVQFNSDRNLVHPAYDILNLGGSESRLIGYWSNYSGLSVAPPEILYQKPPNTSSLVQRLHNVVWPGDSTTTPKGWVFPNNGQPLRVGVPIKPSFKELVAGGKGPDNVTGYCIDIFNAAVKLLPYPVPCQFITVGDGRKNPNYDAIINMVAANSLDAAVGDFAIVRNRTKIAEFTQPYIESGLVIVAPVKQATSSAWAFLKPFTLEMWCVTGALFIFVGIVVWILEHRSNEEFRGSPRRQLITIFWFSFSTMFFSHRQNTVSALGRFVLIIWLFVVLIINSSYTASLTSILTVQQLATGITGIDSLVSSGLPIGYQDGKFTKNYLIDELNIPEYRLVPLNTIQEYADALKRGPKDGGVAAIVDEMPYVEIFLSYHCNFRIVGQEFTKEGWGFAFKRDSPLAADLSTAILQLSESGQLQRIHDEWFTGPSCSSDDSEVGATRLGLGSFWGLFLACALICLLALVVFFIRICWQYNKYSNSEAAGEPSAAATAAAAAAAADVAAAAAAATDAVERQRKPSRLGSFKEIIQFVDKKEEEIKRTMKRRLSEKDNQAAGSSDKDNQAAGSSDAHAVASA

SEQ ID NO: 3596 - protein, 1443 aa, Solanum phureja
MEGGENILRVSSARLSGSNVWRNSAMDVFSRSSSREDYDDEEALRWAALEKLPTYRRIRRGLLLEEEEGQSREVDITKLDLIERRNLLDRLVKIADEDNEKLLMKLKQRIDRVGLDLPTIEVRFEHLNIDAEARVGSRALPTIFNFTVNILEDFLNYLHILPSRKKPLPILHGVGGIIKPGRMTLLLGPPSSGKTTLLLALAGKLDNDLKVSGRVTYNGHGMDEFVPQRTSAYISQNDLHIGEMTVRETLAFSARCQGVGTKYEILAELSRREKEANIKPDPDIDIFMKSAWNEGQEANVITDYTLKILGLEICADTLVGDEMIRGISGGQRKRLTTGEMMVGPARALFMDEISTGLDSSTTYQIVNSIRQSIHILQGTAVISLLQPAPETYDLFDDIILLSDGQIVYQGPRENVLEFFEYLGFKCPQRKGVADFLQEVTSRKDQEQYWSRRDEPYRFITACEFSDVFQSFDVGRKLGDELAVPFDKSKSHPAALTTKRYGISKKELLKACTAREYLLMKRNSFVYIFKMVQLTLMASIAMTLFLRTEMHRDTTIDGAIYLGALFYAVITIMFNGFSELALSIMKLPSFYKQRDFLFFPAWAYALPTWILKIPITLVEIAIWVCMTYYVIGFEADVGRFFKQIFLLICLSQMASGLFRFLAALGRNIIVANTFGSCALLIVLVMGGFILSRDDVKQWLIWGYWISPMMYAQNAIAVNEFLGKSWAHVPPNSTGTDTLGVSFLKSRGIFPEARWYWIGAGALFGYVLLFNFLFTVALAYLNRKNLPTIMQSNLISIYSMILTYQQERGNDVPVSTSSRSLSTRVGNITEGDLNKRKGMILPFEPLSITFDDIRYAVDMPQEMKTQGFIEDRLELLKGVSGAFRPGVLTALMGVSGAGKTTLMDVLAGRKTGGYVEGTISISGYPKQQETFARISGYCEQTDIHSPHVTVYESLLYSAWLRLPREVDTETRKSFIEEVMELVELTPLREALVGLPGVNGLSTEQRKRLTVAVELVANPSIIFMDEPTSGLDARAAAIVMRTVRNTVDTGRTVVCTIHQPSIDIFDAFDELLLLKRGGEEIFVGPLGRHSSHLIKYFEGIDGVLKIRDGYNPATWMLEVTSLAQEAVLGIDFTELYKNSELYRRNKALIQELSVPASGSKDLYFETKYSQSFFTQCMACLWKQHWSYWRNPPYTAVRLMFTFFVSLMLGTIFWGLGSKRGKQQDILNAIGSMYAAILFLGIINASSVQPVVAIERTVFYRERAAGMYSALPYAFGQVMIELPHLFLQTIIYGVIVYAMIGFEWTVTKFFWYLFFMYFTLLYFTLYGMMTVAVTPNHTIASIVSSAFYTIWNLFCGFVVPKTRMPVWWRWYYYICPLSWTLYGLIASQFGDLQDRLDTKETVEEFLENFFDYKHDFVGYVAVILVGISVVFLFIFAYSIKSFNFQKR

SEQ ID NO: 3597 - protein, 138 aa, Solanum tuberosum
MLDITSVAQEAALGVDFTELYRTSELYRRNKALIQELSVPAPGSKDLYFQTKYSQSFFTQSMACFWKQHWSYWRNPPYTAVRILFTFFIALMFGTIFWDLGSKRRRQQDIFECHRFNVCFCLVSWGTKCYFSAASRCY

SEQ ID NO: 3598 - protein, 1448 aa, Mimulus guttatus
MKMKTKRGRRNIFSNKTKHGQEEKNKEKLIRVSSARLGSSSIWRNTGMESFSRSEKDAEDDEEALKWAALEKLPTYLRIRRGMLVEDEGKTREVDIKNLGLSERRNLVERLLKIAEEGNEKFLLKLKERIQRVGLDFPTIEVRFENLNVDADAYAGGRALPTIFNFTVNILEGFLSYLRILPNRKKPLPILHDVSGIIKPGRMTLLLGPPSSGKTTLLLALAGKLDPELKISGRVTYNGHEMNEFVPQRTSAYISQHDLHIGELTVRETLAFSARCQGVGARYEMLTELSRREKEANIKPDPDLDIYMKASSIGGQEASVVTDYIIKILGLEVCADTLVGDEMFRGISGGQRKRLTTGEMMVGPARALFMDEISTGLDSSTTFQIVNSIRQSIHILQGTTIISLLQPAPETYDLFDDIILLSDGQIVYQGPRENVLEFFEHMGFRCPERKGVADFLQEVTSKKDQEQYRIQKDETYEYVSVQEFSEAFRSFRIGQELGDELAVPFDKEKSHPTALTTDKYGVSKKELLKACVAREYLLMKRNSFVYIFKMLQLIIVASISLTLFLRTEMPKNNVTDGGIYLGALFFALIMIMFNGFSELALSIMKLPVFFKQRDLLFFPPWAYTLPSWILKIPITLVEVAIWVGMTYYATGYDSDAGRFFRQLLLLICVNQMASALFRLMGALGRNLIVANTFGSCALLTVFVLGGFILSRDDIKKWWIWGFWTSPLMYGQNAIAVNEFLGKSWSHKCSFFTARGLFSEARWYWIGVGAIIGYVFLFNFLVTVALTYLNPFGKPQAILPEEAVAERNAGRGDDVRRSSSSGSMSSRVGTVIGNADPNRKRGMILPFEPLSITFCDIRYAVDMPQEMKAQGIQENRLELLKGVSGAFRPGVLTALMGISGAGKTTLMDVLAGRKTGGYINGTITISGYPKKQETFARIAGYCEQTDIHSPHVTVHESLQFSAWMRLPPEVDTATRKMFIEEVMELVELTPLREALVGLPGVNGLSTEQRKRLTIAVELVANPSIIFMDEPTSGLDARAAAIVMRTVRNTVDTGRTVVCTIHQPSIDIFDAFDELLLLKRGGEEIYVGPLGRHSSQLIKYFEEIDGISKIKDGYNPATWMLDITSTAQEAALGVDFAELYKNSELCRKNKALIEELTVPIPGSKDLYFSKRYSQSFSTQCMACLWKQHWSYWRNPPYTAVRLLFTTFIALLFGTIFWGIGSKRERQQDVFNAMGSMYVAVLFLGIQNATSVQPVVAIERTVFYRERAAGMYSALPYAFGQAVIELPYLLIQTLIYGVIVYAMIGFEWTVVKFFWYIFFMYFTLMYFTFYGMMTVAVTPNHNIAAIVSSAFYGLWNLFSGFIIPKTRIPVWWRWYYYACPIAWTLYGLVASQFGDVQDRLDTDETVAEFVHSYFGFQHDFVGYVAIIITGLAVLFGFIFAFSIRAFNFQKR

SEQ ID NO: 3599 - protein, 291 aa, Pennisetum glaucum
VRMVATECETGGRVVRNRMAAQRAEPGRFVLWQMAPEMWYIELAVGGSKVHAGCNGKLVWRHTPWLGAHAAKGPVRPLRRALQGLDPLTAASMFAGARCIGERKVNGEDCFILKLCADPETLRARSEGLAEIIRHVLFGYFSQKTGLLVHLEDSHLTRIQSTTGGDAVYWETTINSFIEDYRPVEGIMIAHSGRSAVTLFRFGEAAMSHTKTRMEEAWSIEEVAFNVPGLSMDCFIPPTDIKSGSVSETVELPQGEKSKVGLLPCHRAKVAALEKADDNVAWSGALQLDCK

SEQ ID NO: 3600 - protein, 61 aa, Pennisetum glaucum
KLVWRHTPWLGAHAAKGPVRPLRRALQGLDPLTAASMFAGARCIGERKVNGGGLLHSEAVC

SEQ ID NO: 3601 - protein, 473 aa, Sorghum bicolor
STNSPTGPCHPQPGHGHQEAGLLLRATGGGGARAVAGPRAAAVGVQRRGGGGGAAPLMEGPDPEACPGANCGGAGARREGWGQWVRGQLQLARAPAGAGADAGAGAGPAAAARRNDLRLLLGVMGAPLAPVHVCAAEPLPHLSIKDTPIETSSAQYILQQYLAASGGQRLLSSIRNSYAMGKVRMVATEFETGGRVVRNRMAAQRAEPGRFVLWQMAPEMWYIELAVGGSKVHAGCNGKLVWRHTPWLGAHSAKGPVRPLRRALQGLDPLTAASMFAGARCIGERKVNGEDCFILKLCADPETLRARSEGLAEIIRHVLFGYFSQKTGLLVHLEDSHLTRIQSTTGGDAVYWETTINSFIEDYRPVEGIMIAHSGRSAVTLFRFGEAAMSHTKTRMEEAWSIEEVAFNVPGLSMDCFIPPTDIKSGSISETVELPQGEKSKVGLLLCHRAKVAALEKADDNVAWSGALQLDCK

SEQ ID NO: 3602 - protein, 317 aa, Saccharum officinarum
ILQQYLAASGGQRLLSSIRNSYAMGKVRMVATEFETGGRVVRNRMAAQRAEPGRFVLWQMAPEMWYIELAVGGSKVHAGCNGKLVWRHTPWLGAHSAKGPVRPLRRALQGLDPLTAASMFAGARCIGERKVNGEDCFILKLCADPETLRSRSEGLAEIIRHVLFGYFSQKTGLLVHLEDSHLTRIQSTTGGDAVYWETTINSFIEDYRPVEGIMIAHSGRSAVTLFRFGEAAMSHTKTRMEEAWSIEEVAFNVPGLSMDCFIPPTDIKSGSISETVELPQGEKSKVGLLPCHRAKVAALEKADDNVAWSGALQLDCK

SEQ ID NO: 3603 - protein, 258 aa, Avena sativa
AVGGSKVHAGSNGKLVWRHTPWLGAHSAKGPVRPLRRALQGLDPLTTASMFAGARCIGERKVNGDDCFILKLCADPETLRARSEGLAEIIRHVLFGYFSQKTGLLVHLEDSHLTRIQSTTGGDAVYWETTINSFIEDYRPVDGIMIAHSGRSAVTLFRFGEVAMSHTKTRMEEAWSIEEVAFNVAGLSMDCFIPPTDIKSGSISETVELPHSGKSKAGLLPCHGAKVAAADGNVAWSGAWSEIASDTMVCSYCSLQCY

SEQ ID NO: 3604 - protein, 260 aa, Setaria italica
MERLLRCPAGGGGARAVAGPGAPQVRGGGPRRRVQVRRRRWGWWRDAGAAHGGARSGVRRRGGLRRGGGRGARGRKEGWGHWVRGQLARAPSSVAAAAAGAGATRNDLRMLLGVMGAPLAPVQVCTAEPLPHLSVKDTPLETSSAHYILQQYLAASGGHKLLASVRNAYTMGKVRMVATEHETAGRLTKNRNAGRGGEPGRFVLWQMHQRCGTSSWLSVGARCTQGAMASLCGATPHGLVPMLPRALFASFAVPFRAWIH

SEQ ID NO: 3605 - protein, 463 aa, Zea mays
MERRHGFFAALREEVARGLSPARARRKPDATDLAAALSFTGVAGAGEMLAPLMEGPDPEPSDDGDGSGRRGAARGRKEGWGHWVRVQFARAPSSAVALRSDIRMLLGVMAAPLAPVRVCAAEPLPHLSVKDTPIETSSAQYILQQYLAASGGHKLLASLRSTYAMGKVRMVATEFETAGRLTKNRSAGRGGEPGRFVLWQMAPEMWYIELAVRGSKVHAGCNGKLVWRHTPWLGAHSAKGPVRPLRRALQGLDPLTAASMFARARCIGERKVNGEDCFILKLSTDPEILKARSEGHAEIIRHVTFGYFSQRTGLLVHIEDSHLTRIQSAAGGDAVYWETTISSSMEDYRPVDGIVVAHSGRSAVTLFRFGEVAMSHTKTRMEEVWSIEEVAFNVPGLSMDCFIPPTDIKSGSVGEAMELAHGERSRAGPPPPPPGCRAKVAALGKAEEGKVAWGGGTVLENQN

SEQ ID NO: 3606 - protein, 408 aa, Panicum virgatum
  misc_feature (121)..(121): Xaa can be any naturally occurring amino acid
  misc_feature (138)..(138): Xaa can be any naturally occurring amino acid
MDTKKQGFFSALREEVARGLSPARARRRSASNAAEVAAALRVAGGAGEALAPLMEGPDPEAAPGAGGGARREGWGQWVRGQLQLARAPASAAAADAGAARRNDLRLLLGVMGAPLAPVHVXAAEPLPHLSIKDTPIEXSSAQYILQQYLAASGGQRLLSSIRNAYAMGKVRMVATEFETGGRVVRNRMAAQRAEPGRFVLWQMVPEMWYIELAVGGSKVHAGCNGKLVWRHTPWLGAHAAKGPVRPLRRALQGLDPLTAASMFAGARCIGERKVNGEDCFILKLCADPETLRARSEGLAEIIRHVLFGYFSQKTGLLVHMEDSHLTRIQSTTGGDAVYWETTINSFIEDYRPVEGIMIAHSGRSAVTLFRFGEAAMSHTKTRMEEAWSIEEVAFNVPGPLHGLFHPAH

SEQ ID NO: 3607 - protein, 256 aa, Pseudoroegneria spicata
RVVRNRMAARCAEPGRFVLWQMAPEMWYIELAVGGSKVHAGCNGKLVWRHTPWLGAHSAKGPVRPLRRSLQGLDPLTTASMFAGARCIGERKVNGDDCFILKLCADPETLRARSEGLAEIIRHVLFGYFSQKTGLLVHLEDSHLTRIQSTTGGDAVYWETTINSFIEDYRPVEGIMIAHSGRSAVTLFRFGEVAMSHTKTRMEEAWSIEEVAFNVPGLSMDCFIPPTDIKSGSISETVELPQSGKSKVGGLLPCHG

SEQ ID NO: 3608 - protein, 219 aa, Festuca arundinacea
  misc_feature (188)..(188): Xaa can be any naturally occurring amino acid
ARGRPLRRALQGLDPLTTASMFAGARCIGERKVNGDDCFILKLCADPETLRARSEGLAEIIRHVLFGYFSQKTGLLVHLEDSHLTRIQSTAGGDAVYWETTINSFIEDYRPVEGIMIAHSGRSAVTLFRFGEVAMSHTKTRMEEAWSIEEVAFNVPGLSMDCFIPPTDIKSGSISETVELPHSGKSKXGLLPCHGAKVAALEKADGNVAWSGALQRDCK

SEQ ID NO: 3609 - protein, 185 aa, Phaseolus coccineus
  misc_feature (83)..(83): Xaa can be any naturally occurring amino acid
MVMEIARLKEEQKALEEELQGMNKRLETTEKRPQQMMAFLSKVVEDPQVLSRILREREKKHLGEKKRRLLIPPPSTAATSSSXSSGIKTEFEEDEGNIMSSSPETGLEIDNNNNIICSPVTAGYWGEQGCYGYNCGGVTTPLTVVTPAAPAMGGGYLGRGSLFGEMAAEGSALPPYPFSLLEGGF

SEQ ID NO: 3610 - protein, 375 aa, Vigna unguiculata
LLHTHTLSLSFTHSHSLSRTEKNSDTHVHTSHTPSLLVSSSSSSSCSVPFLFFLHGMMEHNIISNTNNINNVIAPFVIKTYNMVNDPTTDKLITWGPANNSFIVLDPLDFSHSLLPAFFKHNNFSSFVRQLNTYGFRKVDPDRWEFANEWFLRGQKHLLRNIVRRKHGGGRSSNLHLHTLKLEELDDEAMVLEIAKLKEEQKALEEELQGMNKRLETTEKRPQQMMAFLSKVVEDPQVLSRILRERERKHLGEKKRRLIPPPSTAATSSSSSSGIKTEFEEDEGNNIMSSSPETGLEIDNNSNNIICSPATAGYWGEQGCYGYNCGGVTTPLTVVTPAAPAMGGGYFGRGSYFGEMAAEGSALPPYPFSLLEGGF

SEQ ID NO: 3611 - protein, 204 aa, Glycyrrhiza uralensis
MEQNNNNVIAPFVVKTYHMVNDPTTDNLIKWGPANNSFIVLDPLDFSISLLPAFFKHNNFSSFVRQLNTYGFRKVDPDRWEFANEWFLRGQKHLLKNIVRKKHVGGVGGRNNHDYNNCNLFYQQGNKVVEDLDDDEAMVTEIAKLKEEQKALEEEIQGMNKRLETTEKRPQQMMAFLCNVVEDPQVLSRILLEREKKQQYHHLA

SEQ ID NO: 3612 - protein, 135 aa, Lotus japonicus
MLMDQNNNTNLNTTNNNTNNDVIIAPFIMKTYHMVNDPTTDNLIKWGPANNSFIVLDPLDFSHSLLPAFFKHNNFSSFVRQLNTYGFRKVDPDRWEFANEWFLRGQKHLLKNITRRKHGGGGGGGGGGRNGHGHG

SEQ ID NO: 3613 - protein, 113 aa, Arachis hypogaea
MEQNNVIAPFVIKTYHMVNDPSTDYLIAWGPANNSFIVVDPLDFSQSLLPAFFKHNNFSSFVRQLNTYGFRKVDPDKWEFANEWFLRGQKHLLKNIVRRKHGTRSYNSLHFNN

SEQ ID NO: 3614 - protein, 317 aa, Prunus persica
MMEENNNVIAPFVMKTYQMVNDPTTDKLITWGRANNSFIVVDPLDFSQRLLPAYFKHNNFSSFVRQLNTYGFRKVDPDRWEFANECFLRGQTHLLRNVVRRKHMGKNSYSNSNSNSTTCLLQGKHEELDDEEIVMEIARLKQEQKALEEEMENMNKRLEATERRPQQMMAFLHKDRTFRAQLGEKKRRVMMITSTSSSSSGMGATNSVKTEDEDDGTVGVISSSPEPGFEMESFYSTSPETSTAREWGTQRRVVDRVRAVQDPYNMNPTVSGHVIGNSSNSGYGYGNRNVGAGVGYLTEEPIPAPPPYPFSLLEGGF

SEQ ID NO: 3615 - protein, 165 aa, Prunus persica
MEENNNVIAPFVMKTYQMVNDPTTDKLITWGRANNSFIVVDPLDFSQRLLPAYFKHNNFSSFVRQLNTYGFRKVDPDRWEFANECFLRGQTHLLRNVVRRKHMGKNSYSNSNSNSTTCLLQGKHEELDDEEIVMEIARLKQEQKALEEVWRTDKRLEELRDDPSK

SEQ ID NO: 3616 - protein, 120 aa, Malus domestica
MGKSSNLNSLFSNSNSNFLPTKHEELNDEDVIMEISRLKQEQKALEEEIGNMNRRLETTERRPQQMMAFLHKVAEDPEILPRMMLEKDRATTAQLGEKKRRVMMIASTSSSSSGMGATTS

SEQ ID NO: 3617 - protein, 186 aa, Trifolium pratense
MEQNNVIAPFIMKTYHMVNEPNTDNLIKWGPSNNSFIVLDPLQFSHSLLPVFFKHNNFSSFVRQLNTYGFRKVDPDRWEFANEYFLRGQKQLLKNIVRKKHVGGVGNGRNNNNYFNEVKFEDLEEDEVMMKEILKLKEEQRILDEELQGMNKRLETTEKRPQQMMAFLCNVVEDPQILSRILNERE

SEQ ID NO: 3618 - protein, 93 aa, Tropaeolum majus
MEANNNVIPPFVMKTYQMVNDPTTDWLITWGKANNSFIVIDPLDFSHRMLPVYFKHNNFSSFVRQLNTYGFRKVDPDVWEFAHECFLRGQSSY

SEQ ID NO: 3619 - protein, 263 aa, Petunia hybrida
MEANNNNIIAPFVMKTYQMVNDPKIDGLITWGSANNSFIVIDPLDFSQKLLPTYFKHNNFSSFVRQLNTYGFRKVDPDKWEFANEWFLRGQTHLLKNIVRKKHSRNNPYFHKHEEDEEEGMFTEIGRLKQEQKLLEQQLENMTRRLETTEKRPHQMMAFLCKVVEDPEILPRIMLEKENKSKKLTFENGEKKRKLIMMTEPCNANTCPATSSSLSSGSSESGGFTMAPLLDNFSRYDYGGAGIVATEEASPPPYPFSMLGGGF

SEQ ID NO: 3620 - protein, 355 aa, Citrus clementina
MEPNNTNNVIAPFVMKTYQMVNDPTTDSLISWGKANNSFIVVDPLDFSQRILPAYFKHNNFSSFVRQLNTYGFRKVDPDKWEFANEWFLRGQKHLLKNIVRRKHSSNRSAHHMMMRGGAGDQDLDDEEIVMEIARLRQEQKSLDEELQGMNKRLEATERRPEQMMAFLYKVVEDPDLLPRIIMEKESTTNRNNYYLGDKKRRLMISSSSQQQQQPSNSSSSGMAASSSIKSEEEEVGNIGVISSSSPDSGFDNSNNNNSNNFCQSSPSPDSNNNNNNYSVSSSGWLLGQSRQVMNSYGCAAIPSPVSAIPATARNSTSSGTSTNGQMGYFGEMVTGVESRPPMPPYPFSLLGGGF

SEQ ID NO: 3621 - protein, 331 aa, Quercus alba
MEGYNVIAPFIMKTYQMVNDPTTDSLITWGRANNSFIVVDPLDFSQRILPAYFKHNNFSSFVRQLNTYGFRKVDPDKWEFANEWFLRGQKHLLVNIVRKKHNRSSYTQGKNEELVEDEDLVMEIARLKKEQKDMEDELEGMKKRLEATEKRPQQMMAFLHKVAEDPDILPNLMLQRERTRQLISEKKRRLMISSTSSSSSGTVAATTTTTTSSIKTEDEDEGAIGVVISSSPNTGFKIENFCEQSSPSPETQTPAWLIQSEVMGRSQIGQEPFGCSAMNGIGSTMAVSPLESGVLGYGNSGGQISYFAEMAAGMEVSPPTPYPFSLLGGGF

SEQ ID NO: 3622 - protein, 355 aa, Citrus sinensis
MEPNNTNNVIAPFVMKTYQMVNDPTTDSLISWGKANNSFIVVDPLDFSQRILPAYFKHNNFSSFVRQLNTYGFRKVDPDKWEFANEWFLRGQKHLLKNIVRRKHSSNRSAHHMMMRGGAGDQDLDDEEIVMEIARLRQEQKSLDEELQGMNKRLEATERRPEQMMAFLYKVVEDPDLLPRIIMEKESTTNRNNYYLGDKKRRLMISSSSQQQQQPSNSSSSGMAASSSIKSEEEEVGNIGVISSSSPDSGFDNSNNNNSNNFCQSSPSPDSNNNNNNYSVSSSGWLLGQSRQVMNSYGCAAIPSPVSAIPATARNSTSSGTSTNGQMGYFGEMVTGVESRPPTPPYPFSLLGGGF

SEQ ID NO: 3623 - protein, 314 aa, Brassica napus
MEDDNNNNTNTNVIAPFVVKTYQMVNDPSTDWLITWGPAHNSFIVVDPLDFSQRILPAYFKHNNFSSFVRQLNTYGFRKVDPDRWEFANEHFLRGQKHLLKNIARRKHARGMVYGQEMEDGEIVREIERLKDEQRDLESEIQRMNQRIEATEKRPEQMMAFLYKVVEDPDLLPRMMLEKERTKLVSDKKKRRVTVKSEDEEENGRVFGIISPTPSPPENLYRTQSPENSMGWVVPMQKPGNFGSYNETGLISTSSTSSSLTSTLSLPESVNGGGGGCGSIQGETRDKEAATFGGVVESNPQTPPYPFSLFRGGF

SEQ ID NO: 3624 - protein, 337 aa, Ricinus communis
MESTNSSNLIAPFVMKTYQIVNDPTTDTLITWGKANNSFIVVDPLDFSQRILPAYFKHNNFSSFVRQLNTYGFRKVDPDIWEFANEWFLRGQKQFLKNIVRRKHSKSSCKIEDFDNEELVMEIARLKQEQRVLDEELEGMNKRLEATERRPQQMMAFLYKVVEDPDILPRMMLQKEQTKQLNSDKKRRLMISSSSSSSGGAAVSSSVKSEEEEEGNIGAISSPESGFGIDNNNNYNNLYQSSPSPETNFIGWLGDGNYGCAEVAPAPITGGIGNSVKLAVSPPPQMPVNGIICYGGGSGGNGGDRGSQTSYFGELATAVEAKPPPPPYPFSLLGGDF

SEQ ID NO: 3625 - protein, 252 aa, Citrus sinensis
MEPNNTNNVIAPFVMKTYQMVNDPTTDSLISWGKANNSFIVVDPLDFSQRILPAYFKHNNFSSFVRQLNTYGFRKVDPDKWEFANEWFLRGQKHLLKNIVRRKHSSNRSAHHMMMRGGAGDQDLDDEEIVMEIARLRQEQKSLDEELQGMNKRLEATERRPEQMMAFLYKVVEDPDLLPRIIMEKESTTNRNNYYLGDKKRRLMISSSSQQQQQPSNSSSSGMAASSSIKSEEEEVGNIGGDFIFFPRFWVR

SEQ ID NO: 3626 - protein, 291 aa, Cucumis sativus
MEPNSGNNDIVAPFVLKTYQMVNDPLTDPFISWGSANNSFIVLDPLHFSHTLLPAFFKHNNFSSFVRQLNTYGFRKVDPDRWEFANEWFLRGQFQLLKNIVRRKQSCNKYLVGDQMGDEELVTEIGRLRKEQRALEEQLEGMKKRLETTEKRPQQMMAFLHKVVEDPEILPRIMLHKDPTRLQFAEKKRRLMISSSSSSPSTTTLTEGDEIEEDSNNQQDFGPNLSSPEVCGPWFIGEAEGNLGIPIPTVQAIDIGISSNGGERKYLTEMTVEETYPPPPPYPFSLFGCGF

SEQ ID NO: 3627 - protein, 111 aa, Thellungiella halophila
MEDDNNNNNTSNTNVIAPFVVKTYQMVNDPSTDWLITWGPAHNSFIVVDPLDFSQRILPAYFKHNNFSSFVRQLNTYGFRKVDPDRWEFANEHFLRGQKHLLKNIARRRPI

SEQ ID NO: 3628 - protein, 335 aa, Arabidopsis lyrata
MEDDNGNNTNNNNNNNVIAPFIVKTYQMVNDPLTDWLITWGPAHNSFIVVDPLDFSQRILPAYFKHNNFSSFVRQLNTYGFRKVDPDRWEFANEHFLRGQKHLLKNIARRKHARGMYGQDLEDGEIVREIERLKDEQRELEAEIQRMNQRIEATEKRPEQMMAFLYKVVEDPDLLPRMMLEKERTKQQVSDKKKRRVTMSTVKAEEEEVEEDEGRVFRVISSSTPSPSSTENLHRNHSPDGWVVPMTQGQFGNYETGLVANSMLSNSTSSTSSSLTSTFSLPESINGGGGGGGGGGCGNIQGERRYKETATFGGVVESNPPTTPPYPFSLFRGGF

SEQ ID NO: 3629 - protein, 330 aa, Arabidopsis thaliana
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 3630 - protein, 184 aa, Castanea mollissima
MEGYNVIAPFIMKTFQMVNDPTTDSLITWGRANNSFIVVDPLDFSQRILPAYFKHNNFSSFVRQLNTYGFRKVDPDKWEFANEWFLRGQKHLLVNIVRKKHNRSSYTQGKNEELVEDEDLVMEIARLKNEQKAMEDELEGMKKRLEATEKRPQQMMAFLHKVVENPNILPNLMLQRERTRQLIS

SEQ ID NO: 3631 - protein, 294 aa, Vitis vinifera
MEAPNNNIIAPFVMKTYQMVNDSSTDALITWGRANNSFIVFDPLDFSQRILPAYFKHNNFSSFVRQLNTYGFRKVDPDRWEFANEWFLRGQRQLLKNIVRKKHSSCGRSSFLLQAKLEDGDEEILAEIERLKHEQKSLEEELEGMTKRLEATERRPQQMMAFLYKVVEDPELIPTMMMEKERRRQLGEKKRRLLIQSTSSSSGTAGTASVKSEEEEDGSTVGIISSPETLSHSSPSPDTSTPAWVRPRQMMGWPLVAQQPYPLAAIPSPIYSGSVTGIGHFNTMSPPPENTISS

SEQ ID NO: 3632 - protein, 337 aa, Fragaria vesca
MSMEDSGNVIAPFVMKTYQMVNDPTTDRLISWGRANNSFIVVEPLEFSQRLLPAYFKHNNFSSFVRQLNTYGFRKVDPDRWEFANECFLRGQTHLLKNVVRRKHTGNHGNNNHRMVNTTAFGKAEELDDEEIVMEIARLRQEQKSLEDEMESMNKRLEATERRPQQMMAFLHRVAEDPEILPRMMLEKDRRITEGDKKRRLMIASTSSTSSSGMGATTTSVKTEEEVDGAMGVLSSPEPGFEVQSFCRGSTSPETSTAQAWWSQGRVVGRTRGDQELYGSSTALGTQSGHGNGNSSNFGLGFGYSGNRSGSGEVGYFAEVEESPPPPYPFSLLEGGF

SEQ ID NO: 3633 - protein, 235 aa, Fragaria vesca
MSMEDSGNVIAPFVMKTYQMVNDPTTDRLISWGRANNSFIVVEPLEFSQRLLPAYFKHNNFSSFVRQLNTYGFRKVDPDRWEFANECFLRGQTHLLKNVVRRKHTGNHGNNNHRMVNTTAFGKAEELDDEEIVMEIARLRQEQKSLEDEMESMNKRLEATERRPQQMMAFLHRVAEDPEILPRMMLEKDRRITEGDKKRRLMIASTSSTSSSGMGATTTSVKTERKLTGPWGCFR

SEQ ID NO: 3634 - protein, 191 aa, Hordeum vulgare
MRACGSGSGGEGRGGRHRVTSVTLSMLGEKPDLVCDRATCSGRRREPKTLNKRSEPPLPPHVAIRRRRRNPVRGAAESNTSAEDSRWLAALSEPELDLLISLKMLACHLLSPADYSPNAKFISVLSPADYSPAVTCRMVSCFISVLSPADYSPNAKFISALVADLLSLLLIYVHLRHALGHSVVTVILQIL

SEQ ID NO: 3635 - protein, 213 aa, Vitis vinifera
VDIFRDAAVLMVNYIDEIRAQGFEISYLNIGGGLGIDYYHAGAVLPTPRDLIDTVRELVLSRDLNLIIEPGRSLIANTCCLVNRVIGVKTNGTKNFVVIDGSMAELIRPSLYDAYQHIELVSPPPSDAQISTFDVVGPVCESADFLGKDRELPTPPRGAGLVVHDAGAYCMSMASSYNLKMRPPEYWVEDDGSVSKIRHGETFEDHVRYFEGL

SEQ ID NO: 3636 - protein, 340 aa, Vitis vinifera
LVSGNELRLALRAGFDPTRCIFNGNGKLLEDLVLAAQEGVFVNVDSEFDLDNIISAARIAGKKVNVLLRINPDVDPQVHPYVATGNKNSKFGIRNEKLQWFLDAVKAHPNELKLVGAHCHLGSTITKVDIFRDAAVLMVNYIDEIRAQGFEISYLNIGGGLGIDYYHAGAVLPTPRDLIDTVRELVLSRDLNLIIEPGRSLIANTCCLVNRVTGVKTNGTKNFVVIDGSMAELIRPSLYDAYQHIELVSPPPSDAQISTFDVVGPVCESADFLGKDRELPTPPRGAGLVVHDAGAYCMSMASTYNLKMRPPEYWVEDDGSMSKIRHGETFEDHVRYFEGL

SEQ ID NO: 3637 - protein, 216 aa, Raphanus sativus
  misc_feature (22)..(22): Xaa can be any naturally occurring amino acid
ITKVDIFRDAAVLMVEYIDEIXRQGFEVSYLNIGGGLGIDYYHAGAILPTPMDLINTVRELVLSRGLNLIIEPGRSLIANTCCFVNHVTGVKTNGTKNFIVIDGSMAELIRPSLYDAYQHIELVSPPAPEADVSKFDVVGPVCESADFLGKDRELPTPPKGAGLVVHDAGAYCMSMASTYNLKMRPPEYWVEDDGSITKIRHAETFEDHLRFFEGL

SEQ ID NO: 3638 - protein, 221 aa, Orobanche aegyptiaca
YLGSTITKVDIFRDAALLMVNYIDEIRSQGFEIDYLNIGGGLGIDYYHTGAVLPTPRDLIDTVRELVVSRNLNLIIEPGRSLIANTCCFVNHVTGVKTNGTKNFIVVDGSMSELIRPSLYGAYQHIELVSPSSPDVEMSTFDVVGPVCESADFLGKDRELPAPPKGAGLVVHDAGAYCMSMASTYNLKMRPPEYWVEDDGSISKIRHGETFEDHLRYFEGL

SEQ ID NO: 3639 - protein, 416 aa, Citrus clementina
MAATQLCSNSASLSKALTQNPFPKIPISPLKTTLNFQRTLKPFTLKAVLSQNPAKSQTHTAPVEHCFSKKADGFLYCEDVRVQDVMETVEKRPFYLYSKPQITRNVEAYKQALEGLNSIIGYAIKANNNYKILEHLRKLGCGAVLVSGNELRRVHPYVATGNKNSKFGIRNEKLQWFLDAVKAHPNELKLVGAHCHLGSTITKVDIFRDAAVLMVNYIDKIRAQGFEVDYLNIGGGLGIDYYHTGAVLPKPRNLIDTVRELVLSRNLNLIIEPGRSLIANTCCLVNHVTGVKTNGTKNFIVIDGSMAELIRPSLYDAYQHIELVSPAPQDAEISKFDVVGPVCESADFLGKERELPTPDRGAGLVVHDAGAYCMSMASTYNLKMRPPEYWVEEDGSVSKIRHGEIFEDHMRFFEGL

SEQ ID NO: 3640 - protein, 225 aa, Ipomoea nil
GAHCHLGSTITKVDIFRDAAVLMVAYIDQIRAQGFEIDFLNIGGGLGIDYYHAGAILPSPRDLIDTVRELVVSRNLNLIIEPGRSLIANTCCLVNRVTGVKTNGTKNFIVIDGSMSELIRPSLYDAYQHIELVSPTPSESEVSTFDVVGPVCESADFLGKNRELPTPPRGSGLVVHDAGAYCMSMASTYNLKMRPPEYWVEEDGNVSKIRHAETFEDHLRFFEGL

SEQ ID NO: 3641 - protein, 310 aa, Brassica juncea
DLVLAAQEGVFVNVDSEFDLENIVEASRISGKQVNVLLRINPDVDPQVHPYVATGNKNSKFGIRNEKLQWFLDEVKAHPNELKLVGAHCHLGSTITKVDIFRDAAVLMVEYIDEIRRQGFEVSYLNIGGGLGIDYYHAGAVLPTPMDLINTVRELVLSRGLNLIIEPGRSLIANTCCFVNHVTGVKTNGTKNFIVIDGSMAELIRPSLYDAYQHIELVSPPAPEAEVSKFDVVGPVCESADFLGKDRELPTPPKGAGLVVHDAGAYCMSMASTYNLKMRPPEYWVEDDGSITKIRHAETFEDHLRFFEGL

SEQ ID NO: 3642 - protein, 530 aa, Theobroma cacao
MAAATHLLSHSPSLPKTLNHPLTQNPFSKFPILPLKPSQNVFKRHSLSIKAVLSQNPAKTLTPTFQHCFTKSPDGFLYCEDTKVQDIMEKVEKRPFYLYSKPQITRNVEAYTEALEGLKNSIIGYAIKANNNFKILQHLKKLGCGAVLVSGNELELALRAGFDPTKCIFNGNGKILEDLIIAAQEGVFVNVDSEFDLENIVAAARIAGRKVNVLLRINPDVDPQDFLMGNIGLLKCNQQKLHPILRTSNHLLNLYYFVSISMMALLPVHPYVATGNKNSKFGIRNEKLQWFLDAVKAHPNELKLVGAHCHLGSTITKVDIFRDAAVLMVNYIDEIRAQGFEVDYLNIGGGLGIDYYHSGAVLPTPRDLIDTVRELVLSRNLNLIIEPGRSLIANTCCLVNHVTGVKTNGTKNFVVIDGSMAELIRPSLYDAYQHIELVSPAPPDAEVSTFDVVGPVCESADFLGKERKLPTPAKGTGLVVHDAGAYCMSMASTYNLKMRPPEYWVEEDGSVTKIRHGETFEDHMRFFEGL

SEQ ID NO: 3643 - protein, 335 aa, Cajanus cajan
SLNWLFVLGFDPTRCIFNGNGKILEDLTLAAQAGVFVNIDSEFDLENIVEAARRAGKRVNVLLRINPDVDPQVHPYVATGNKNSKFGIRNEKLQWFLDAVKEHPNELKLVGAHCHLGSTITKVDIFRDAATIMINYIDEIRAQGFEVDYLNIGGGLGIDYYHSGAILPTPRDLIDTVRELVLSRGLNLIIEPGRSLIANTCCLVNRVTGVKTNGSKNFIVIDGSMAELIRPSLYDAYQHIELVSPAPSNAETATFDVVGPVCESADFLGKGRELPTPAKGTGLVVHDAGAYCMSMASTYNLKMRPPEYWVEDDGSVSKIRHGETFEDHVRFFEGL

SEQ ID NO: 3644 - protein, 460 aa, Gossypium hirsutum
KNDSQQTQSIAIFITNGGYSSSLSLPISSQTLNHSLTKNPFSKSPILPLKPSKNLFKQPSLSLSLKAVLSQNPAKTLNPTFQHCFTKSPDGFLYCEDTKVQDVMEKVEKRPFYLYSKPQITRNVEAYKEALEGLKNSIIGYAIKANNNFKILQHLRMLGCGAVLVSGNELKLALRAGFDPTKCIFNGNGKILEDLVLAAQEGVFVNVDSEFDLENIVAAARIAGRKVNVLLRINPDVDPQVHPYVATGNKNSKFGIRNEKLQWFLDAVKGHPNELKLVGAHCHLGSTITKVDIFRDAAVLMVNYIDEIRAQGFEVDYLNIGGGLGIDYYHSGAVLPTPRDLIDTVRELVHSRNLNLIIEPGRSLIANTCCFVNRVTGVKTNGTKNFIVIDGSMAELIRPSLYDAYQHIELVSPAPPAAEVSTFDVVGPVCESAISWERRENFPPQLRGLAWSYMMQVLTA

SEQ ID NO: 3645 - protein, 225 aa, Euphorbia esula
  misc_feature (3)..(4): Xaa can be any naturally occurring amino acid
DSXXHLGSTITKVDIFRDAAVLMVKYIDEIRAQGFEIDYLNIGGGLGIDYYHAGAVLPTPRDLIDTVRELVVSRNLNLIIEPGRSLIANTSCLVNRVTGVKTNGTKNFIVIDGSMAELIRPSLYDAYQHIELVSPESSDAEVSKFDVVGPVCESADFLGKDRELPTPSKGAGLVVHDAGAYCMSMASTYNLKMRPPEYWVQEDGSVAKIRHGETFQDHVRFFEGL

SEQ ID NO: 3646 - protein, 489 aa, Arabidopsis thaliana
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEHLRSLGCGAVLVSGNELRLALLAGFDPTKCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPTPPEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 3647 - protein, 237 aa, Artemisia annua
KSYPDELKLVGAHCHLGSTITKVDIFRDAAEIMVKFIDEIRAQGFDISYLNIGGGLGIDYYHTGTVLPTPRDLIDTVRDLVKSRNLNLIIEPGRSLIANTCCLVNRVTGVKTNGTKNFIVIDGSMAELIRPSLYDAYQHIELVSPSPPDATISTFDVVGPVCESADFLGKNRELPAPARGSGLVVHDAGAYCMSMASTYNLKMRPPEYWVEEDGSVSKIRHGETFEDHMRYFEGLMI

SEQ ID NO: 3648 - protein, 402 aa, Artemisia annua
MEVVENRPFYLYSKPQITRNVEAYKEALEGLDNSVIGYAIKANNNFLILNHLRSLGCGAVLVSGNELRLALKAGFDPTRCIFNGNGKLLEDLVLAAQEGVFVNIDSEFDLDNIVAAARIAGKRVNVLLRINPDVDPQVHPYVATGNKNSKFGIRNEKLQWFLDQVKSYPDELKLVGAHCHLGSTITKVDIFRDAAEIMVKFIDEIRAQGFDISYLNIGGGLGIDYYHTGTVLPTPGDLINTVRDLVKSRNLNLIIEPGRSLIANTCCLVNRVTGVKTNGTKNFIVIDGSMAELIRPSLYDAYQHIELVSPPPSDATISTFDVVGPVCESADFLGKNRELPAPARGSGLVVHDAGAYCMSMASTYNLKMRPPEYWVEEDGSVSKIRHGETFEDHMRYFEGLMV

SEQ ID NO: 3649 - protein, 278 aa, Cleome gynandra
KVNVLLRINPDVDPQVHPYVATGNKNSKFGIRNEKLQWFLDEVKAHPEELKLVGAHCHLGSTITKVDIFKDAAVLMVKYIDEIRAQGFEVNYLNIGGGLGIDYYHTGAVLPSPRDLIDTVRELVLSRDLNLIIEPGRSLIANTCCFVNHVTGVKTNGTKNFIVIDGSMAELIRPSLYGAYQHIELVSPPPAEAEVSTFDVVGPVCESADFLGKDRELPTPPKGAGLVVHDAGAYCMSMASTYNLKMRPPEYWVEEDGSIAKIRHGETFEDHLRFFEGL

SEQ ID NO: 3650 - protein, 488 aa, Glycine max
MAASHILYNPPPLSKTFINHPLNQNPSPQNLILPLKATIKPRVLRAVHSQKITANSSLHNSDTRTRFQHCFTKSEDGLLYCEGLKVHEIMDSVERRPFYLYSKPQITRNVEAYKDALEGLRSIIGYAIKANNNLKILEHLRQLGCGAVLVSGNELRLALRAGFDPTRCIFNGNGKVLDDLVLAAKEGVFVNIDSEFDLENIIAAAKIAQKRVNVLLRINPDVDPQVHPYVATGNKNSKFGIRNEKLQWFLDAVKEHPNELKLVGAHCHLGSTITKVDIFRDAAIIMVNYIDQIRAQGFEVDYLNIGGGLGIDYQHSGAVLPTPRDLIDTVRELVLSRGLNLIIEPGRSLVANTCCLVNRVTGVKTNGSKNFIVIDGSMAELIRPSLYDAYQHIELVSPAPANAEIANFDVVGPVCESADFLGKDRQLPTPAKGTGLVVHDAGAYCMSMASTYNLKMRPPEYWVEEDGSVSKIRHGETFEDHIRFFEGL

SEQ ID NO: 3651 - protein, 298 aa, Raphanus sativus
  misc_feature (97)..(97): Xaa can be any naturally occurring amino acid
  misc_feature (270)..(270): Xaa can be any naturally occurring amino acid
PDVDPQVHPYVATGNKNSKFGIRNEKLQWFLDEVKAHPNELKFVGAHCHLGSTITKVDIFRDAAVLMVEYIDEIRRQGFEVSYLNIGGGLGIDYYHXGAVLPTPMDLINTVRELVLSRDLNLIIEPGRSLIANTCCFVNHVTGVKTNGTKNFIVIDGSMAELIRPSLYDAYQHIELVSPPAPEAEVSKFDVVGPVCESADFLGKDRELPTPPKGAGLVVHDAGAYCMSMASTYNLKMRPPEYWVEDDGSITKIRHAETFDDHLRFFQGLXIFPFIIVCCCFSRTIWLFRITTLMLLLC

SEQ ID NO: 3652 - protein, 280 aa, Amaranthus tuberculatus
RERVNVLLRINPDVDPQVHPYVATGNKNSKFGIRNEKLQWFLDAVKSHPNELKLVGAHCHLGSTITKVNIFRDAAVLMVEFIDQIRDQGFEISYLNIGGGLGIDYYHTGAVLPTPRDLIDTVRELVLSRDLNLIIEPGRSLIANTCCLVNRVTGVKTNGTKNFIVIDGSMAELIRPSLYDAYQHIELVSPAPSDAEISTFDVVGPVCESADFLGKERELPTPQRGAGLVVHDAGAYCMSMASTYNLKMRPPEYWVEEDGSVAKIRHGETFEDHLRYFAGL

SEQ ID NO: 3653 - protein, 492 aa, Arabidopsis lyrata
MAAATQFLSQPSSIRGTLNQYQLNQTSLSRIPILSLKSTLKPLKRLSVKSAVSQNSQNSTKTLTKESASSFDHCFKKSSDGFLYCEGTKVQDIMESVERRPFYLYSKPQITRNLEAYKEALEGVRSVIGYAIKANNNLKILEHLRSLGCGAVLVSGNELRLALRAGFDPTKCIFNGNGKLLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPTPPEAEVSKFDVVGPVCESADFLGKDRELPTPPQGACLVVHDAGAYCMSMASTYNLKMRPPEYWVEEDGSITKIRHAETFDDHLRFFEGL

SEQ ID NO: 3654 - protein, 437 aa, Artemisia annua
HQSSHLPNTPTNPEIHPLFHKTEDGYLYVEKTKVEEIMQVVEKRPFYLYSKAQITRNVEAYKEALEGLDNSVIGYAIKANNNFLILNHLRSLGCGAVLVSGNELRLALKAGFDPTRCIFNGNGKLLEDLVLAAQEGVFVNIDSEFDLDNIVSAARIAGKKVNVLLRINPDVDPQVHPYVATGNKNSKFGIRNEKLQWFLDQVKSYPDELKLVGAHCHLGSTITKVDIFRDAAEIMVKFIDEIRAQGFDISYLNIGGGLGIDYYHTGTVLPTPRDLIDTVRDLVKSRNLNLIIEPGRSLIANTCCLVNRVTGVKTNGTKNFIVIDGSMAELIRPSLYDAYQHIELVSPPPPDAPVSTFDVVGPVCESADFLGKNRELPAPARGSGLVVHDAGAYCMSMASTYNLKMRPPEYWVEEDGSVSKIRHGETFDDHMRYFEGL

SEQ ID NO: 3655 - protein, 294 aa, Brassica napus
EFDLENIVEASRISGKQVNVLLRINPDVDPQVHPYVATGNKNSKFGIRNEKLQWFLDEVKAHPNELKLVGAHCHLGSTITKVDIFRDAAVLMVEYIDEIRRQGFEVSYLNIGGGLGIDYYHAGAVLPTPVDLINTVRELVLSRDLNLIIEPGRSLIANTCCFVNHVTGVKTNGTKNFIVIDGSMAELIRPSLYDAYQHIELVSPPAPEAEVSKFDVVGPVCESADFLGKDRELPTPPKGAGLVVHDAGAYCMSMASTYNLKMRPPEYWVEDDGSITKIRQAETFEDHLRFFNGL

SEQ ID NO: 3656 - protein, 493 aa, Cleome spinosa
MAATTHLLYQSPILPKIQAQHQFTRNPFPRTPILPLKSNLKPLKRLSLKAAVSHNPAKTLTRDANSDQTTSFHHCFKKSSDGFLYCEETRVQDIIESVEKRPFYLYSKPQITRNFEAYSEALRGLRSIIGYAIKANNNLKILEHLRGLGCGAVLVSGNGLRLALRAGFDPAKCIFNGNGKLLEDLVLAAQEGVFVNVDSEFDLENIVQASRIAGKKVNVLLRINPDVDPQVHPYVATGNKNSKFGIRNEKLQWFLDEVKAHPEELKLVGAHCHLGSTITKVDIFRDAAVLMVKYIDEIRAQGFEVNYLNIGGGLGIDYYHTGAVLPSPRDLIDTVRELVLSRDLNLIIEPGRSLIANTCCFVNHVTGVKTNGTKNFIVVDGSMAELIRPSLYGAYQHIELVSSPPHEAEVSTFDIVGPVCESADFLGKDRELPTPSKGAGLVVHDAGAYCMSMASTYNLKMRPPEYWVEEDGSIAKIRHGEAFEDHLRFFEGL

SEQ ID NO: 3657 - protein, 248 aa, Vigna unguiculata
MAGSHLLSHSHSLPKTYNHSFNQNPLSQKLLLPLKFKATLRPRALRAVLSQKAAQTAVEDSKKAPFQHCFTKSEDGYLYCEGLKVHDIMESVEKRPFYLYSKPQITRNVEAYKNALEGLNSIIGYAIKANNNLKILEHLRHLGCGAVLVSGNELRLALRAGFDPTRCIFNGNGKILEDLVLAAQAGVFVNIDSEFDLENIVEAAKRAGKKVNVLLRINPDVDPQVHPYVATGNKNSKFGIRNESCNGS

SEQ ID NO: 3658 - protein, 246 aa, Momordica charantia
NEKLQWFLDAVKAHPDELRLVGAHCHLGSTITKVDIFRDAAVLMVNYIDQIRDQGFEVNYLNIGGGLGIDYYHAGAVLPTPRDLINTVRELVLSRDLNLIIEPGRSLIANTCCLVNRVTGVKTNGTKNFIVIDGSMAELIRPSLYDAYQHIELVAPSASDSEISTFDVVGPVCESADFLGRERELPTPNKGAGLVVHDAGAYCMSMASTYNLKMRPPEYWVEDDGSVSKIRHGETFDDHIRFFENL

SEQ ID NO: 3659 - protein, 482 aa, Cynara scolymus
  misc_feature (457)..(457): Xaa can be any naturally occurring amino acid
  misc_feature (465)..(465): Xaa can be any naturally occurring amino acid
MAVAYSSSHLQLQPLSFTKTLNRSSNSITPKTLVSFKPNSKTLGIRAIISQTPPETQKFEHCFTKKDDGYLYCENLKVQEVMEAVERRPFYLYSKPQITRNVEAYKDALEGLNSVIGYAIKANNNFMILQHLRSLGCGAVLVSGNELRLALRAGFDPTRCIFNGNGKLLEDLVLAAQEGVFVNIDSEFDLDNIVSAARIAGKKVNVLLRINPDVDPQVHPYVATGNKNSKFGIRNEKLQWFLDAVKSFPDELKLVGAHCHLGSTITKVDIFRDAAAIMVKFIDEIRAQGFDINYLNIGGGLGIDYYHKGTVLPTPRDLIDTVRELVLSRNLNLIIEPGRSLIANTCCFVNRVTGVKTNGMKNFIVIDGSMAELIRPSLYDAYQHIELVSPPPPDSAVSTFDVVGPVCESADFLGKNRELPAPARDSGLVVHDAGAYCMSMASTYNLKMRPPEYWVEXDGSVAKIXHGETFEDHMRYFEGLSL

SEQ ID NO: 3660 - protein, 481 aa, Helianthus annuus
MAAASSPSSAHPQLISFTKTLNNKSPFTSKSLISFKPTFKPFTIKAITSEKPTQTHKFDHCFTKQDDGYLYCEGLKVQEVMEAVEKRPFYLYSKPQITRNVEAYKDALEGLNSIIGYAIKANNNFVILKHLRELGCGAVLVSGNELRLALAAGFDPTRCVFNGNGKLLEDLVLAAQEGVFVNIDSEFDLDNIVSAARIAGKKVNVLLRINPDVDPQVHPYVATGNKNSKFGIRNEKLQWFLDAVKSYPDELKLVGAHCHLGSTITKVDIFRDAAAIMVKFIDEIRAQGFDISHLNIGGGLGIDYYHTGTVLPTPRDLIDTVRELVKSRNLNLIIEPGRSLIANTCCFVNRVTGVKTNGTKNFIVIDGSMAELIRPSLYDAYQHIELVSPPPSDSAVSTFDVVGPVCESADFLGKNRELPAPARGSGLVVHDAGAYCMSMASTYNLKMRPPEYWVEEDGSVAKIRHGETFDDHMRFFEGLSV

SEQ ID NO: 3661 - protein, 201 aa, Trifolium pratense
NYIDEIRAQGFEVDYLNIGGGLGIDYYHAGAVLPKPRDLIDTVRELVLSRGLKLIIEPGRSLIANTCCLVNRVTGVKTNGSKNFIVIDGSMAELIRPSLYDAYQHIELVSPAPANAEIATFDVVGPVCESADFLGKGRELPTPAKGTGLVVHDAGAYCMSMASTYNLKMRPPEYWVENDGSLSKIRHGETFEDHMRFFEGL

SEQ ID NO: 3662 - protein, 482 aa, Aristolochia fimbriata
MATTCFLARPSRFARTTSPLDVVCITKPSIALKQLSTKTSKGFRLRAVLSEKPQVQSSTKFKHCFSKSDDGHLYCEGLKVQELLDSFEQRPFYLYSKPQITRNCEAYREALQGLSSIIGYAIKANNNLKILEHLRRLGCGAVLVSGNELKLALRAGFDPKRCIFNGNGKLLKDLVLAAEEEVFVNVDSEFDLKNIVTASRIAGKKVNVLLRINPDVDPQVHPYVATGNKNSKFGIRNEKLQWFLDAVKSHPNELKLVGAHCHLGSTITKVDIFKDAAVLMVNYIDEIRAQGFEIDYLNIGGGLGIDYHHSGAILPTPMDLINTVRKLVISRNLTLIIEPGRSLIANTCCFVNHVTGVKTNGTKNFIVVDGSMAELIRPSLYGAYQHIELISPPPSDAEVSVFDVVGPVCESADFLGKDRELPTPPKGAGLVVHDAGAYCMSMASTYNLKMRPPEYWVEDDGSVSKIRHAETFEDNLRFFEGL

SEQ ID NO: 3663 - protein, 502 aa, Carica papaya
MMANHYFSLQSRPNTLPPSMMAVHSSSLSRTLKHPLHQNSFSQFPILPLKSNLKPVKPLSHMAVVQNPSKSLNQEEKTAEFHHCFTKSPDGFLCCEGVKVQDIMETVERRPFYLYSKEQITRNVEAYKEALQGLRSIIGYAIKANNNLKILEHLRHLGCGSVLVSGNELRLALRAGFDPKKCIFNGNGKLLDDLVLAAKEGVFVNIDSEFDLENIIAAARIAGKRVNVLLRINPDVDPQVHPYVATGNKNSKFGIRNEKLQWFLDAVKAYPSELKLVGAHCHLGSTITKVDVFRDAAVIMVKYIDEIRSQGFEVDYLNIGGGLGIDYYHSGAVLPTPKDLIDTVRELVLSRDLNLIIEPGRSLIANTCCLVNRVTGVKTNGTKNFIVIDGSMAELIRPSLYDAYQHIELVSPTSSDAEVSTFDVVGPVCESADFLGKERKLPTPAKGAGLVVHDAGAYCMSMASTYNLKMRPPEYWVEEDGSVAKIRHGETFEDHMRFFENL

SEQ ID NO: 3664 - protein, 275 aa, Prunus persica
  misc_feature (252)..(252): Xaa can be any naturally occurring amino acid
GDSRSWRVHSSGYQIPRLHAVQNSKFGIRNEKLQWFLDAVKAHPNELKLVGAHCHLGSTITKVDIFRDAAVLMVKYIDEIRSQGFQVDYLNIGGGLGIDYYHAGAVLPTPRDLIDTVRDVVQSQGLNLIIEPGRSLIANSCCLVNRVTGVKTNGTKNFIVIDGSMAELIRPSLYDAYQHIELVSPASPDAEISTFDVVGPVCESADFLGKDRELPTPPKGAGLVVHDAGAYCMSMASTYNLKMRPPEYWVEXDGSVAKIRHAETFEDHMRFFDGL

SEQ ID NO: 3665 - protein, 203 aa, Lotus japonicus
MVSYIDEIRAQGFEVDYLNIGGGLGIDYYHTGAVLPTPRDLIDTVRELVLSRNLNLIIEPGRSLIANTCCLVNRVTGVKTNGSKNFIVIDGSMAELIRPSLYDAYQHIELVSPAPENAETATFDVVGPVCESADFLGKERELQTPAQGTGLVVHDAGAYCMSMASTYNLKMRPPEYWVEDDGSVSKIRHGETFEDHIRFFEGL

SEQ ID NO: 3666 - protein, 479 aa, Fragaria vesca
MAAAHLTFNPPSSFSKPLNHSLPRNPFSRNSILPFKPSLKPLLLKAVLTQEAPQTVPFKHCFSKSSDGFLYCEGLKVQDVMESVEKRPFYLYSKPQITRNVEAYKDALEGLKSVIGYAIKANNNFKILEHLRGLGCGAVLVSGNELRLALRAGFDPTRCIFNGNGKLLDDLVLAAQEGVFINVDSEFDLENITTAARMAGKRVNVLLRINPDVDPQVHPYVSTGNKNSKFGIRNEKLQWFLDEVKKHPDELKLVGAHCHLGSTITKVDIFRDAAVLMVEYIDKIRDQGFDVNYLNIGGGLGIDYYHTGAVLPTPRDLINTVWEVVLSRDLNLIIEPGRSLIANSCCLVNRVTGVKTNGTKNFIVIDGSMAELIRPSLYDAYQHIELVAPAPHEAEISTFDVVGPVCESADFLGKERKLPTPPKGAGLVVHDAGAYCMSMASTYNLKMRPPEYWVEEDGSVSKIRHAETFKDHMRFFEGL

SEQ ID NO: 3667 - protein, 291 aa, Malus domestica
NGNGKLLDDLVLAAQEGVFINIDSEFDLENIVAAARIAGKRVNVLLRINPDVDPQVHAYVATGNKNSKFGIRNEKLQWFLDAVKAHPDELKLVGAHCHLGSTITKVDIFRDAAVLMVKYIDEIRSQGFQVDYLNIGGGLGIDYYHSGAILPKPRDLINTVRDVVLSQGLNLIIEPGRSLIANSCCLVNRVTGVKTNGTKNFIVIDGSMAELIRPSLYDAYQHIELVAPTAPDAEISTFDVVGPVCESADFLGKDRELPTPPKGAGLVVHDASAYCMSMASTYNLKMRPPEY

SEQ ID NO: 3668 - protein, 487 aa, Arachis hypogaea
MASTHLVSQSPSIPKTLNFSNPFFSKSPFPQNLVLPLKASLKPRVLRAVNAANTPLVNPAEKKTHFKHCFTKSDDGYLYCETVKVQEIMESVDRRPFYLYSKPQITRNVEAYKDALQGLNSVIGYAIKANNNLKILEHLRHLGCGAVLVSGNELRLALRAGFDPTRCIFNGNGKILEDLTLAALEGVFINIDSEFDLENIVAAARVVGKRVNVLLRINPDVDPQVHPYVATGNKNSKFGIRNEKLQWFLDAIKEHPNEVKLVGAHCHLGSTITKVDIFRDAAVIMINYIDQIRDQGFEVNYLNIGGGLGIDYYHSDAVLPTPRDLIDTVRELVLSRGLNLIIEPGRSLVANTCCLVNRVTGVKTNGSKNFVVIDGSMAELIRPSLYDAYQHIELVSPATADAEILTFDVVGPVCESADFLGKGRELPTPAKGAGLVVHDAGAYCMSMASTYNLKMRPPEYWVEDDGSVSKIRHGETFEDHIRFFEGL

SEQ ID NO: 3669 - protein, 487 aa, Arachis hypogaea
MASTHLVSQSPSIPKTLNFSNPFFSKSPFPQNLVLPLKASLKPRVLRAVNAANTPLVNPAEKKTHFKHCFTKSDDGYLYCETVKVQEIMESVDRRPFYLYSKPQITRNVEAYKDALQGLNSVIGYAIKANNNLKILEHLRHLGCGAVLVSGNELRLALRAGFDPTRCIFNGNGKILEDLIIAAQEDVFINIDSEFDLENIVAAARIAGKRVNVLLRINPDVDPQVHPYVATGNKNSKFGIRNEKLQWFLDAIKEHPNEVKLVGAHCHLGSTITKVDIFRDAAVIMINYIDQIRDQGFEVNYLNIGGGLGIDYYHSDAVLPTPRDLIDTVRELVLSRGLNLIIEPGRSLVANTCCLVNRVTGVKTNGSKNFVVIDGSMAELIRPSLYDAYQHIELVSPATADAEILTFDVVGPVCESADFLGKGRELPTPAKGAGLVVHDAGAYCMSMASTYNLKMRPPEYWVEDDGSVSKIRHGETFEDHIRFFEGL

SEQ ID NO: 3670 - protein, 203 aa, Raphanus sativus
MVEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPAPEAEVSKFDVVGPVCESADFLGKDRDLPTPPKGAGLVVHDAGAYCMSMASTYNLKMRPPEYWVEDDGSITKIRHAETFDDHLRFFQGL

SEQ ID NO: 3671 - protein, 1293 aa, Solanum phureja
KINSDINKLSKSYFDVLGICCTSEVVLVEKILKNLDGVKEVSVIVTTKTVIVTHDSLLISQQQIVKALNQARLEASIRVKGLQNYQKKWPSPFAIGSGILLALSFLKYFFLPLQWLALVAVVVGIPPIIFRGIAAIRNFTLDINILVLIAVAGSIVLHDYWEAATIVFLFTIAEWLESRASHKATAVMSSLVNIVPPTAVLAENGEVVNVDQVKLNSILAVKAGETIPIDGIVVEGECDVDEKTLTGESFPVSKQKDSTVWAGTTNLNGYISVKTTALAEDCAVARMAKLVEDAQNKKSKTERYIDKCAKYYTPAIVVIAAGLAVVPTALRVHNRKEWYRLALVALVSACPCALVLSTPVAMCCALSKAATSGLLFKGAEYLETLAKIKIMAFDKTGTITRGEFAVTEFRSLIDGLSLNTLLYWVSSIESKSGHPMAAALVDYAQSNSVEPKPDRVEQFQNFTGEGIYGRIDGMEIYVGNRKISSRAGCTTVPELEGDSIEGKSVGYIFLGSSPAGIFTLSDVCRTGVKDAMRELKQMGIKTVMLTGDCYAAANHVQDQLGGALDEFQAELLPEDKATIIKGFQKEAPTAMIGDGLNDAPALATADIGISMGISGSALAKETGHVILMTNDIGRIPKAARLARRVRRKIIENMIIAIGTKGAIVALAIAGHPLVWAAVLADAGTCLLVILNSMLLLRGATRRHEKKCCKSSTSSHAHQHESKASCCKSEKAPQLCCSDIESQKECRKQSCSSEVCVQKRQPFPSGSTSSGNNQCSNSIENNGHHSHSHSHPQCCSSKMSVTACQSAVSESKSCGSNNCSDSIHKSSCHSLTNSSISSSDMSAPRCHSATSNSKLCGSTKSSNLSDKNSCRSHEIPQTCSTKKAAHGCHSEVSGPKSCGNSKCSDSRDNNIHHSHSDHQTCASKVCAPQSPSATSSSTTCGKTKCSNTTSKNSCHSHANSEPCSSKKSGPACQNANSGSRSCGNHKCQDSATEQGIHSLTDQLSEEKISEQKSLVLESNHDLSHGCCEEEHDHHPNLDKAYDSCALQECCYSVQGDINDISETGIQETSQCDSTNQTCQTVISGSMICGDNKSLDSVDIHGCHSHAHPPHKEEPHHSVGHGCSDKEHDHSHPEKSYDSYATQDCCFSVQDHSIDISENGTAHCDSIKQSMVIPSSCKHTPQDQVSHCGFHSTTTPTDEELAKLVRRCCNYRPCHEVRSGYRKHAAECGPTTRSTINILRDNHHHHLDCSGRKVCSPIEKRHIGGCCETFRKECCPKNNHFASSFGGGLSEIVLE

SEQ ID NO: 3672 - protein, 164 aa, Solanum phureja
MAASARRSTGPVLRSLSPAGRFYSSTSRTSSSSASSIRFTLDRETSPSRSISVMNRQKTMASSQKKTCMCSPTNHPGSFRCSMHKKMDNRRSSNTSQTASNSIRLHMRRSAMTNSLVRIGTVEGELVKRALAALIRPSSHQQRRRSDFQRRPSRLSVISSPGDS

SEQ ID NO: 3673 - protein, 164 aa, Solanum tuberosum
MAVSARRSTGPVLRSLSPAGRFYSSTSRTSSSLASSIRFTLDRETSPSRSISVMNRQKTMASSQKKTCMCSPTNHPGSFRCSMHKKMDNRRSSNTSQTASNSIRLHMRRSAMTNSLVRIGTVEGELVKRALAALIRPSSHQQRRRSDFQRRPSRLSVISSSGDS

SEQ ID NO: 3674 - protein, 162 aa, Solanum melongena
MAASARRSTGPVLRSLSPAGRLYSSTSRTSSSSASSIRFTLDRETSPSRCISVMNRQKTVSSSQKKTCMCSPTNHPGSFRCSMHKKMDVRRSSSQTASNSIRLHMRRSAMTNSLVRIGTIEGELVKRALAALIRPSSLQQRRRFDFQRRPSRLSVISSSGDS

SEQ ID NO: 3675 - protein, 130 aa, Solanum phureja
MATIIHSIFSFFFIINIIFLSSSYYALGGRDILKINDKIIHPDTFIPYDGTVLIPGIGRVVVPPIGTHDNPFTYNPITGSNNGNGLVIPIPGLALALALTFLVVTIHLFPTLESKSLVVVPFLYHHRYRH

SEQ ID NO: 3676 - protein, 123 aa, Solanum tuberosum
HSIFSFFFIINIIFLSSSYYALGGRDIPKINDKIIHPDTFIPYDGTVLIPGIGRVVVPPIGTHVNPFTYNPITGSNNGNGLVIPIPGSGTGTGIGSYIPGGDDTLVPNPGVEVPSGGTIPVPP

SEQ ID NO: 3677 - protein, 127 aa, Solanum phureja
HSIFSFFFIINIIFLSSSYYALGGRDILKINDKIIHPDTFIPYDGTVLIPGIGRVVVPPIGTHDNPFTYNPITGSNNGNGLVIPIPGLALALALALTFLVVTIHLFPTLESKSLVVVPFLYHHRYRH

SEQ ID NO: 3678 - protein, 168 aa, Solanum tuberosum
MDPKQAKTTSGSGHSSTHKPNSHPKPSKSELMSSAKLVADAAKAKLHHDPKQFEKSELAGAAADLLNAASQYGKIEETGIGKFVGKAETYLHKYETSHHSTTTAAATTHTQSSGHTGGGKHEKTGSGYGEYIKMAEGLLKKNSDGSQSSESGKKGDYLKMAGDFLKKH

SEQ ID NO: 3679 - protein, 168 aa, Solanum phureja
MDPKQAKTTSGSGHSSTHKPNSHPKPSKSEVMSSAKLVADAAKAKLHHDPKQFEKSELAGAAADLLNAASQYGKIEETGIGKLVGKAETYLHKYETSHHSTTTAAATAHTQSSGHTGGGKHEKAGSGYGEYIKMAEGLLKKNSDGSQSSESGKKGDYLKMAGDFLKKH

SEQ ID NO: 3680 - protein, 175 aa, Solanum melongena
MDPTQAKTISGSVHHSSTQKPNSHPKPSKSELMSSAKLVADAAKAKLHHDPTQFEKSKLAGAAADLLNAASEYGKLEEKGIGKFVGKAENYLHKYETSHHSTTTTTAAGAAYTTAHSQSSGHTTGGNHEGSGSGYGEYIKMAEGILKKHSDGSQSSESGKKGEYLKMAGDFLKKR

SEQ ID NO: 3681 - protein, 172 aa, Capsicum annuum
MDPTQSKTTSGAAHSSNHKPNSHPKPSKSELMSSAKLVADAAKAKLHHDPKNFEKSELAGAAADLLNAASQYGKLEEKGIGKFVGKAETYLHKYETSHSTTTTTHAAAASTTGHTHSSGHTEGKHEESGSGYGEYIKMAEGIFKKHSDGNQSSESGKKGEYLKMAGDFLKKH

SEQ ID NO: 3682 - protein, 194 aa, Nicotiana tabacum
  misc_feature (32)..(32): Xaa can be any naturally occurring amino acid
RGLSKVHGTQSFFNLFPKFSHSPNNFMDPTQXKTTSGASHSLSHKPNSHPKPSKSELMSSAKLVADAAKAKLHHEPNSKVDKSELAGAAADLLNAASQYGKLEEKGIGKFVGKAETYLHKYETSHSTTTSTTEHTQSSAHTGGKHEQSGSGYGEYIKMAEGIFKKHSDGTHSSESGGGKKGEYLKMAGDFLKKH

SEQ ID NO: 3683 - protein, 198 aa, Nicotiana benthamiana
HEGSQHTIFQLISQISHSPNNFMDPTQSKTTSGASHSSSHKPNSHPKPSKSELMSSAKLVADAAKAKLHHEPNSKVDKSELAGAAADLLNAASQYGKLEEKGIGKFVGKAETYLHKYETSHSTTTTTGTTTTTSTTEHTQSSAHTGGKHEQSGSGYGEYIKMAEGIFKKHSDGTHSSESGGGKKGEYLKMAGDFLKKH

SEQ ID NO: 3684 - protein, 315 aa, Solanum tuberosum
MEEIEHKYIEVNGLKLHIAEIGSGSSPVVVFLHGFPEIWYSWRYQMLAVAKAGYRAIAPDFRGYGLSDQPTQPEKTTFLDLNNDLLALLDALNISKVFLVGKDFGSFVVSYFSILHKERLSGFIVMGVPFLPPKPLEFKQGLPEGFYISRFGVPGRAEADFGRLDAKTVVKNVYILFSRSELPIANEDQEIMDIVQPSTPLPPWFSEEDLTAYGALYENSGFRTALQVPYRSLHEQVNITDPTVHVPALFIKGEKDYFLKFPGIEDYISSGVLKSLVPNLQIVNLPEGTHFVQEQLPNEVNQLVLEFLTKNSKLQ

SEQ ID NO: 3685 - protein, 315 aa, Solanum phureja
MEEIEHKYIEVNGLKLHIAEIGSGSSPVVVFLHGFPEIWYSWRYQMLAVAKAGYRAIAPDFRGYGLSDQPTQPEKTTFLDLNNDLLALLDALNISKVFLVGKDFGSFVVSYFSILHKERVSGFIVMGVPFLPPKPLEFKQGLPEGFYVSRFGVPGRAEADFGRLDAKTVVRNVYILFSRSEIPIANEDQEIMDIVQPSTPLPPWFSEEDLTAYGALYENSGFRTALQVPYRSLHEQVNITDPTVHVPALFIKGEKDYFLKFPGIEDYISSGVLKSLVPNLQIVNLPEGTHFVQEQLPDEVNHLVLEFLTKNSKLQ

SEQ ID NO: 3686 - protein, 315 aa, Capsicum annuum
MEGIEHKYVEVNGLKLHVAETGNGNSPVVVFLHGFPEIWYSWRHQMIAVARAGYRAIAPDFRGYGLSGQPPQPEKTTFLDLTNDILALLDALNISKVFLIGKDFGSFIVSQFVNLYEEKVSGFIVMGVPFLPPKPLQFKQGIPEGFYISRFAEPGRAEADFGRLDAKTVVRNIYILFSRSELPIANENQEIMDIVQPSTPLPPWFSEEDLTAYGALYENSGFRTAMQVPYRSLHEELNITDPTVHVPALFIKGEKDYFLKFPGIEDYISGGLLKSLVPNLQIVNLPEGTHFVQEQLPDEVNPLVLEFLTKNSKPQ

SEQ ID NO: 3687 - protein, 269 aa, Petunia hybrida
MIAVTKAGYRAIAPDFRGYGLSDQPTEPEKTTFLDLTNDILALFDALSISKAILVGKDFGSIIISRFVLLHGERVSGFIVMGVPYLPPQPLKFQDGLPEGFYISRWREPRRAEADFGRLDAKTVVKNVYILFSRSEIPIANENQEIMDIVQPLTPLPPWFTEEDLAAYGALYEKSGFQTALQVPYRSLLEEVNITDPTVHGPALFIVGEKDYFLKFPGIEDYISGELKNLVPNLEIASLPEGNHFVQEQLPDEVNTLMLDFLTKNSKLQ

SEQ ID NO: 3688 - protein, 314 aa, Nicotiana benthamiana
MCSTKQKQKQNLHQQRSTEPVSTSAVDGGDEENWREESITGGSLKHVDSDTGKNGWASPPGDLFNLRGPNYFTKKAKVPSGAWLLQPAGVDWLRSNSKLDHVLARHDNRVMHALRKSHSQGKSLKTFILAVNLQVPGRDHHSAVFYFSTNDDEPLEPGSLLYRFVNGDDAYRNSRFKIVNRIVKGPWIVKAAVGNYSACILGKALNCYYHRGPNYFEIDVDIGSSAIANAILHLALGYVTSVTIDMGFCVESQTEEELPEKLFGAVRVCQMEMSSATFVDTTSSRKVLTATANLHNPIGSSRVQAEENGENEED

SEQ ID NO: 3689 - protein, 128 aa, Avena sativa
MAPKLLPAAAALLLLALAASAASAFTTAGDLGGAAAVVMRRGGRTCRGTVGDCMEYFGVDGEGEGDVAAMAGGKRRLLQDGSGYIGYDALRRDSVPCSQRGASYYNCQPGAEANPYSRGCSAITQCRG

SEQ ID NO: 3690 - protein, 319 aa, Hordeum vulgare
MATVEQQQQQIEHSHLAIRGLNLHVAQAGTGELGTVLFLHGFPEIWYSWRHQMLAVAAAGYRAVAPDWRGYGLSDQPPEPEAAAYSDLIEDLLALLDALSVPKAYLVAKDFGTMLAYDFALRHPNRTCGVMCLGIPFLHGGSSFTAMPEGFYILRWREPGRAEADFGRYDVKRVVRTIYILFSRSEIPTAKEDQEIMDLADLSTPLPEWFTEEDLDVYASLYEKSGFVYPLHMPYRSLHKRQPIEDPKFEVPVFVVMGEKDYVCKFPGVEAVLKNGTMEKFAPDLKITYIPEGGHFVQEQFPDKVNDLLLGFLKDHPVA

SEQ ID NO: 3691 - protein, 316 aa, Brachypodium distachyon
MATAEQRIEHSRIAVRGLNLHVAQSGTGELGTVIFLHGFPEIWYSWRHQMQAVAAAGYRAVALDWRGYGLSDQPPEKETASRDDLVEDLLALLDALAVHKAFLIAKDFGAMPAYDFALRHPSRTSGVMCLGIPYLHGGSPFTTLPEGFYILRWREPGRAEADFGRYDVKRVVQTIYILFSRSEIPIANEDQEIMDLADLSTPLPEWFTEKDLDVYASLYEKSGFGYPLQMPYRSLHKTQPVEDPKFQVPVFVVMGEKDYVFKFPGVEAVLKDGVMEKFAPDLKITYVPEGSHFVQEQFPDMVNELLLGFLRDHPVA

SEQ ID NO: 3692 - protein, 314 aa, Sorghum bicolor
MEQQIKHSHLPIRGLSLHVAQAGKGELGTVVFLHGFPEIWYSWRHQMLAVAAAGYRAVAPDWRGYGLSDQPPEAEAASYDDLVEDLLAILDALSIPKAFLVAKDFGAMPAYDFALRHPSRTCGVMCLGIPFLHGGSSFTSLPEGFYILRWREPGRAEADFGRYDVKRVVRTIYVLFSRSEIPIAKEGQEIMDLADLSTPLPEWLTEDDLAVYASLYEKSGFRYPMEMPYRSLHKRMPIEDPRFQVPVFVVMGEKDYVFKFPGVESVLKDGIMEKFTPDLKITYIPEGSHFVQEQFPDKVNDLLVSFLKDHPVAA

SEQ ID NO: 3693 - protein, 314 aa, Saccharum officinarum
MEQQVEHSHLPIRGLSLHVAQAGKGELGTVVFLHGFPEIWYSWRHQMLAVAAAGYRAVAPDWRGYGLSDQPPEPEAASYDDLVEDLLAILDALSIPKAFLVAKDFGAMPAYLFALRHPSRTCGVMCLGIPFLNGGSPSTGLPEGFYILRWREPGRAEADFGRYDVKRVVRTIYVLFSRSEIPIAKEDQEIMDLAELSTPLPEWFTEDDLAVYVSLYEKSGFRYPMEMPYRSLHKTKPIEDPKFQVPVFVVMGEKDYVFKFPGVESVLKDGIMEKSAPDLKITYIPEGSHFVQEQFPDKVNDLLVSFLKDHPVSA

SEQ ID NO: 3694 - protein, 217 aa, Triticum aestivum
MAFAASTACCKPSALLAPRASSSSPPSQARLCRPSTSAAFHGLRAPASAFALAPAPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 3695 - protein, 216 aa, Hordeum vulgare
MAFAASTACCKPSALLAPRASASSSSQARLCRPSTSAAFQGLRAPAPAFALAPAPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 3696 - protein, 217 aa, Triticum aestivum
MAFAASTACCKPSVLLAPRASSSSSSSQARLCRPSTSAAFHGLRAPASAFALAPAPRRRAASAGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 3697 - protein, 216 aa, Triticum aestivum
MAFAASTACCKPSVLLAPRASSLSSSQARLCRPSTSAAFHGLRAPASAFALTPAPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 3698 - protein, 216 aa, Pseudoroegneria spicata
MAFAASTACCKPSVLLTPRASSSSSSQARLCRPSTSAAFHGLRAPASAFALAPAPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 3699 - protein, 325 aa, Triticum aestivum
MGAQRALLASFLLAALATQAFVAVSARTSPTDKASQDDVKKPDCVPSLDPHNFPGHGGTTVPLPSHGGSSGTPPYHGGSGTTPSHGGSGSTPSHSGSGSTVPDPSHGGYGTPPSHGGSGSLPDPSHSGGGYGSTPDAPSHGGGAYGSSPTPSTGGAYGSSPTPSHDGGAYGSSPTPAHDGGSYSGTPAAPSHSSHGSITPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAVAGGSDSAAAAQAAAFKKANEGKKV

SEQ ID NO: 3700 - protein, 324 aa, Leymus cinereus x Leymus triticoides
  misc_feature (81)..(81): Xaa can be any naturally occurring amino acid
  misc_feature (280)..(280): Xaa can be any naturally occurring amino acid
  misc_feature (290)..(290): Xaa can be any naturally occurring amino acid
MGAQRALLASLLLAALATQAFVAVSARSGPTDKASQDDVKKPDCVPSLDPHNFPGHGGTTVPLPSHGGSSGTPPYHGGSGXTPSHGGSGSTPSHGGSGSLPDPSHGGYGTPPSHGGSGSLPDPSHSGGGYGSTPDAPSHGGGAYGSSPTPSTGGAYGSSPTPSHGGGAYGSSPTPAHDGGSYSGTPAAPSNSSHGSVTPTPLVPVDPNSLGTCDYWRTHPMQIWSALGSWPSSVSHFFGAAGGAVAGGPSVSIQDALANTRTDGAGALLREGTAALLNSXTRPGFAYTTXQVRDAFAAAESGGSDSAAAAQAAAFKKANEGRKA

SEQ ID NO: 3701 - protein, 348 aa, Triticum aestivum
LSTPLPPKQLPLKQRRKKKKLEDMGAQRALLASFLLAALATQAFVAVSARTSPTDKASQDDVKKPDCVPSLDPHNFPGHGGTTVPLPSHGGSSGTPPYHGGSGTTPSHGGSGSTPSHSGSGSTVPDPSHGGYGTPPSHGGSGSLPDPSHSGGGYGSTPDAPSHGGGAYGSSPTPSTGGAYGSSPTPSHDGGAYGSSPTPAHDGGSYSGTPAAPSHSSHGSITPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAVAGGSDSAAAAQAAAFKKANEGKKV

SEQ ID NO: 3702 - protein, 348 aa, Hordeum vulgare
MAAQRALFASFLLAALATQAFVAVSARSVPTDKASQDDVKKPDCVPSLDPHNFPGHGGTTVPLPSHGGSSGTPPYHGGSGTTPSHGGSGSTPSHSGSGSVPDPSHGGSGSTPSHSGSGSVPDPSHGGSGSLPDPSHSGGGYGSTPDAPSHSGGAYGSSPTPSTGGAYGSSPTPSHDGGAYGSSPTPSHDGGAYGSSPTPAHDGGSYSGTPAAPSHSSHGSVTPTPLIPVDPNSLGTCDYWRTHPMQIWSALGSWPSSVSHFFGAAGGAVAGGPSVSIQDALANTRTDGAGALLREGTAALLNSMTRPGFAYTTQQVRDAFAAAAAGGSDSAAAAQAAAFKKANEGRKA

SEQ ID NO: 3703 - protein, 306 aa, Pseudoroegneria spicata
MGAPRALLASFLLAALATQAFVSVSARSGPTDKASQDDVKKPDCVPSLDPHNFPGHGGTTVPLPSHGGSSGTPPYHGGSGTTPSHGGSGSTPSHSGSGSTPSHSGSGSLPDPSHGGYGTPPSHGGSGSLPDPSHSGGGYGSTPDAPSHGGGAYGSSPTPSTGGAYGSSPTPSHDGGAYGSSPTPAHDGGSYSGTPAAPSHSSHGSVTPTPLIPVDPNSLGTCDYWRTHPMQIWSALGSWPSSVSHFFGAAGGAVAGGPSVSIQDALANTRTDGAGALLREGTAALLNSMTRQGFAYTTEQVRDAFA

SEQ ID NO: 3704 - protein, 466 aa, Leymus cinereus x Leymus triticoides
MASTATTARHMVALPYPGRGHINPMLAVCRLLVAADGALAVTVVVTEEWHGLLASAGVTPTLPDRVRLDTIPNVIPSENGRGADHAGFIEAVNCKMAEPVERLLDRLVLELGRRPDAIVADTYLQWAVAAGAQRGIPVGSLWTQPATFFLALYHLDLWPPVDEGASEEELSCKSMEQYVPGLSSLRLSDLKIFSAWERPMKIAAEVFVNVRKAQCVLFTSFHELEPGCINKIAESLPCPVYPIGPSILRAPDKGESARDEEHRRWLDAQPENSVLYVSFGSFVSMPPKQFEEIAMGLRDSAVRFFWVARDRATAGLREKCGDKGLAVPWCDQQEVLRHPSVGGFLSHCGWNSVLEAVCAGVPVIGFPVAWDQLVNARMVADEWKVGINLRRQRGEDGIVSRAAVSDAARKLMDLDSGAGQEMRRRAAHLREASRGAVLEGGSSHRSLSAFLEDLVEGKLEVAESSA

SEQ ID NO: 3705 - protein, 215 aa, Solanum phureja
MAGGGASTKASNGGPTRVRKRVEVESAAAAASLKRAKDGSAFARCEECSKDVPIALISFHNCSLDAKIKMNLEAQVVENQTEVKKPAAKSREKSTEPKAKREKKPKNPNAPKRPPTAFFVFMDDFRQEFKAANPDCKSVSTVAKEGGEKWKSMTDEEKKPYQEKAAELKAAYEKALKSNTDADNANDDDEEPEKEIKEEIVVDEEVKDEIEVDEE

SEQ ID NO: 3706 - protein, 223 aa, Nicotiana tabacum
  misc_feature (58)..(58): Xaa can be any naturally occurring amino acid
MAGGGASKNSNGPTRVRKRVEVESATAASLKRAKDGSAFARCEECNKDVPIALINFHXCSLDAKIKMNLEAQVVENASETKKPASKSKEKLTEPKAKRERKAKNPNAPKRPPTAFFVFMDEFRQTFKAANPDCKSVSTVAKEGGEKWKSMTDEEKKPYQDKAAELKAAYEKALKQSITDAENANDEDELSEKEVKEEVEVVEEVKEETEVVDEVKEEVEVDEE

SEQ ID NO: 3707 - protein, 354 aa, Saccharum officinarum
AVLAPAVMAQTCDDELPAQLVGNFSGLACAPVWHNFVLRYAQGKDNVLRVVLSTMYSTGWVGMGFSKNGLMVGSSAMVGWMGKTGLPHIKPFSLGGKTPSQVVADQGFLVSSDHHKPTVLVHQAKIYLAFQLSFTEPLKGQNVLLAFGSAIPVNDRLSEHQDKTAIVFDFTTGSSSSSSSFPEGLKRTHGALNLFAWGVLLPIGAIVARYCRRWDPLWFYLHAGIQFVGFILGLAGVVAGVSLYNKIQADVPAHRGLGIFVLVLGILQILAIFLRPNKDSKYRKFWNWYHHWVGRLALFFAAINIVLGIKVGGAGNSWKIGYGFNLAVLLITIITLEVLLWTRWKNNSGSTGAY

SEQ ID NO: 3708 - protein, 369 aa, Zea mays
MVMGAASVGTLLVALAVLAPAVMTQSCDDELPAQLAGNFSGLACAPVWNSFVLRYAQDKDNVLRVVLSTMYSTGWVGMGFSKNGLMVDSSAMVGWIGKTGLPHIKPFSLRGKTPSQVVADQGFLVSSDNHKPTVLVQQAKIYLAFQLSFTEPLRRQNVLLAVGSAIPVNDRLAEHQDKTSIVFDFTTGSSSGSSSFPEGLKRTHGALNLFAWGVLLPIGAIVARYCRRWDPLWFYLHAGIQFVGFILGLAGVVAGVSLYSKIQADVPAHRGLGIFVLVLAILQILAIFLRPNKDSKYRKFWNWYHHWVGRLALFFAAINIVLGIKVGGAGNSWKIGYGFNLAVLLITIVTLEVLLWTRWKNSTGSTGAY

SEQ ID NO: 3709 - protein, 248 aa, Panicum virgatum
MAMATSTFSPRPASLRPLRAGAKPRLHLLPFPRLRAGRRGSRLERAAAGEAPVEVAPPKEPEAEPAPAAASNGSAVKAVEAPAEAAPAPAFRDARWVNGTWDLSKFEKGGAVDWDAVIDAEARRRKWLEDYPEATNTDEAVVFDTSVIPWWAWMKRFHLPEAEKLNGRAAMIGFFMAYFVDSLTGVGLVDQMGNFFCKTLLFVAVAGILLIRKNEDLDSLKKIIDETTFYDKQWQATWQDETTGGPKN

SEQ ID NO: 3710 - protein, 634 aa, Triticum aestivum
MQHLTLAASLSAAVLFACILYAESADLNSDKQALLAFAASLPHGRKLNWSSTTPVCTSWVGVTCTPDNSRVHTLRLPAVGLFGPIPSDTLGKLDALEVLSLRSNRLTVDLPPDVGSIPSLHSLYLQHNNLSGIIPTTLSSSLTFLDLSYNTFDGEIPLRVQNLTGLTAILLQNNSLSGPIPDLRLPKLRHLNMSNNNLSGPIPPSLQKFPASSFLGNAFLCGLPLEPCPGTAPSPSPTPPPSVPSKPKKSFWKRIRTGVLIAIAAAGGVLLLLLILVLCICICKRKKCAEPTAASSSKGKAVAGGRADTPKEDYSSSVQEAERNKLVFFEGSSYNFDLEDLLRASAEVLGKGSFGTTYKAVLEDSTTVVVKRLKEMVVGKKDFEQQMEIVGRIGQHQNIVPLRAYYYSKDEKLLVYDYVPAGSLAAVLHGNKATGRAALDWETRVKISLGMARGLAHLHAEGSGKFIHGNLKSSNILLSQNLDGCVSEFGLAQLMTTLPAPARLIGYRAPEVLETKKPTQKSDVYSFGVLLLEMLTGKAPLRSPGREDSVEHLPRWVQSVVREEWTAEVFDVDLLRHPNIEDEMVQLLQVAMACVAVAPDQRPKMDEVIRRIAEIRNSYSGPASPPEETGAQAP

SEQ ID NO: 3711 - protein, 633 aa, Brachypodium distachyon
MQHLILAALSAAVLSACLLHAESADLNSDKQALLAFAASLPHGRKLNWSSTTPLCTSWVGVTCTPDNSRVHTLRLPAVGLFGPIPSDTLSKLDALEVLSLRSNRLTVDLPPDVGSIPSLHSLFLQHNNLSGIIPTSLSSSLTFLDLSYNTFDGEIPLRVQNLTGLTAILLQNNSLSGPIPDLQLPKLRHLNVSNNNLSGPIPPSLQKFPASSFLGNAFLCGFPLESCPGTAPSPSPTSPSPMPSKTKKSFWRRIRTGVLIAVAAAAGVLLLILIIVLLVCIFKRKKHTEPTTTSSSKGKAIAGGRVENPKEDYSSSVQEAERNKLVFFEGSSYNFDLEDLLRASAEVLGKGSYGTTYKAVLEDGTVVVVKRLKEVVVGKKDFEQQMEIVGRIGQHQNVVPLRAYYYSKDEKLLVYDYVPSGSLAAVLHGNKTTGRAPLDWETRVKISLGVARGIAHLHAEGSGKFTHGNLKSSNILLSQNLDGCASEFGLAQLMSNVPAPARLIGYRAPEVMETKKPTQKSDVYSFGVLLLEMLTGKAPLRSPGRDDSVGDLPRWVQSVVREEWTAEVFDVDLLRHPNIEDEMVQLLQVAMACVAIPPEQRPKMEEVVGRITEIRNSYSGAMTPPEETTLAPP

SEQ ID NO: 3712 - protein, 635 aa, Sorghum bicolor
MQHLTVIAFLAASLLIASIPHAKSADLNSDKQALLAFAASLPHGRKLNWSSTTPVCTSWVGVTCTPDKSRVHTLRLPAVGLFGPIPSDTLGKLDALEVLSLRSNRLTVDLPPDVGSIPALHSLYLQHNNLSGIIPTSLSSSLTFLDLSYNTFDGEIPLKVQNLTQLTALLLQNNSLSGPIPDLQLPKLRHLNLSNNNLSGPIPPSLQRFPSSSFLGNVFLCGFPLEPCFGTAPTPSPVSPPSTNKTKKSFWKKIRTGVLIAIAAVGGVLLLILIITLLICIFKRKRHTEPTTASSKGKAIAGGRAENPKEDYSSGVQEAERNKLVFFEGSSYNFDLEDLLRASAEVLGKGSYGTTYKAVLEDGTTVVVKRLKEVVVSKKDFEQQMEIVGRVGQHQNVIPLRAYYYSKDEKLLVFDYVPSGSLAAVLHGNKASGRAPLNWETRVKISLDVARGIAHLHAEGGGKFIHGNIKASNVLLSQNLDGCVSEFGLAQIMTTPQTAPRLVGYRAPEVLETKKSTQKSDVYSFGVLLLEMLTGKAPLRSPGREDSIEHLPRWVQSVVREEWTAEVFDVDLLRHPNVEDEMVQMLQIAMACVAIAPEQRPKMEEVIRRITEIRNSYSSGTRTPLEDKPETAQAP

SEQ ID NO: 3713 - protein, 631 aa, Oryza sativa
MPCRAPPPARQGQQRLISSSSSTSTSALLAFAASLPHGRKLNWSSAAPVCTSWVGVTCTPDNSRVQTLRLPAVGLFGPLPSDTLGKLDALEVLSLRSNRITVDLPPEVGSIPSLHSLYLQHNNLSGIIPTSLTSTLTFLDLSYNTFDGEIPLRVQNLTQLTALLLQNNSLSGPIPDLQLPKLRHLNLSNNNLSGPIPPSLQRFPANSFLGNAFLCGFPLQPCPGTAPSPSPSPTSPSPGKAKKGFWKRIRTGVIIALAAAGGVLLLILIVLLLICIFKRKKSTEPTTASSSKGKTVAGGRGENPKEEYSSGVQEAERNKLVFFEGCSYNFDLEDLLRASAEVLGKGSYGTTYKAVLEDGTTVVVKRLKEVVVGKKDFEQQMEIVGRVGQHQNVVPLRAYYYSKDEKLLVYDYIPSGSLAVVLHGNKATGKAPLDWETRVKISLGVARGIAHLHAEGGGKFIHGNLKSSNILLSQNLDGCVSEFGLAQLMTIPPAPARLVGYRAPEVLETKKPTQKSDVYSFGVLVLEMLTGKAPLRSPGREDSIEHLPRWVQSVVREEWTAEVFDVDLLRHPNIEDEMVQMLQVAMACVAAPPDQRPKMDEVIRRIVEIRNSYSGSRTPPEEKQKDESAAP

SEQ ID NO: 3714 - protein, 637 aa, Zea mays
MQHLTVIAFVAASLIASIPHAKSADLNSDKQALLAFAASLPRGRKLNWSSTTPVCTSWVGVTCTPDKSRVHTLRLPAVGLFGPIPSDTLGKLDALEVLSLRSNRLTVDLPPEVGSIPALHSLYLQHNNLSGIIPTSLSSSLTFLDLSYNTFDGEIPLKVQNLTQLTALLLQNNSLSGPIPDLQLPKLRHLNLSNNNLSGPIPPSLQRFPLSSFLGNAFLCGFPLEPCFGTAPIPSPVSPPSPNKIKKSFWKKIRTGVIIAIAAIGGVLLLILILMLVICIFKRKGHTEPTTASSKGKAIAGGRAENPKEDYSSGVQEAERNKLVFFGGSSYNFDLEDLLRASAEVLGKGSYGTTYKAVLEDGTTVVVKRLKEVVVSKKDFEQQMEIIGRVGQHQNVIPLRAYYYSKDEKLLVFDYVPSGSLAVVLHGNKADGRAPLNWETRVKISLDVARGIAHLHAEGGGKFIHGNIKASNVLLSQNLDGRVSEFGLAQIMTTPQTSLPQLVGYRAPEVLETKKTIQKSDVYSFGVLLLEMLTGKAPLRSPGRKDSVEHLPKWVRSVVREEWTAEIFDVDLLRHPNVEDEMVQMLQIAMACVAADPEQRPRMDEVIRRITEIRNSYSSSSGTRTPLEDRPETAQAP

SEQ ID NO: 3715 - protein, 637 aa, Zea mays
MQRLTAIVFVATSFLIASVPHAKSADLNSDKQALLAFAASLPHGRKLNWSSTTPVCTSWVGVTCTPDKSRVHTLRLPAVGLFGPIPSDTLGKLDALEVLSLRSNRLTVDLPPDVGSIPALHSLYLQHNNLSGIIPTSLSSSLTFLDLSYNTFDGEIPLKVQNLTQLTALLLQNNSLSGPIPDLQLPKLRHLNLSNNNLSGPIPPSLQRFPSSSFLGNSFLCGFPLEPCFGTAPSPSPVSPPSPSKTKKSLWKKIRTGVIIGIAVVGGVLLLILILVLLICIFKRKGHTEPTTASSKGKAIAGGRAENPKEDYSSGVQEAERNKLVFFEGSSFNFDLEDLLRASAEVLGKGSYGTTYKAVLEDATIVVVKRLKEVVVSKKDFEQQMEIIGRVGQHQNVIPLRAYYYSKDEKLLVFDYVPSGSLAAVLHGNKAAGRAPLNWETRVKISLDVAHGIAHLHTEGGGKFIHGNIKASNVLLSQNLDGCVSEFGLAQIMTTPQTPPRPVGYRAPEVLENKKSTQQSDVYSFGVLLLEMLTGKAPLRSPGREDPSVEHLPRWVQSVVREEWTAEVFDVDLLRHPNVEDEMVQMLQVAMACVAAHPEERPKMEEVIRRVTEVRNSYSSGTRTPLEDKPSETARAP

SEQ ID NO: 3716 - protein, 343 aa, Brassica oleracea
MAPTLQGEWIKVQQKGGEGPGARSSHGIAVVGDKLYSFGGERTPNISIDKHLYVFDFNTHTWSIAPANGQAPNVKALGTRMVAVGTKLYLFGGRDEKKQFDDFYSYDTVTKEWKFLTKLDEEGGPEARTYHSMASDENHVYVFGGVSKGGVMKTPFRFRTIEAYNIADGKWAQLPDPGEQYPTFERRGGAGFIVVQGKIWVVYGFATSPDPNGKNDYESDLVHYFDPATQKWTEVETKGEKPSPRSVFAHAAVGKYIIIFGGEVGPDPNGHYGPGTLTNEGYALNTESLVWEKFGGGAEPGELGWPAYTTATVYGKQGLLMHGGKRPTNNRTDEMYFYAVHSA

SEQ ID NO: 3717 - protein, 108 aa, Brassica napus
MAPTLQGEWIKVQQRGGQGPGPRSSHGIAVVGDKLYSFGGELTPNISIDKDLYVFDSTLTLGQSLQPRETFLTSRPWAPAWWLLELNSISSEAAMRINNLRTFIHTIP

SEQ ID NO: 3718 - protein, 343 aa, Brassica napus
MAPSVQGEWIKVEQKGGQTPGPRSSHGIAVVGDKLYSFGGELTPNISIDKDLYVFDFNTHTWSIAPSKGVAPDVKALGTRMVSVGTKLYLFGGRDENKKFDDFYSYDTVTNEWTKLTILDQEGGPEARTYHSMASDENHVYVFGGVSKGGTDKTPFRFRTIEAYNIADGKWAQLPDPGEQFPRFERRGGAGFVVVQGKIWVVYGFATSPDPNGKNDYESDQVQFYDPATQKWTEVETKGDKPSARSVFAHAVVGKYILIFGGETWPDPKAHLGPGTLSDEGFALDTETLVWERFGGGAEPGQLGWPGYTTATVYGKKGLLMHGGKRPTNNRTDELYFYAVNSA

SEQ ID NO: 3719 - protein, 343 aa, Brassica oleracea
MAPSVQGEWIKVEQKGGQTPGPRSSHGIAVVGDKLYSFGGELTPNISIDKDLYVFDFNTHTWSISPSKGVAPDVKALGTRMVSVGTKLYLFGGRDENKKFDDFYSYDTVTNEWTKLTILDQEGGPEARTYHSMASDENHVYVFGGVSKGGTNKTPFRFRTIEAYNIADGKWSQLPDPGEQFPRFERRGGAGFVVVQGKIWVVYGFATSPDPNGKNDYESDQVQFYDPATQKWTEVETKGDKPSARSVFGHAVVGKYILIFGGETWPDPKAHLGPGTLSDEGFALDTETLVWERFGGGAEPGQLGWPGYTTATVYGKKGLLMHGGKRPTNNRTDELYFYAVNSA

SEQ ID NO: 3720 - protein, 348 aa, Brassica napus
MDIAAVTPTLQGEWIKVEQKGGEGPGTRSSHGIAVVGDKLYSFGGELTPNISIDKDLYVFDFKTHTWSIETGSGDLPNVKALGTRMVPVGTKLYIFGGRDEHKQFDDFYSYDTVKKEWKFLTKLDEVGGPEARTFHSMAWDDNDVYVFGGVSKGGANKTPVRFRTIEAYNIAEGKWTQLPDPGEQLARFEKRGGAGFLVVQGKIWVVYGFATSPDPNGKNDYESDHVQFYDPVTQKWTEVETRGEKPSARSVFAHAVVGKYILIFGGETWPDPRAHLGPGTLSDEGYALDTETLVWERFGGGDEPSTRGWSAYTTATVYGKKGLIMHGGKLPTNNRTDELYFYAVNSA

SEQ ID NO: 3721 - protein, 374 aa, Solanum phureja
MAHSAISQVSVAVPLQTDSSFRRSTFKATSLTFSDKSCISMPSIDLKATRSRSQYIVCMSVQHASKAKVSVSPLSLEDAKEPPLNIYKPKEPYTATIVSVERIVGPKAPGETCHIVIDHDGNLPYWEGQSYGVVPPGENPKKPGSPHNVRLYSIASTRYGDSFDGKTASLCVRRAVYYDPETGKEDPSKNGVCSNFLCNAKSGDKVKITGPSGKIMLLPENNPNATHIMIGTGTGVAPFRGYLRRMFMESVPMKFNGLAWLFLGVANTDSLLYDDEFTKYLNDYPGNFRYDRALSREQKNNKGGKMYVQDKIEEYSDEIFKLLDEGAHIYFCGLKGMMPGIQDTLKRVAEERGESWEQKLSQLKKNKQWHVEVY

SEQ ID NO: 3722 - protein, 374 aa, Solanum tuberosum
MAHSAISQVSVAVPLQTDSSFRRSTFKATSLTFSDKSCISMPSIDLKATRSRSQYIVCMSVQHASKAKVSVSPLSLEDAKEPPLNIYKPKEPYTATIVSVERIVGPKAPGETCHIVIDHDGNLPYWEGQSYGVVPPGENPKKPGSPHNVRLYSIASTRYGDSFDGKTASLCVRRAVYYDPETGKEDPSKNGVCSNFLCNAKPGDKVKITGPSGKIMLLPENNPNATHIMIGTGTGVAPFRGYLRRMFMESVPIKFNGLAWLFLGVANTDSLLYDDEFTKYLSDYPGNFRYDRALSREQKNNKGGKMYVQDKIEEYSDEIFKLLDEGAHIYFCGLKGMMPGIQDTLKRVAEERGESWEQKLSQLKKNKQWHVEVY

SEQ ID NO: 3723 - protein, 374 aa, Solanum phureja
MAHSAISQVSVAVPLQTDSSFRRSTFKATSLTFSDKLCISMPSIDLKAARSRSQYIVCMSVQQASKAKVSVSPLSLEDAKEPPLNIYKPKEPYTATIVSVERIVGPKAPGETCHIVIDHDGNLPYWEGQSYGVVPPGENPKKPGSPHNVRLYSIASTRYGDSFDGKTASLCVRRAVYYDPETGKEDPSKNGVCSNFLCNAKPGDKVKITGPSGKIMLLPEDNLNATHIMIGTGTGVAPFRGYLRRMFMESVPIKFNGLAWLFLGVANTDSLLYDDEFTKYLSDYPGNFRYDRALSREQKNNKGGKMYVQDKIEEYSDEIFKLLDEGAHIYFCGLKGMMPGIQDTLKRVAEERGESWEQKLSQLKKNKQWHVEVY

SEQ ID NO: 3724 - protein, 375 aa, Nicotiana tabacum
MAHSALSQVSVAVPLQTDSSFRRSTFKATSVTFSDRSSWISMPPIDLKAPRSRNQHIVCMSVQQASKAKVSVSPLSLEDAKEPPLNIYKPKEPYTATIVSVERLVGPKAPGETCHIVIDHDGNLPYWEGQSYGVIPPGENPKKPGSPHNVRLYSIASTRYGDSFDGKTASLCVRRAVYYDPETGKEDPSKNGVCSNFLCDSKPGDKVKITGPSGKIMLLPEENPNATHIMIGTGTGVAPFRGYLRRMFMESVPTKFNGLAWLFLGVANTDSLLYDDEFTKYLNDYPGNFRYDRALSREQKNNKGGKMYVQDKIEEYSDEIFKLLDEGAHIYFCGLKGMMPGIQDTLKRVAERRGESWEQKLSQLKKNKQWHVEVY

SEQ ID NO: 3725 - protein, 375 aa, Nicotiana benthamiana
  misc_feature (295)..(295): Xaa can be any naturally occurring amino acid
MAHSALSQVSVAVPLQTDSSFRRSTFKATSITFSDRSSWISMPPIDLKALRSRNQYIVCMSVQQASKAKVSVSPLSLEDAKEPPLNIYKPKEPYTATIVSVERLVGPKAPGETCHIVIDHDGNLPYWEGQSYGVIPPGENPKKPGSPHNVRLYSIASTRYGDSFDGKTASLCIRRAVYYDPETGKEDPSKNGVCSNFLCDSKPGDKVKITGPSGKIMLLPEDNPNATHIMIGTGTGVAPFRGYLRRMFMESVPTKFNGLAWLFLGVANTDSLLYDDEFTKYLNDYPGNFRYDRAXSREQKNNKGGKMYVQDKIEEYSDEIFKLLDEGAHIYFCGLKGMMPGIQDTLKRVAEGRGESWEQKLSQLKKKKQWHVEVY

SEQ ID NO: 3726 - protein, 374 aa, Solanum melongena
MAHSAVSQVSVAVPLQTDSSFPRSMFKTTSLTFSDKSCFSMPSINLKAARSRSQYIVCMSVQQATKGKVSVSPLSLEDAKEPPLNIYKPKEPYTATIVSVERIVGPKAPGETCHIVINHDGNLPYWEGQSYGVIPPGENPKKPGSPHNVRLYSIASTRYGDSFDGKTASLCVRRAVYYDPETGKEDPSKNGVCSNYLCNSKPGDKVKITGPSGKIMLLPEDNPNATHIMIGTGTGVAPFRGCLRRMFMESVPVKFNGLAWLFLGVANADSLLYDDEFTKYLSDYPDNFRYDRAFSREQKNKKGGKMYVQDKIEEYSDEIFKLLDEGAHIYFCGLKGMMPGIQDTLKRVAEERGESWEQKLSQLKKNKQWHVEVY

SEQ ID NO: 3727 - protein, 375 aa, Capsicum annuum
MAHSAISQVSVAAPLQTESSFRRSTIKATNVTFTDKTWISMLHVNLQASRSRSQQIVCMSVKPASKDKVLVSPLSLEDAKEPPLNIYKPREPYTAKIVSIERIVGPKAPGETCHIVIDHGGNLPYWEGQSYGVIPPGENPKKPGSPHNVRLYSIASTRYGDSFDGKTASLCVRRAVYYDPETGKEDPSKNGVCSNFLCDSKPGDKVQITGPSGKIMLLPEDNPNATHIMIGTGTGVAPFRGYLRRMFMESVPTFKFNGLAWLFLGVANRDSLLYDEEFTSYLHEYPDNFRYDRALSREHKNKKGGKMYVQDKIEEYSDEIFKLLDEGAHIYFCGLKGMMPGIQDTLKRVAEERGESWEQKLSKLKKNKQWHVEVY

SEQ ID NO: 3728 - protein, 378 aa, Cucumis sativus
MAHSTFSQVAVAVPVGSDLSVKRSVFKTRSLNFHDKSWSSPVIALNSNLRGTRARGWQTVCMSVQQASAPKVSVAPLDLEDAKEPPLNLYKPKEPYTATIVSVERLVGPKAPGETCHIVIDHGGNVPYWEGQSYGVIPPGENPKKPGNPHNVRLYSIASTRYGDSFDGNTASLCVRRAVYYDPETGKEDPSKNGICSNYLCNSKPGDKVLITGPSGKIMLLPEDNPNATHIMIATGTGVAPFRGYLRRMFMESVPTFKFGGLAWLFLGVANTDSLLYDDEFSKYLKDYPDNFRYDRALSREQKNRNGGKMYVQDKIEEYSDEIFKLLDGGAHIYFCGLKGMMPGIQDTLKKVAEQRGEKWEEKLSQLKKNKQWHVEVY

SEQ ID NO: 3729 - protein, 377 aa, Phaseolus coccineus
MFHLTLSQVAVTVPVSSDLSLRRSAFKAPNLNFWDKSWSPVLTLDLKANSSRLRSQNVVCMSVQQASVPKVSVSPLDLEDAKETPLNLYKPKEPYTATIVSVDRLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIKITGPSGKIMLLPEEDPNATHIMIATGTGVAPFRGYLRRMFMESVPTYKFGGLAWLFLGVANSDSLLYDDEFSKYLKDYPNNFRFDRALSREQKNKKGGKMYVQDKIEEYSDEIFKLLDNGAHIYFCGLRGMMPGIQDTLKRVAEQRGESWEEKLSQLKKNKQWHVEVY

SEQ ID NO: 3730 - protein, 377 aa, Vigna unguiculata
MFHLTLSQAAVTVPVGSDLSLRRSAFKAPNLNFRDKSWAPVLTLDLKANSSCLRSRNVVCMSVQQASVPKVSVSPLELEDAEEPPLNLYKPKEPYTATIVSVERLVGPKAPGETCHIVIDHGGNVPYWEGQSYGVIPPGENPKKPGAPHNVRLYSIASTRYGDSFDGKTASLCVRRAVYYDPETGKEDPSKNGVCSNFLCDSKPGDKIKITGPSGKIMLLPEDDPNATHIMIATGTGVAPYRGYLRRMFMESVPNYKFGGLAWLFLGVANSDSLLYDEEFSKYLKDYPNNFRYDRALSREQKNKNGGKMYVQDKIEEYSDEIFKLLDNGAHIYFCGLKGMMPGIQDTLKRVAEQRGESWEEKLSQLKKNKQWHVEVY

SEQ ID NO: 3731 - protein, 379 aa, Cucumis melo
MAHSTFSQVAVAVPVGSDLSVKRSVFKTSSLNFHDKPWSPVIALNLSLRGTRARGWQRQTVCMSVQQASAPKVSVAPLDLEDAKEPPLNLYKPKEPYTATIVSVERLVGPKAPGETCHIVIDHGGNVPYWEGQSYGVIPPGENPKKPGSPHNVRLYSIASTRYGDSFDGKTASLCVRRAVYYDPETGKEDPSKNGICSNYLCNSKPGDKVLITGPSGKIMLLPEDNPNATHIMIATGTGVAPFRGYLRRMFMESVPTFKFGGLAWLFLGVANTDSLLYDDEFSKYLKDYPDNFRYDRALSREQKNKSGGKMYVQDKIEEYSDEIFKLLDGGAHIYFCGLKGMMPGIQDTLKKVAEQRGEKWEEKLSQLKKNKQWHVEVY

SEQ ID NO: 3732 - protein, 377 aa, Eucalyptus grandis
MAHSAVSQVSVAVPVGSDSSIRRSVFKAHTLSFCGTLRAPVLTLDLSTKNARSKKGYTICMSVQQANAPKVAVSPLQLEDAKEPPLNTFKPKEPYTATIVSVERLVGPKAPGEVCHVVIDHGGNVPYWEGQSYGVIPPGENPKKPGNPHNVRLYSIASTRYGDSFDGRTASLCVRRALYYDPETGKEDPSKSGVCSNFLCNAKPGDKVKITGPSGKIMLLPEDNPNATHIMIATGTGIAPFRGYLRRMFMESVPTYKFGGLAWLFLGVANSDSLLYDDEFSKYLRDYPDNFRYDTALSREQNNKKGGKMYVQDKIEEYSDEIFKLLDEGAHIYFCGLKGMMPGIQDTLKRVAVERGESWEEKLSQLKKNKQWHVEVY

SEQ ID NO: 3733 - protein, 377 aa, Momordica charantia
MAHSTFSQVSVVVPVGSDLSVKRSVFKANSLNFHDKSWSPVLALDLNRRSTRVRGWQTVCMSVQQASVPKVSVAPLQLEDVKEPPLNLYKPKEPYTATIVSVERLVGPKAPGETCHIVIDHGGNVPYWEGQSYGVIPPGENPKKPGNPHNVRLYSIASTRYGDSFDGKTASLCVRRAVYYDPETGKEDPSKNGVCSNFLCDSKPGDKIQITGPSGKIMLLPEDDPNATHIMIATGTGVAPFRGYLRRMFMESVPTFKFGGLAWLFLGVANNDSLLYDDEFSKYLKDYPDNFRYDRALSREQKNKTGGKMYVQDKIEEYSDEIFKLLDGGAHIYFCGLKGMMPGIQETLKRVAEQRGEKWEEKLSQLKKNKQWHVEVY

SEQ ID NO: 3734 - protein, 379 aa, Cucumis melo
  misc_feature (184)..(184): Xaa can be any naturally occurring amino acid
MAHSTFSQVAVAVPVGSDLSVKRSVFKTSSLNFHDKPWSPVIALNLSLRGTRARGWQRQTVCMSVQQASAPKVSVAPLDLEDAKEPPLNLYKPKEPYTATIVSVERLVGPKAPGETCHIVIDHGGNVPYWEGQSYGVIPPGENPKKPGSPHNVRLYSIASTRYGDSFDGKTASLCVRRAVYYDXETGKEDPSKNGICSNYLCNSKPGDKVLITGPSGKIMLLPEDNPNATHIMIATGTGVAPFRGYLRRMFMESVPTFKFGGLAWLFLGVANTDSLLYDDEFSKYLKDYPDNFRYDRALSREQKNKSGGKMYVQDKIEEYSDEIFKLLDGGAHIYFCGLKGMMPGIQDTLKKVAEQRGEKWEEKLSQLKKNKQWHVEVY

SEQ ID NO: 3735 - protein, 377 aa, Cajanus cajan
MAPLALSQMAATVPVGNDLTLRRSAFKAPSLNFSNKSWAPVFTLDLKANNSCLRSRQVICMSVQQASAPKVTVSPLELEDAKEPPLNLYKPKEPYTATIVSVERLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFMESVPTFKFGGLAWLFLGVANSDSLLYDDEFSKYLKDHPNNFRYDRALSREQKNKNGGKMYVQDKIEEYSDEIFKLLDNGAHIYFCGLKGMMPGIQDTLKRVAEQRGESWEEKLSQLKKNKQWHVEVY

SEQ ID NO: 3736 - protein, 377 aa, Arachis hypogaea
MAHLIASQVAVAVPLGNDLSLKRTALKVSNLNFQDKSWALVLTFDLKASNSQLRSLRVTCMSVQQASVPKVTVSPLELEDANEPPLNIYKPKEPYTATIVSVERLVGPKAPGETCHIVIDHGGNVPYWEGQSYGVIPPGENPKKPGSPHNVRLYSIASTRYGDNFDGKTASLCVRRAVYYDSEIGKEDPSKQGVCSNFLCNSKPGDKIKITGPSGKIMLLPEDDPNATHIMIATGTGVAPFRGYLRRMFMELVPKFKFGGLAWLFLGVANTDSLLYDDEFTKYLKDYPDNFRYDKALSREQKNRSRGKMYVQDKIEEYSDEIFKLLDNGAHIYFCGLKGMMPGIQDTLKKVAEQRGENWEEKLSQLKKNKQWHVEVY

SEQ ID NO: 3737 - protein, 377 aa, Glycine max
MAHLALSQMAVTVPVGNDLSLRRSAVKAPNLNFWDKSWAPVFTLDLKPNNPSLRSRHVVCMSVQQASVSKVNVSPLELEDAKEPPLNLYKPKEPYTATIVSVDRLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFMESVPAYKFGGLAWLFLGVANTDSLLYDDEFSKYLKDYPDNFRYNRALSREQKNKSGGKMYVQDKIEEYSDEIFKLLDNGAHIYFCGLKGMMPGIQDTLKKVAEQRGESWEEKLSQLKKNKQWHVEVY

SEQ ID NO: 3738 - protein, 378 aa, Citrus sinensis
MAHSAVSQVAVAVPVGTDSTLRSAPLFKTQNLRLGEKSWAPVLSLDLKSRNPRLRNRYVVCMSVQQASKSKVAVSPLELEERSQPPLNLYKPKEPYTATIVSVERVVGAKAPGETCHIVIDHGGNVPYWEGQSYGVIPPGENPKKPGNPHNVRLYSIASTRYGDSFDGKTASLCVRRAVYYDPESGKEDPSKSGICSNFLCNSKPGDKVLITGPSGKIMLLPEDNPNATHIMIATGTGIAPFRGYLRRMFMESVPTYKFGGLAWLFLGVANPDSLLYDDEFTKYLQDYPDNFRYDKALSREQKNKKGGKMYVQDKIEEYSDEIFKRLDGGAHIYFCGLKGMMPGIQETLKRVAEQRGESWDQKLSQLKKNKQWHVEVY

SEQ ID NO: 3739 - protein, 377 aa, Arachis hypogaea
MAHLALSQVAVAVPVSSDLSLRRSAFKVSNLNFQDKSWAPVLTFNLKANNSRSRSRRVTCMSVQQTSAPKVTVSPLELEDANEPPLNIYKPKEPYTATIVSVERLVGPKAPGETCHIVIDHGGNVPYWEGQSYGVIPPGENPKKPGSPHNVRLYSIASTRYGDNFDGKTASLCVRRAVYYDPDTGKEDPSKQGVCSNFLCNSKPGDKIKITGPSGKIMLLPEDDPNAAHIMIATGTGVAPFRGYLRRMFMESVPKFKFGGLAWLFLGVANSDSLLYDDEFNKYLKDYPDNFLYDKALSREQKNRSGGKMYVQDKIEEYSDEIFRLLDNGAHIYFCGLKGMMPGIQDTLKKVADQRGENWEEKLSQLKKNKQWHVEVY

SEQ ID NO: 3740 - protein, 377 aa, Prunus persica
MSHLAISQGSLTAPVGSDFSIRRSVFKAQSINFNDKSWAPLLSLDLKTKNGGLRNQRIVCMSVQQASVPKVAVSPLQLEDANEPPLNTYKPKEPYTATIRSVERIVGPKAPGETCHIVIDHGGNVPYWEGQSYGVIPPGENPKKPGAPQNVRLYSIASSRYGDYFDGKTTSLCVRRAVYYDPETGKEDPSKNGVCSNFLCNSKPGDKIKITGPAGKIMLLPEDNPNATHIMIATGTGVAPYRGYLRRMFMESVPKFKFGGLAWLFLGVANTDSLLYDEEFTKYLKDYPDNFRYDIALSREHKNNRGGKMYVQDKIEEYSDEIFKLLDNGAHIYFCGLRGMMPGIQETLKRVADGRGENWEEKLSQLKKNKQWHVEVY

SEQ ID NO: 3741 - protein, 377 aa, Manihot esculenta
MAHSAAVSQVSFAVPIGSDSTLRRSVLKPHSIRFSDKSWAPSLAVDLKPRNAQLQSRYIVCMSVQQARRSKVAVLPSDLEDAKEPPLNTYKPKEPYTATIVSVERLVGPKAPGETCHIVIDHGGNVPYWEGQSYGVIPPGENPKKPGAPHNVRLYSIASSRYGDNFDGKTATLCVRRALYYDPETGKEDPSKSGICSNFLCNSKPGDKVQITGPSGKIMLLPEDNPSATHIMIATGTGVAPFRGYLRRMFMENVSFKFSGLAWLFLGVANTDSLLYDDEFTKYLQDYPDQFLYDKALSREQKNKSGGKMYVQDKIEEYSDEIFKLLDGGAHIYFCGLKGMMPGIQDTLKRVAEQRGESWEQKLSQLKKNKQWHVEVY

SEQ ID NO: 3742 - protein, 378 aa, Ricinus communis
MAHSAAVSQVSLAVPVGSDSTLKRSVFKTHSISFSGKSWAPSLALDLKSRKVQLKNQYVVCMSVQQASRSKVAVSPLELEDAKEPPLNLYKPKEPYTATIASVERLVGPKAPGETCHIVIDHGGNVPYWEGQSYGVIPPGENPKKPGAPHNVRLYSIASTRYGDNFDGKTATLCVRRALYYDPETGKEDPSKMGICSNFLCNSKPGDKVQITGPSGKIMLLPESDPNATHIMIATGTGVAPFRGYLRRMFMEDVPTFKFGGLAWLFLGVANTDSLLYDDEFTKYLEDYPDHFRYDKALSREQKNKNGGKMYVQDKIEEYSDEIFKLLDGGAHIYFCGLKGMMPGIQDTLKKVAEQRGESWDQKLSQLKKNKQWHVEVY

SEQ ID NO: 3743 - protein, 377 aa, Quercus alba
MAQLAASQVAVTVPVGSDLSTRRSVFKTHSISFHDKSWAPSLSLDLKTKNARLRNRHIICQSVQQASVPKVTVSPLNLEDAKEPPLNTYKPKEPYTATIVSVERIVGPKAPGETCHIVIDHGGNVPYWEGQSYGIIPPGENPKKPGSPQNVRLYSIASTRYGDTFDGKTASFCVRRAVYYDPETGKEDPSKNGVCSNFLCNSKPGDKVRVTGPSGKIMLLPEDNPNATHIMIATGTGVAPYRGYLRRMFMEAVPTFKFNGLAWLFLGVANSDSLLYDDEFKKYLKDYPDNFRYDLALSREQKSKSGGKMYVQDKIEEYSDEIFKLLDTGAHIYFCGLKGMMPGIQETLKRVADQRGENWEEKLSQLKKNKQWHVEVY

SEQ ID NO: 3744 - protein, 378 aa, Manihot esculenta
MAHSAAVSQVSFAVPVGSDSTLGRSVLKPHIISFSDKSWGPSLALDLKSRNARLQNRFIVCMSVQQASRSKVSVSPIEYEDDKEPPLNLYKPKEPYTATIVSVERLVGPKAPGETCHIVIDHGGNVPYWEGQSYGVIPPGENPKKPGAPHNVRLYSIASTRYGDNFDGKTATLCVRRALYYDPETGKEDPSKGGICSNFLCNSKPGDKVQITGPSGKIMLLPEDNPNATHIMIATGTGVAPFRGYLRRMFMEDVPRYKFGGLAWLFLGVANSDSLLYDDEFTKYLQDYPDHFRYDKALSREQKNKSGGKMYVQDKIEEYSDEIFKLLDGGAHIYFCGLKGMMPGIQDTLKKVAQQRGESWEQKLSQLKKNKQWHVEVY

SEQ ID NO: 3745 - protein, 377 aa, Glycine max
MAHLALSQMAVTVPVGSDLSLRRSAVKAPNFNFWDKSWAPVFTLYLKANNSSLRSRHVVFMSVQQASVPKVNVSPLELEDAKEPPLNLHKPKEPYTATIVSVDRLVGPKAPGETCHIVIDHGGNVPYWEGQSYGVIPPGENPKKPGAPHNVRLYSIASTRYGDFFDGKTASLCVRRAVYYDPETGKEDPSKNGICSNFLCNSKPGDKIQITGPSGKIMLLPEDDPNATHIMIATGTGVAPFRGYLRRMFLESVPTYKFGGLAWLFLGVANTDSLLYDEEFSKYLNDYSDNFRYDRALSREQKNKNGGKMYVQDKIEEYSDEIFKLLDNGAHIYFCGLKGMMPGIQDTLKKVAEQRGESWEEKLSQLKKNKQWHVEVY

SEQ ID NO: 3746 - protein, 379 aa, Malus domestica
MSHLALSQGSLTVTVPLGSDFSLRRSVFKARSVSFNDKSWTPILPLDFKTKNGRLRNQRILCMSVQQASAPKVNVAPLQLEDANEPPLNTYKPKEPYTATILSVERIVGPNAPGETCHIVIDHGGNVPYWEGQSYGVIPPGENPKKPGAPQNVRLYSIASTRYGDYFDGKTTSLCVRRAVYYDPETGKEDPSKNGVCSNFLCNSKPGDKIKITGPAGKIMLLPEDNPNATHIMIATGTGVAPYRGYLRRMFMESVPKFKFGGLAWLFLGVANTDSLLYDEEFTKYLKDYPDNFRYNIALSREQKNQRGGKMYVQDKIEEYSDEIFKLLDNGAHIYFCGLKGMMPGIQETLKRVAVERGESWEEKLSQLKKNKQWHVEVY

SEQ ID NO: 3747 - protein, 377 aa, Actinidia deliciosa
MAQSAVSQVSLTVPLNSDLSFRKSVLKVHNISFREKSRVAVSPLEVNARNVRSRNQFVVCMLVQQASKPKVFVSPLALEDPKEPPINLHKPKEPYTATIVSVERIVGPKAPGETCHIVIDHGGNVPYWEGQSYGVIPPGENPKKPGAPHNVRLYSIASTRYGDFFDGKTASLCVRRAIYYDPETGKEDPSKNGVCSNFLCDSKPGDKIEVTGPSGKIMLLPEDDSNAAHIMIATGTGVAPFRGYLRRMFMESVPSFKFGGLAWLFLGVANTDSLLYDEEFTKYLQDYPENFRYDRALSREQKNQSGGKMYVQDKIEEYSDEIFKLLDGGAHIYFCGLKGMMPGIQDTLKRVAEQRGESWEEKLSQLKKNKQWHVEVY

SEQ ID NO: 3748 - protein, 375 aa, Aristolochia fimbriata
MAHLAVAQASVSVPISNDTFPRSHGFKAYNLRIQDKPWGPLVNLKANYASSRSQWRICMSVQQATRSKVTVSPLTLEDAKDPPINTFKPKEPYTATIVSVERIVGPKAPGETCHIVIDHGGNVPYWEGQSYGVIPPGENPKKPGSPNNVRLYSIASTRYGDAFDGKTASLCVRRAVYYEAETGKEDPSKKGVCSNFLCDSKPGDKVKITGPSGKVMLLPEEDPNATHIMIATGTGVAPFRGYLRRMFMESVPTFKFNGLAWLFLGVANTDSLLYDEEFTKYLEDYPDNFRYDKALSREQKNRNGGKMYVQDKIEEYSDEIFKRLDGGAHIYFCGLKGMMPGIQETLKRVAEERGESWEEKLSQLKKNKQWHVEVY

SEQ ID NO: 3749 - protein, 308 aa, Tropaeolum majus
MAQSAASQVAIAVPAVGSETSLRRSVFKTHSVNFSNKSWVLALTFDLNSRNARMKNQFTVCMSVQQASPTKVAVSPIDLEDAKEPPLNLHKPKEPYTATIVSVERIVGPKAPGETCHIVIDHDGNVPYWEGQSYGVIPPGENPKKPGAPHNVRLYSIASTRYGDNFDGKTGSLCVRRAVYYDPETGKEDPSKNGVCSNYLCNSKPGDKIKITGPAGKIMLLPEDDPKATHIMIATGTGVAPYRGYLRRMFMENVPTYKFGGLAWLFLGVANNDSLLYDDEFTKYLQDYPDNFRYDKAHRQGTEEQERR

SEQ ID NO: 3750 - protein, 376 aa, Gossypium hirsutum
MAQSTVSQVSVAVPVGNDISLRRSVTNRNIISFGNKSWASTLSFDLKSRNAQKNKPYIVCMSVQQASKSKIAVSPLELEIAKEPPLNTFKPKEPYTATIVSVERLVGPKAPGETCHIVIDHGGNVPYWEGQSYGVIPPGENPKKPGSPHNVRLYSIASSRYGDSFDGKTTSLCVRRAVYYNPETGKEDPSKSGVCSNFLCNCKPGDKVQITGPSGKIMLLPEDNPKANHIMIATGTGVAPFRGYLRRMFMEDVTFKFKGLAWLFLGVANKDSLLYDDEFTKYLEDYPDQFRYDLALSREQKNKSGGKMYVQDKIEEYSDEIFKLLDDGAHIYFCGLRGMMPGIQETLKRVAEQRGENWDEKLSQLKKNKQWHVEVY

SEQ ID NO: 3751 - protein, 381 aa, Tragopogon dubius
MAAAHCGVAFQGSVTTPLNSDTSLHRSIFKTGKISFTDKPWMSFSPMELKTKNTRSRYQSIVSMSTPQAVGSAKVSVAPLALEDAKEPPLNTYKPKEPYTATIVSVERIVGPKAPGETCHVVIDHGGNVPYWEGQSYGVIPPGENPKKPGAPHNVRLYSIASTRYGDSFDGKTASLCVRRAVYYDPETGKEDPSKNGICSNFLCNSKPGDKVKITGPSGKIMLLPEDNPNATHIMIATGTGVAPYRGYLRRMFMEAVPKYKFTGLSWLFLGVANKDSLLYDDEFRKYLEDNPGNFRYDIALSREEKNKNGGKMYVQDKIEEYSDEIFKLLDEGAHIYFCGLKGMMPGIQDTLKRVAEGRGEKWEDKLSVLKKNKQWHVEVY

SEQ ID NO: 3752 - protein, 383 aa, Aquilegia formosa
MAHLALTQFQLVSSPTDASLKTSVAGFKQGFIKTQSLRFQYPSGIPLLSSDLKSRNLHSTNKYQVCMSVGQAVTPKVAVSPLELDDAIEPPLNTYKPKGPYTATIVSVERIVGPKAPGETCHIVIDHDGNVPYWEGQSYGVIPPGENPKKPGAPHNVRLYSIASTRYGDSFDGKTGSLCVRRAVYYDPETGKEDPSKNGICSNFLCNSKPGDKVQITGPSGKIMLLPEDNPNATHIMIATGTGVAPFRGYLRRMFMESVPKFKFGGLAWLFLGVANTDSLLYDDEFSKYLQDYPDNFRFDRALSREQKNKNGGKMYVQDKIEEYSDEIFKLLDEGAHIYFCGLKGMMPGIQETLKRVADERGENWETKLSQLKKNKQWHVEVY

SEQ ID NO: 3753 - protein, 378 aa, Populus trichocarpa
MAHLAALSQVSFAVPAGSDTTLRRSAFKIQNISFGDKSWHPASSLDLKSRNTGLKKRLLVCMSVQQASRSKVAVSPLGLEDAKEPPLNTYKPKEPYTATIVSVERIVGPNAPGETCHVVIDHGGNVPYWEGQSYGVIPPGENPKKPGAPHNVRLYSIASTRYGDSFDGKTASLCVRRAVYYDPETGKEDPSKSGVCSNFLCNSKPGDKVQITGPSGKIMLLPEDDPNATHIMIATGTGVAPFRGYLRRMFMEAVPTYKFGGLAWLFLGVANNDSLLYDEEFAKYLQDNPDHFRYDKALSREQKNKSGGKMYVQDKIEEYSDEIFKRLDDGAHIYFCGLKGMMPGIQDTLKKVAEQRGEKWDEKLSQLKKKKQWHVEVY

SEQ ID NO: 3754 - protein, 298 aa, Prunus persica
  misc_feature (7)..(7): Xaa can be any naturally occurring amino acid
  misc_feature (13)..(14): Xaa can be any naturally occurring amino acid
  misc_feature (26)..(26): Xaa can be any naturally occurring amino acid
  misc_feature (36)..(36): Xaa can be any naturally occurring amino acid
  misc_feature (45)..(46): Xaa can be any naturally occurring amino acid
MLMSPHXIHTSLXXLILQPFVLLRRXVGPKAPGETXHIVIDHGGXXPYWEGQSYGVIPPGENPKKPGAPQNVRLYSIASSRYGDYFDGKTTSLCVRRAVYYDPETGKEDPSKNGVCSNFLCNSKPGDKIKITGPAGKIMLLPEDNPNATHIMIATGTGVAPYRGYLRRMFMESVPKFKFGGLAWLFLGVANTDSLLYDEEFTKYLKDYPDNFRYNIALSREHKNNRGGKMYVQDKIEEYSDEIFKLLDDGAHIYFCGLRGMMPGIQETLKRVADGRGENWEEKLSQLKKNKQWHVEVY

SEQ ID NO: 3755 - protein, 379 aa, Artemisia annua
MAAASAHLGVAYQGSVTTQLNNDKSLFLKTQKVSFGDKPWARFSPLELKSNTTPSRYQSIVSMSVPQAVSTPKVAVSPLDLEDAKEPPLNLHKPKEPYTATIVSVERLVGPKAPGETCHIVIDHGGNIPYWEGQSYGVIPPGENPKKPGAPHNVRLYSIASTRYGDSFDGKTASLCVRRAVYYDPETGKEDPSKNGVCSNFLCDSKPGDKVKIAGPSGKIMLLPEDDPNATHIMIATGTGVAPYRGYLRRMFMESVPNKFNGLAWLFLGVANNDSLLYDDEFSKYLVDYPDNFRYDRALSREQKNKNGGKMYVQDKIEEYSDEIFKLLDNGAHIYFCGLKGMMPGIQETLKRVAVERGESWDEKLSQLKKNKQWHVEVY

SEQ ID NO: 3756 - protein, 377 aa, Orobanche aegyptiaca
MAHSALSQVPICVPLNTDLSLPRFVFKNNNVPLRGKSLALGLSSDPKIANSRSKNRFVVRMSVQQVIKPKVGISPLSLEDSKEPPLHLFKNKEPYTATIVSVERLVGPKAPGETCHIVIDHGGNVPYWEGQSYGVIPPGENPKKPGNPHNVRLYSIASSRYGDSFDGKTASLCVRRAVYYDPETGKEDPSKNGVCSNFLCDSKPGDKVQITGPSGKIMLLPEDDPNATHIMIGTGTGVAPFRGYLRRMFMEAVPTFKFNGLAWLFLGVANTDSLLYDEEFSKYLRDRPDNFRFDRALSREQKNRNGGKMYVQDKIEEYSDEIFKLLDDGAHIYFCGLKGMMPGIQATLKKVAENRGESWDEKLSQLKKNKQWHVEVY

SEQ ID NO: 3757 - protein, 376 aa, Gossypium hirsutum
MAQSTVSQVSVAVPVGNDISLRRSVTNRNIISFGNKSWASTLAFDLKSRNAQKNKPYIVCLSVQQASKSKIAVSPLELEIAKEPPLNTFKPKEPYTATIVSVERLVGPKAPGETCHIVIDHGGNVPYWEGQSYGVIPPGENPKKPGSPHNVRLYSIASSRYGDSFDGKTTSLCVRRAVYYNPETGKEDPSKSGVCSNFLCNCKPGDKVQITGPSGKIMLLPEDNPKANHIMIATGTGVAPFRGYLRRMFMEDVTFKFKGLAWLFLGVANKDSLLYDDEFTKYLEDYPDQFRYDLALSREQKNKSGGKMYVQDKIEEYSDEIFKLLDDGAHIYFCGLRGMMPGIQETLKRVAEQRGENWDEKLSQLKKNKQWHVEVY

SEQ ID NO: 3758 - protein, 293 aa, Zea mays
MAMATAKLVLLMVLVAGSSSGGSAWGPLMSRLRMPTARSPVEVAKERLQEDYVVSAAAPLIHALRPLLGSAGDLGRRAGVPCDSWRLAVETYNKRDWTTVPASCERYVGHYMLGGHYRRDSRVVIDEAIAYAEGLKLGGNGKEVWVFDIDETSLSNLPYYATHGFGTKLYNATSFNEYVLEGSAPVLPETQRLFKKLVSLGIKPVFLTGRTEDQRAITVTNLRRQGYSGWMTLLLKPVGLKATAIAYKSGERQKLQDAGYVIVGNIGDQWSDILGAPEGARTFKLPDPLYYIG

SEQ ID NO: 3759 - protein, 253 aa, Solanum phureja
MGVVHTLHFVFGIFGNATALFLFLAPIITFKRVIQNRSTEQFSGLPYVMTLLNCLLSAWYGLPFVSPNNLLVSTINGTGAVIETIYVLIFIAFAPSKEKKKISALLLLVLTVFAAVALVSMLALHGSKRKLFCGIAATIFSIIMYGSPLSIIRLVIKTKSVEFMPFFLSLFVFLCGASWFAFGLLGKDPFVAIPNGFGFGLGTVQLILYAIYCEKKGFTKKSTFDESLTTGNVKSHQEEKQSSNNNKSKLEQV

SEQ ID NO: 3760 - protein, 227 aa, Theobroma cacao
MSLTIPTNLSKPLLKPKLNSQVTPKVSRSLVVCSSTPSSDKSSTSPSASPLQAFSAALALSSILLSAPQPAVADISGLTPCKESKQFAKREKQQIKKLESSLNLYAPDSAPALAIKATIEKTKRRFDNYGKYGLLCGSDGLPHLIVNGDQRHWGEFITPGLLFLYIAGWIGWVGRSYLIAIRDDKKPAMKEIIIDVPLASSLLFRGFIWPVAAYRDLVNGDLIAKDV

SEQ ID NO: 3761 - protein, 224 aa, Populus trichocarpa
MSLTIPSNLSMLKPKLGVSQMTPIKPRSMIVCSASQTPSTQEKSSSPLQAFSAALALSSILLSAPLPAVADISGLTPCKDSKQFAKREKQQIKKLESSLKLYSPDSAPALAIKATVEKTKRRFDNYGKQGLLCGSDGLPHLIVSGDQRHWGEFITPGILFLYIAGWIGWVGRSYLIAISDEKKPAMKEIIIDVPLATGLIFRGFSWPVAAYREFVNGDLVVKDV

SEQ ID NO: 3762 - protein, 225 aa, Quercus alba
MSLTIPTNLSKPILKPKLSSSPIPKSRPTIVCSSQNSNQDEQNTTSPLKAFSAALALSSILVSAPVLPANADIAGLTPCKESKQFAKREKQQIKKLESSLKLYAPDSAPALAIKASVEKTKRRFDNYGKQGLLCGSDGLPHLIVSGDQRHWGEFITPGILFLYIAGWIGWVGRSYLIAIRDEKKPTQKEIIIDVPLASSLLFRGFIWPVAAYRELVNGDLVVKDV

SEQ ID NO: 3763 - protein, 223 aa, Carica papaya
MSLTIPSNLSKPILKPRLNSPTKQLRPSIVCSSSGTTQEKTSSTSPLQAFSAALALSSILLSAPLPAVADISGLTPCKESKQFAKREKQQLKKLESSLKLYAPDSAPALAINATIEKTKRRFDNYGKQGLLCGSDGLPHLIVNGDQRHWGEFITPGILFLYIAGWIGWVGRSYLIAISDDKKPAMKEIIIDVPLASRLLFRGFSWPVAAYREFVNGDLVVKDV

SEQ ID NO: 3764 - protein, 228 aa, Manihot esculenta
MSLTIPANLSKPMLKPKLGSPLNPSKLSSSSRATVVCSAAQTPEKDSSKSPLQAFSAALALSSILLSAPLPAVADISGLTPCKESKQFAKREKQQIKKLESSLKLYAPDSAPALAIKATVEKTKRRFDNYGKQGLLCGADGLPHLIVSGDQRHWGEFITPGILFLYIAGWIGWVGRSYLIAIRGEKKPAMKEIIIDVPLATGLIFRGFSWPVAAYREFVNGELVVKDV

SEQ ID NO: 3765 - protein, 224 aa, Linum usitatissimum
MSLTIPTNLSNPLLKLNTKLTPKPQSRSLIVCSASSNDNSTTTATPLKAFSAALALSSILLTSAPLPATADIAGLTPCKDSKQFAKREKQSLKKLESSLKIYAPDSAPALAIKATMEKTKRRFANYAKQGLLCGSDGLPHLIVSGDQKHWGEFITPGILFLYIAGWIGWVGRSYLIAISGEKKPAMKEIIIDVPLATGIIFRGFSWPIAAYRELINGDLVVKDV

SEQ ID NO: 3766 - protein, 223 aa, Linum usitatissimum
MSLTIPNNLSNPLLKLNTKLTPKPQSRSLIVCSASSNDSTTTATPLKAFSAALALSSILLTSAPLPATADIAGLTPCKDSKQFAKREKQSLKKLESSLKIYAPDSAPALAIKATMEKTKRRFTNYAKQGLLCGSDGLPHLIVSGDQKHWGEFITPGILFLYIAGWIGWVGRSYLIAISGEKKPAMKEIIIDVPLATGIIFRGFSWPIAAYRELINGDLVVKDV

SEQ ID NO: 3767 - protein, 224 aa, Tropaeolum majus
MSLTIPANLSKSILKPKLNSQLSHKHGKPMIICCQNQSQDKPSSTSPLQGFTAALALSSILLSAPLPAVADISGLTPCKDSKQFAKREKQQIKKLESSLKLYAPDSAPALAINATIEKTKRRFDNYGKQGLLCGADGLPHLIVSGDQRHWGEFITPGILFLYIAGWIGWVGRSYLIAISGEKKPAMKEIIIDVPLASKLVFRGFSWPVAAYREFLNGELIAKDV

SEQ ID NO: 3768 - protein, 231 aa, Bruguiera gymnorhiza
MSLTIPITNLSKTLLAPKLGSPTKSSRTSVSTNVVVCSASTQEKEKENASSASPLPAFSAALALSSILLSAPLPAVADISGLTPCKESKQFAKREKQQIKKLESSLKLYAPDSAPALAIQASIEKTKRRFENYGNQGLLCGSDGLPHLIVSGDQRHWGEFITPGILFLYIAGWIGWVGRSYLIAIRDEKKPAMKEIIIDVPLPSRLIFRGFSWPVAAYREFVNGDLVVKDV

SEQ ID NO: 3769 - protein, 229 aa, Prunus persica
MSLTIPTNLSKPMLKPKFSSPLATKLPRTVVFCSASQTPNPTPEKISTASPMQAFSAALALSSILLGSAPMPAVADIAGLTPCKDSKQFAKREKQQIKKLESSLKLYAPDSAPALAINATIEKTQRRFANYGKQGLLCGSDGLPHLIVSGDQRHWGEFITPGILFLYIAGWIGWVGRSYLIAIRDDKKPTQKEIIIDVPLATSLVFRGFIWPVAAYRELVNGELIAKDV

SEQ ID NO: 3770 - protein, 223 aa, Cicer arietinum
MSLTIPTNLSKPITTLRPKLTQKPKHSSTIIHCSTNQESNSNSNSNLKAFSAALALSSILISSPLPATADISGLTPCKESKQFAKREKQQIKKLESSLKLYGPDSAPALAIKATVEKTKRRFENYGKQGLLCGADGLPHLIVSGDQRHWGEFITPGVLFLYIAGWIGWVGRSYLIAIRDEKKPTQKEIIIDVPLASRLVFRGFSWPIAAYREFLNGELIAKDV

SEQ ID NO: 3771 - protein, 359 aa, Theobroma cacao
MAVETPNHTQTVGGWAAYDSSGKIAPYIFKRRENGVNDVTIKVLYCGICHTDLHHVKNDWGITMYPVVPGHEITGVITKVGSNVKNFKVGDRVGVGCLAASCLECEFCKSSQENYCDQIQFTYNGIFWDGSITYGGYSKMLVADHRYVVRVPDNLPMDAAAPLLCAGITVFSPMKDSQLLESPGKMVGIVGLGGLGHVAVKMAKAFGHHVTVISTSPSKEKEARQRLGADGFIVSTNAEQMQRGKRTLDVILDTVSAKHSLGPILELLKVNGTLVVVGAPDRPMDLPSFPLIFGKRAVKGSMTGGMKETQEMMDVCGKHNITCDVELIEPDQINEALDRLARNDVRYRFVIDIAGRSKL

SEQ ID NO: 3772 - protein, 360 aa, Manihot esculenta
MAQTTPNHTQTVSGWAAHDSSGKITPYIFKRRENGVNDVTIKIMYCGICHTDLHHARNDWGITMFPVVPGHEITGLITKVGSNVKNFKVGDRVGVGCLAASCLECEFCKSSQENYCDQIQFTYNGIFWDGSITYGGYSEMLVADHRYVVHIPDNLAMDAAAPLLCAGITVFCPMKDNDLLKSPGKRIGIVGLGGLGHVAVKFGKAFGHHVTVISTSPSKEREARERLGADGFIVSTSPKQMQAGKRSLDLILDTVSAKHSLGPILELLKVNGTLVVVGAPDKPIDLPSFPLIFGKRTVKGSMTGGMRETQEMMDVCGKYNITCDIEVVKPHKINEAFQRLARNDVRYRFVIDIAGNSSLL

SEQ ID NO: 3773 - protein, 362 aa, Ricinus communis
MTQTTPNHTQTVSGWAAHDSSGKITPYIFKRRENGINDVTIKILYCGICHTDIHHAKNDWGITIYPVVPGHEITGIITKVGSNVKNFKVGDRAGVGCLAASCLNCEFCNNDQENYCDQIQLTYNGIFWDGSITYGGYSEFLVADHRYVVHIPESLPMDAAAPLLCAGITVFSPMKDNKLLDSPGKKIGIVGLGGLGHVAVKFGKAFGHHVTVISTSPSKEKEAKERLGADDFIVSTNPEQMQEGKKTLDLILDTVSANHSLGPILELLKVNGTLVAVGAPEKPFELPSFPLIFGKRSVKGSMTGGIKETQEMMDVCGKHNITCDIEVVKPDKINESLDRLARNDVRYRFVIDIAGNFNPSHL

SEQ ID NO: 3774 - protein, 360 aa, Vitis vinifera
MAQTTPNHTQTVSGWAAHDSSGKITPYVFKRRENGPNDVTIEILYCGICHTDLHHVRNDWGITMYPVVPGHEITGVVTKVGTNVTRFKTGDRVGVGCLAASCLECEFCKSSQENYCDQIQFTYNGIFWDGSITYGGYSRMLVADQRYVVRVPENLPMDAVAPMLCAGITVYSPMKDTKMLESPGKKLGIIGLGGLGHVAVKFAKAFGLHVTIISTSPSKEKEAKERLGADHFIVSTNPKQMQAGKRSLDFILDTVSANHSLGHYLELLKVNGTMVIVGAPEKPMELPSFPLIFGKRTVKGSMTGGMNETQEMMDVCGKHNITCDIEVVKPDQINEALERLANNDVRYRFVIDIAGQSPNL

SEQ ID NO: 3775 - protein, 360 aa, Citrus sinensis
MAQTTPNHTQSVVGWAAHDPSGKITPYIFKRRENGVNDVTIKILYCGICHTDIHHVKNDWGITMYPVVPGHEITGIITKVGSNVKNFKVGDRAAVGCLAAACMECEFCKDSQENYCDKIQFTYNGIFWDGSITYGGYSEMLVADYRFVVHVPENIAMDAAAPLLCAGITVFCPMKDNNLIDSPAKKRIGIVGLGGLGHVAVKFGKAFGHHVTVISTSPSKEKEAKELLGADEFILSTNAMQMQAGKRTLDFILDTVSAKHSLGPILELLKVNGTLSVVGAPEAPFELPSFPLIFGKRSVKGSMTGGMRETQEMMNVCGKYNITCNIEVIKPDQINEALDRLARNDVRYRFVIDIAGGARE

SEQ ID NO: 3776 - protein, 360 aa, Citrus clementina
MAQTTPNHTQSVVGWAAHDPSGKITPYIFKRRENGVNDVTIKILYCGICHTDIHHIKNDWGITMYPVVPGHEITGIITKVGSNVKNFKVGDRAAVGCLAAACMECEFCKDSQENYCDKIQFTYNGIFWDGSITYGGYSEMLVADYRFVVHVPENIAMDAAAPLLCAGITVFCPMKDNNLIDSPAKKRIGIVGLGGLGHVAVKFGKAFGHHVTVISTSPSKEKEAKELLGADEFILSTNAMQMQAGKRTLDFILDTVSAKHSLGPILELLEVNGTLSVVGAPEAPFELPSFPLIFGKRSVKGSMTGGMRETQEMMNVCGKYNITCNIEVIKPDQINEALDRLARNDVRYRFVIDIAGGARE

SEQ ID NO: 3777 - protein, 360 aa, Camellia sinensis
MAQTTPNHTQTVSGWAAHDSSGKITPYTFKRRENGINDVTIDILYCGICHTDLHHVRNDWGITMYPVVPGHEITGLISKVGSNVSKFKIGDRVGVGCLAASCLECEFCKDSQENYCDQIQFTYNGIFWDGSITYGGYSKMLVADQRYVVHVPENLPMDAAAPLLCAGVTVFCPLKDNNMLELDSPPKKLGVVGLGGLGHVAVKFGKAFGHHVTVISTSPSKEDEAKHRLGADDFIVSTDLAQMQAKKRSLDLILDTVAAKHSLGSYLELLKVNGTLVIVGAPDKPIDLPSFPLIFGKRVVKGSMTGSMKETQEMMDVCGKYNIKCDIEKTTPNKINEALDRLSKNDVKYRFVIDIASADK

SEQ ID NO: 3778 - protein, 361 aa, Prunus persica
MAQTTPNHTQTVSGWAAHDSSGKITPFIFKRRENGINDVTIEVLYCGICHTDLHHVRNDWGITMYPVVPGHEITGVITKVGSNVKEFKVGDRVGVGCLAATCLECDFCKDSQENYCDQVQFTYNGIFWDGSITYGGYSKMLVADHRYVVHIPANLPLDATAPLLCAGVTVFSPMKDHNLHQAPGKKIGVVGLGGLGHVAVKFGKAFGHHVTVISTSPSKEKEAKERLGADDFLVSTDAQQLKKGMRTLDFILNTVSAKHSLGPLLELLKVNGTMVVVGAPDQPFELPSFPMIFGKRAVKGSVIGGMRDTKEMMELCGKHNITCDIEVTTPHKLDAALDRVAKNDVRYRFVIDITAGLPSNL

SEQ ID NO: 3779 - protein, 360 aa, Eucalyptus grandis
MAQETQNHTLSVSGWAAYDSSGEIKPYTFKRRENGVNDVTIKVLYCGICHTDLHYAKNDWGITMYPVVPGHEITGVVIKVGCNAGKFKIGDRVGVGCLAASCLKCEFCADSQENYCDQMQFTYNGIFWDGSITYGGYSNVIVADYRYVVRIPENLPMDSVAPLLCAGITVFSPLKDNGMLGSPGKKMGVVGLGGLGHVAVKFGKAFGHHVTVLSTSPSKETEAKGRLGADDFIVSTNSQQMQAGKRSLDFILDTVSAQHSLGPILELLKVDGTLVMVGAPDQPLELPSFPLIFGKRSVKGSMTGGMRDTQEMMDLCGKHNITCDVEVIAPDTINEAMDRLAKNDVRYRFVIDIAGRISNI

SEQ ID NO: 3780 - protein, 569 aa, Solanum phureja
MATLSHFCGVKTPYPSVLKRSVHFPQLDFVGTVPFVSTPSKSVKASCCERVQRLVCKAQAADVNPKETKNESFGEVPDELTCVMKFGGSSVASAERMREVADLILSFPEERPVIVLSAMGKTTNNLLLAGEKAQSCGVSNVSDLQELDFIKELHLRTIDELGVESSTISKHLLELEQLLNGIALMKELTPRARDYLVSFGECMSTRIFTAYLNKLGVKSRQYDAFEMGIITTDDFTNADILEATYPAVAKRLTGDWMSSPAIPIVTGFLGKGWRTCAVTTLGRGGSDLTATTIGKALGLREIQVWKDVDGVLTCDPNIYPRAETVPYLTFDEAAELAYFGAQVLHPQSMRPAREGDIPVRVKNSYNPKAPGTLIVKTRDMSKAVLTSIVLKRNVTMLDIASTRMLGQFGFLAKVFSIFEDLGISVDVVATSEVSISLTLDPSKLWSRELIQQASELDNVVEELEKIAVVKLLQNRSIISLIGNVQRSSLILEKAFHVMHTNGVNVQMISQGASKVNISLIVNDSEAEQCVRALHHSFFESDLSELVWESPSGNGYAATTTTTPLSTLSN

SEQ ID NO: 3781 - protein, 249 aa, Zea mays
MGSECKGYGVGVATSPQQEQEQAGAAVAPFVAKTFHMVSDPATDAVVRWGGASNTFHVLDPATFSDYLLPSYFKHRNFASFVRQLNTYGFRKVDTDRWEFAHESFLRGQARLLPLVVRKRKKAGAGAGGGGRELCEAGEEVRGTIRAVQRLREQQRGVEDELRAMDRRLRAAESRPAQMMAFLAKLADDPGLVLRAMLAKEEELALIDKGSEAQPAKRRRIGAEAVDLAHSRGGGAVPFPFSVLGQVFY

SEQ ID NO: 3782 - protein, 240 aa, Solanum melongena
MRRGRAAAAARQVPVTDAPVAAPVAGEINGSGGSKEIRFRGVRKRPWGRFAAEIRDPWKKTRVWLGTFDSAEDAARAYDAAARTLRGPKAKTNFPLPSSHHLPPYPHHHQFNQSINPNDPFVDSRLYPQDHPIISQRPTSSSMSSTVESFSGPRPPPRQQTAASVPSRKYPRSPPVVPDDCHSDCDSSSSVVDDGECENDNIASSSFRKPLPFDLNLPAPMDDAGADAYADDLHCTALCL

SEQ ID NO: 3783 - protein, 354 aa, Triticum aestivum
MGALHVGEPRVSFQQQVGKNGGGHGAVVEEIHGLIRVYKDGHVERLPAIPDVPCTWGSTAAASGVLARDVAVDRATGVWARLYAPAAAAGKVPVVVYFHGGGFSVGSAAWSCYHEFLAQLPARAGCAVMSVDYRLAPENRLPAAFDDGLTALRWLRQQASRNAAASDEVSWWRSRCRFDRVFLMGDSAGAAIAFHVAARAGQGQLGALAPLSVKGAILIQPFFGGEARTASEKSMPQPPGSALSLSTSDSYWRMALPAGAGRDHPWCNPLARGAPRLETLALPPVLVCISEADILRDRNLELCRALRKAGKSVEQATYGGVGHAFQVLHNCHLSQPRTQEMLAHIRAFVSARSS

SEQ ID NO: 3784 - protein, 359 aa, Avena sativa
MGALHVGEPRVSFQPQVGKNGGGHGAVVEEIHGLIRVHKEGHVERLPAVPDVPCEWGSTAAGSGVIARDVAVDRATGVWARLYAPAAVSAGKVPVVVYFHGGGFCVGSAAWSCYHEFLAQLPLRAGCAVMSVDYRLAPEHRLPAAFDDGVAAVRWLRQQAGYSRNNSTSASDEVSWWRSRCRFDRVFLMGDSAGASIAFHVAARLGQGQLGALAPLCVKGAILIQPFFGGEARTASEKTTPQPPRSALSLATSDSYWRMALPAGGRDHPWCNPLSRGAPRLEALALPPLLVCVAEADVLRDRNLELCRALRKGGKSVEQATYGGVGHAFQVLHNYHLSQPRTQEMLAHIRAFVSARSTS

SEQ ID NO: 3785 - protein, 165 aa, Saccharum officinarum
MAAVARGPATAMAPAAGSGATAAAEEMRWRQLDSGVSAVSFGFVATAILVSMFLAMAILEHFLRPPAHAPGHAPPRGILRRLRLFLGRGGERGAAPGADLEAARKLQGHAPLEIPVYPKGVSVLMPGQDMPTFIAHPVPAPCPPERIRWPSHQSPPFTGSSSNPS

SEQ ID NO: 3786 - protein, 135 aa, Brachypodium distachyon
MFSGDWTPPCGSCCTKKYANLVQIPWRVFCKKGCNADGDTWDECIGKCTEICYKDPVLEDRQWSAYIDRSPGEDSYSLECFNACISGCGYRFDIPAEKVKEIKPNRPSKPPPPVIERAAGSEPAVKGEDVPCTSA

SEQ ID NO: 3787 - protein, 138 aa, Oryza sativa
MFSGEWTPPCGSCCTKKYASLVQIPWRVFCKKGCDADGDTWDECISKCTEICYKDPVLEDHQWSAYIDRSPGQDSYSLECFNACVSGCGYRFDIPAEKVEQIKPNRPSKPPPPPPPAVERATNSEPAVKGEDVPCTSA

SEQ ID NO: 3788 - protein, 136 aa, Panicum virgatum
MFSGDWTPPCGSCCTKKYASLVQIPWRVFCKKGCNADGDTWEECIGKCTEICYKDPVLEDRQWSAYIDRSPGQDSYSLECFNACVSGCGFRFEIPTEKVEEIKPNRPSKPPPPEVKPTTGPASAAGSREDVPCTSA

SEQ ID NO: 3789 - protein, 134 aa, Zea mays
MFSGDWTPPCGSCCTKKYASLVQIPWRVFCKKGCNADGDTWDECIGKCTEICYKDPVLEDRQWSAYIDRSPGQDSYSLECFNACVSGCGFRFDIPTEKVEEIKPNRPSKPSAPEPEVKQTRNADCNEDVPCTSA

SEQ ID NO: 3790 - protein, 134 aa, Saccharum officinarum
MFSGDWTPPCGSCCTKKYASLVQIPWRVFCKKGCNADGDTWDECIGKCTEICYKDPVLEDRQWSAYIDRSPGQDSYSLECFNACVSGCGFRFDVPTEKVEEIKPNRPSKPSAPEPEVKRTRNADCTEDVPCTSA

SEQ ID NO: 3791 - protein, 318 aa, Glycine max
MEHNIIVNNNVIAPFVIKTYNMVNDPTTDKLITWGPANNSFIILDPLDFSHSLLPTFFKHNNFSSFVRQLNTYGFRKVDPDRWEFANEWFLRGQKHLLRNIVRKKHGGAGRTNSNSHYSHPLKLEELDDEAMVMEIARLKEEQKALEEELHEMNKRLETTEKRPQQMMAFLCKVVEDPQILSRILREREKKHLGEKKRRLIPPPPPTAATSSSSSSGIKTEFEEDEGNYNIKSSSPETGLEIDNNSNNICSPPPLGCWGEQGCYGYNCASVPAPLTVVAPAFPTMGGGYLRRGGFWGEMAAEGNAVPPYPFSLLEGGF

SEQ ID NO: 3792 - protein, 320 aa, Glycine max
MMEHNIIVNNNNVIAPFVIKTYNMVNDPTTDKLIMWGPANNSFIVLDPLDFSHSLLPAFFKHNNFSSFVRQLNTYGFRKVDPDRWEFANEWFLRGQKHLLRNIARRKHGGAGRSNFNLHSHHHPLKVEELDDEAMVMEIARLKEEQKALEEELQGMNKRLETTEKRPQQMMAFLSKVVEDPQVLSRILREREKKHLGEKKRRLIPPPTTTAATTSSSSSSGIKTEFEEDEGNYNIMSSSPETGLEIDNNNICSPLAAGYWGEQGCHGYNRGAVTAPLTVVAPAVPTMGGGYLGRGVFFGEMAAEGNAVPPYPFSLLEGGF

SEQ ID NO: 3793 - protein, 319 aa, Glycine max
MEHNIIVNNNNVIAPFVIKTYNMVNDPTTDKLIMWGPANNSFIVLDPLDFSHSLLPAFFKHNNFSSFVRQLNTYGFRKVDPDRWEFANEWFLRGQKHLLRNIARRKHGGAGRSNFNLHSHHHPLKVEELDDEAMVMEIARLKEEQKALEEELQGMNKRLETTEKRPQQMMAFLSKVVEDPQVLSRILREREKKHLGEKKRRLIPPPTTTAATTSSSSSSGIKTEFEEDEGNYNIMSSSPETGLEIDNNNICSPLAAGYWGEQGCHGYNRGAVTAPLTVVAPAVPTMGGGYLGRGVFFGEMAAEGNAVPPYPFSLLEGGF

SEQ ID NO: 3794 - protein, 332 aa, Zea mays
MASTTLLAVLLLVAASAAPARSCSPRDLQALLSVKQALGNPSTLSTWTPASPDCCSWDHLRCNDAGRVNNVFIDGADDVRGQIPSAVGGLTELMSLTLFRLAGLTGPIPACLAALSNLQFLTVSHTNVSGAIPESLARLRGLDSVDLSSNQLTGGIPASFADLPSLRSLDLGHNQLTGSIPAGLVQGQFRSLVLSYNQLTGPIPRDDARDEINTVDLSHNKLTGDPSHLFAAGRPIGKVDLSWNYLDFDLSQLVFPPEMTYLDLSHNLIRGTVPLSLERLSTLQKLDLSYNRLCGPLPKGHGVIKHGCKPYAHNQCRKGTPLAGCQDLEWSE

SEQ ID NO: 3795 - protein, 332 aa, Saccharum officinarum
MASTTTTFLAVFLLVASASAAPARSCSPSDLHALLSVKQALGNPATLSTWTASSPNCCAWDHLRCNDAGRVNNVFIDAADDVHGQIPSAVGGLTELMSLTLFKLPGLTGSIPTCLTALSKLEFLTISHTSVSGAIPESLARLRSLDSVDLSSNQLTGGIPASFADLPNLRSLDLRHNQLTGTIPAGLVQGQFRSLILSYNQLTGPIPRDDAHDEINTVDLSHNKLTGDPSHLFVAGRPIGKVDLSWNYLDFDLSKLVFPAELTYLDLSHNQIRGTVPVSLERLSTLQKLDLSYNRLCGPLPKGHGVIKHGCKPYAHNQCRKGTPLAGCQDLE

SEQ ID NO: 3796 - protein, 333 aa, Sorghum bicolor
MASTTTATFLAVFLLVAASSSAPARSCAPSDLHALLSVKQALGNPATLSTWTASSPNCCAWDHLRCNDAGRVNNVFIDAADDVHGQIPSAVGGLTELMSLTLFKLPGLTGSIPACLTALSKLEFLTISHTSVSGAIPESLTRLRSLDSVDLSSNQLTGTIPASFADLPNLRSLDLRHNQLTGTIPAGLVQGQFRSLILSYNQLTGPIPRDDAHDEINTVDLSHNKLTGDPSHLFVAGRPIGKVDLSWNYLDFDLSKLVFPPELTYLDLSHNHIRGTVPLSLERLSTLQKLDLSYNRLCGPLPKGHGVIKHGCKPYAHNQCRKGTPLAGCQDLE

SEQ ID NO: 3797 - protein, 332 aa, Setaria italica
MASTASSFLVVFLLVAAAATTPARSCAPSDLHALLSVKAALGNPATLSSWSPSSPNCCAWDHLRCDDAGRVNNVFIDGADDVHGQIPSAVGGLSALMSLSLFRLPGLTGTIPPCLTALSNLQFLTISHTNVSGPIPEALARLRSLDSVDLSNNKLCGGIPAAFADLPNLRSLDLRHNQLTGPIPAGLVQGQFRSLILSYNQLSGPIPRDDAQDEINTVDLSHNKLTGDPSHLFVPGRPIGKVDLSWNYLDFDLSKLVFPPELTYLDLSHNRIRGTVPASLERLSTLQKLDLSYNNLCGPLPRGHGVIKHGCKPYAHNECHHGTPLAGCQDLS

SEQ ID NO: 3798 - protein, 348 aa, Pennisetum glaucum
LAVFLLVAAAAATPARSCAPSDLHALLSVKAALGNPATLSSWSPSSPNCCAWDHLRCDDAGRVNNVFIDGADDVHGQIPSAVGGLSALMSLSLFRLPGLTGTIPPCLTALSNLQFLTISHTNVSGPIPQALARLRSLDSVDLSNNKLCGGIPAAFADLPNLRSLDLRHNQLTGPIPAGLVQGQFRSLVLSYNQLTGPIPRDDADQHRGPLPQQAHRRPLPPLRPRPAHRQGGPVVELPRLRPQQAGVPAGAHLPGPLPQPHPGHRAGVAGAPLHAAEAGPQLQQPVRAAAQGPRRDQARVQAVRAQPVPPRNPARRVPGPVVSAPAAAAGSSAGGGCSCSVSLGVRAL

SEQ ID NO: 3799 - protein, 313 aa, Panicum virgatum
STPARSCAPSDLRALLSMKQALGNPATLSSWSPSSPNCCAWDHLRCDDAGRVNNVFIDGADDVHGQIPSAVAGLTALMSLSLFRLPGLTGAIPACLAGLSNLQFLTISHTNVSGPIPEALARLRTLDSVDLSSNRLSGLIPASFADLPNLRSLDLQHNQLTGPIPAGLVQGQFRSLILSYNQLTGPIPRDDAQDEINTVDLSHNKLTGDPSHLFVPGRPIGKVDLSWNYLDFDLSKLVFPPELTYLDLSHNRIRGTVPASLERLSTLQKLDLSYNNLCGPLPRGHGVIKHGCKPYAHNQCRHGTPLAGCRDLS

SEQ ID NO: 3800 - protein, 379 aa, Zea mays
MALAVRTPRFQPRPASISAPTTPASTSLAAGNARPRPCAGAAVRASPFTEATSSSRYRRDAWSYAADGSSNSASPSSAAAAAAGRRDDEIALQLPELRRLLDVLRASRGRGAEEGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLYVAGNAADPDTTLVVYMGLSTLPSLAPKLMKHGLPPDTPAVAVERGTTPQQRTVFASLKDLVDEVKSADLVSPTLIIIGKVVSLSPFWVESSEHDALKVQSSYANEAR

SEQ ID NO: 3801 - protein, 389 aa, Zea mays
MALAVRTPRFQPRPASISAPATPASNSLAAAAAANARPRTCAGAAVRASPFTEATSSSRYLRDAWSYATDCSSNSASRSSDAAAAAAALGRRDDEIALQLPELQRLLDALRASRRRGAEGGGGGGRGPGRVALVGTGPGDPELLTLKAVRAIEAADLVLYDRLVSNDVLDLVGEGSRLLYVGKTAGYHSRTQEEIHELLLSFAEAGANVVRLKGGDPLVFGRGGEEMDFLQQQGIKVEIIPGITSASGIAAELGIPLTHRGVATSVRFLTGHSRNGGTDPLYVAGNAADPDTTLVVYMGLSTLASLAPKLMKHGLPPDTPAVAVERGTTPQQRMVFALLKDLVDEVKSADLVSPTLIIIGKVVSLSPFWVESSEHDALKIESSYASEAR

SEQ ID NO: 3802 - protein, 391 aa, Brachypodium distachyon
MALALRPPRFQPLSASISVATTSSTSFATSARPSSTPAAAICAAASSPFTEATSSSRYRRDAWSYTAEDSSSPSSTSSSAAAAAVAAAAASGRRDDEIALQLPELRRLLEVLRASRGKGLEEEGGASGPGRVALVGTGPGDSELLTLKAVQAIEAADLVLYDRLVSNEVLDLVGDSARLLYVGKTAGYHSRTQEEIHELLLSFAEAGASVVRLKGGDPLVFGRGGEEMDFLQQQGIRVEVIPGITSASGIAADLGIPLTHRGVATSVRFLTGHSRNGGTDPLFVAENAADPDTTLVVYMGLSTLPSLAPKLMKHGLPPDTPAVAVERGTTPQQRMVFSMLKDLVDEVKSAELVSPTLIIIGKVVALSPFWVESSEQDALKIENSYAAETTR

SEQ ID NO: 3803 - protein, 383 aa, Hordeum vulgare
MALALRAPRFQPLPASIPATSTAFASTARHSSSAVAICAAASPFTEATSSSRYRRDAWSYTAQDSSSPSSAAAAAAAAASGRRDDEIALQLPELRRLLKALRASRGKGLEGKDGGGGPGRVALVGTGPGDPELLTLKAVRAIEAADLVLYDRLVSNEVLDLVAEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLHVAENAADPDTTLVVYMGLSTLPSLAPKLMKHGLPADTPAVAVERGTTPQQRMVFAMLKDLVNEVHSADLVSPTLIIIGKVVALSPLWVESSKQDALNNENSSQLSPTIFPV

SEQ ID NO: 3804 - protein, 139 aa, Triticum aestivum
  misc_feature (70)..(70): Xaa can be any naturally occurring amino acid
  misc_feature (90)..(90): Xaa can be any naturally occurring amino acid
MATSIMASMALKSSPSPFSGQSQLQRIQPSARSSSFRVMSKKAKKVQTSQPFGPGGGLELKDGVDASGRXAKGKGVYQFASKYGANVDGXSPIYNPEEWSPSGDYYAGGKTWLLLWVATLAGILLGGALLVYNTSALAS

SEQ ID NO: 3805 - protein, 970 aa, Arabidopsis lyrata
MASQNKQEEKKKVKKLQKSYFDVLGICCTSEVPIIENILKALDGVKEYSVIVPSRTVIVVHDSLLISPFQIAKALNQARLEANVRVNGETNFKNKWPSPFAVVSGILLLLSFLKFVYSPLRWLAVAAVAAGIYPILAKAFASIRRLRIDINILVIITVIATLAMQDFMEAAAVVFLFTISDWLETRASYKATAVMQSLMSLAPQKAIIAETGEEVEVDEVKISTVVAVKAGETIPIDGIVVDGNCEVDEKTLTGEAFPVPKQRDSTVWAGTINLNGYISVKTTSLAGDCVVAKMAKLVEEAQSSKTKSQRLIDKCSQYYTPAIIVVSACVAIVPVIMKVHNLKHWFHLALVVLVSGCPCGLILSTPVATFCALTKAATSGLLIKSADYLDTLSKIKIAAFDKTGTITRGEFIVIDFKSLSRDISLRSLLYWVSSVESKSSHPMAATIVDYAKSVSVEPRPEEVEDYQNFPGEGIYGKIDGNDIYIGNKRIASRAGCSTVPETEIDTKGGKTVGYVYVGERLAGVFNLSDACRSGVSQAMTELKSLGIKTAMLTGDSQAAAMHAQEQLGNVLDVVHGELLPEDKSKIIQEFKKEGPTAMVGDGVNDAPALATADIGISMGISGSALATQTGHIILMSNDIRRIPQAVKLARRARRKVVENVFLSIVLKAGILALAFAGHPLIWAAVLVDVGTCLLVILNSMLLLREKKKIGNKKCYRASTSMLNGRKLEGDDDDVVDLEAGLLKKSGNGQCNSSCCGDKKNQEKVVMMKPSSKTSSDHSHPGCYGDKKQDKVKPLVRDGCCGEETRKAVGDIISLSSCKKSSHVKHDLKMKGGSGCCANKSEKVEEVVAKSCCEKSKQQMESAGDCKSSHCEEKKHAEEIVVPVQIIGQALTGLEIELQRKEPCKTSCCDNKEEKVKEIGLLLASEDKSYPEKGVLIKDEGNCKSGCENKGTVTQRCHEKAAAVMKNKPGK

SEQ ID NO: 3806 - protein, 271 aa, Hordeum vulgare
MAMARVPILVAVALMAASASCSAWDPTIRMVDDAVAPLIHALRPLLGSGGQLGSRGGVPCDSWRLGVEAYNVRDWKTVPANCEGYVGHYMLGNHFRRDCKVVIDQAIAYVDGLKLAGNGKDVWVFDIDETTLSNLPYYATHGFGARPYNATSFDAYVMEGSAPVLPETKRLYYKLLKVGIKPVFITGRTEDKRAVTVGNLRSQGFSGWMSLTLKQHGFKGSAISYKSAERKKLEDAGYVIVGNIGDQWSDILGAPEGARTFKLPDPMYYIA

SEQ ID NO: 3807 - protein, 280 aa, Triticum aestivum
MAMARVPILIAVALVAAAASCSAWEPTIRMPTAEAAAAAVDDAVAPLIHALRPLLGSSGELGSRGGVPCDSWRLGVEAYNVRDWKTVPANCEGYVGHYMLGSHFRRDSKVVIDQAIAYVDSLKLAGNGKEVWVFDIDETTLSNLPYYATHGFGARPYNATSFDAYVLEGTAPVLPETKRLYYKLLKVGIKPVFITGRTEDKRAITVGNLRSQGISGWMNLTLKQPGFHGSAISYKSAERKKLQDAGYVIVGNIGDQWSDLLGAPEGARTFKLPDPLYYIS

SEQ ID NO: 3808 - protein, 280 aa, Triticum aestivum
MAMARVPILIAVALVAAAASCSAWEPTIRMPTAEAAAAAVDDAVAPLIHALRPLLGSSGELGSRGGVPCDSWRLGVEAYNVRDWKTVPANCEGYVGHYMLGSHFRRDSKVVIDQAIAYVDSLKLAGNGKEVWVFDIDETTLSNLPYYATHGFGARPYNATSFDAYVLEGTAPALPESKRLYYKLLKVGIKPVFITGRTEDKRAITVANLRSQGISGWMNLTLKQPGFHGSAISYKSAERKKLQDAGYVIVGNIGDQWSDLLGAPEGARTFKLPDPLYYIG

SEQ ID NO: 3809 - protein, 280 aa, Leymus cinereus x Leymus triticoides
MAMARMPILVAVALVAAAASCSAWEPTIRMPTAEAAAAAVDDAVAPLIHALRPLLGSGGQLGSRGGVPCDSWRLGVEAYNVRDWKTVPANCEGYVGHYMLGGHFRRDSKVVINEAIAYVESLKLAGNGKEVWVFDIDETTLSNLPYYATHGFGARPYNATSFDAYVLEGTAPALPETKRLYYKLLKVGIKPVFITGRTEDKRAITVSNLRSQGISGWMNLRLKQPGFKGSAISYKSAERQKLQDAGYVIVGNIGDQWSDILGAPEGARTFKLPDPMYYIG

SEQ ID NO: 3810 - protein, 154 aa, Triticum aestivum
MAMARVPILIAVALVAAAASCSAWEPTIRMPTAEAAAAAVDDAVAPLIHALRPLLGSSGELGSRGGVPCDSWRLGVEAYNVRDWKTVPANCEGYVGHYMLGSHFRRDSKVVIDQAIAYVDSLKLASNGKEGVGLRHRRDHALQPPLLRHARLRG

SEQ ID NO: 3811 - protein, 280 aa, Triticum aestivum
MAMAKVPILVAVALMAAVASCSAREPNICMPLAEVAATAADDAVAPLIHALRPLLGSGGQLGSHGGVPCDSWRLGVEAYNVRDWKMVPANCEGYVGHYMLGSHYRRDSKVVIDQAIAYLDSLRLAGNGKEVWVFDIDETMLSNLPYYATHGFGARPYNATSYNAYVLEGSAPALPETKRLYNKLLTVGIKPVFLTGRTEDQRAITVANLRRQGISGWMYLLLKQPGFKGSAVIYKSGERQKLQDAGYVIVGNIGDQWSDILGAPEGARTFKLPDPMYYIG

SEQ ID NO: 3812 - protein, 280 aa, Triticum aestivum
MAMAKVPILVAVALMAAVASCSAREPNICMPLAEVAATAADDAVAPLIHALRPLLGSGGQLGSHGGVPCDSWRLGVEAYNVRDWKMVPANCEGYVGHYMLGSHYRRDSKVVIDQAIAYLDSLRLAGNGKEVWVFDIDETMLSNLPYYATHGFGARPYNATSYNGNVLKGSAPALPETKRLYNKLLTVGIKPVFLTGRTEDQRAITVANLRRQGISGWMYLLLKQPGFKGSAVIYKSGERQKLQDAGYVIVGNIGDQWSDILGAPEGARTFKLPDPMYYIG

SEQ ID NO: 3813 - protein, 280 aa, Triticum aestivum
MAMVRMPILVAVALVAAVASCSAREPNICTPMAEVAATAVDDAVAPLIHALRPLLGSGGQLGSHGGVPCDSWRLGVEAYNVRDWTTVPANCEGYVGHYMLGSHYRRDSKVVIDQAIAYLDSLKLAGNGKEVWVFDIDETMLSNLPYYATHGFGARPYNATSYNAYVLEGSAPALPETKRLYYKLLAVGIKPVFLTGRTEHRRAITVANLCRQGISGWMNLLLKQPWFKGSTVTYKSGERQKLQDAGYVVVGNIGDQWSDILGAPEGARTFKLPDPMYYIG

SEQ ID NO: 3814 - protein, 330 aa, Glycine max
MGKQSTEFSALNCIDLSNPDINQSVNLLKQACLDSGFFYVVNHGISQEFMEEVFAQSKKFFSLPHKEKMKILRNEKHRGYTPVLDELLDPENQVHGDYKEGYYIGVEKGEDDPESNKPFYGPNNWPAPGVLPGWRETMEKFHRETLEVGKAVAKIIALALDLDANFFDQPEMLGEPIATLRLLHYEGQVSDPLKGLYGAGAHTDYGLITLLATDDVSGLQICKDRDAKPQKWEDVAPLKGAFIVNLGDMLERWSNCVFKSTLHRVLGNGQGRYSIAYFLEPSHDCLVECLPTCKSDSNPPKFPPILCHDYLTQRYNDTHADLNVYKKQQA

SEQ ID NO: 3815 - protein, 388 aa, Sorghum bicolor
MAAAAAATSTASAPSSSFPSTCRARARVGARPSLVSLRVRAANPATVNVTTASDPAPVFQSVTAFAPATVANLGPGFDFLGCAVADASLSLGDTVTATLDPTLPPATVSIASVTSPSRPHLADRLSKDPLRNCAGVAAIAALRALGVRSHAVSIHLTKGLPLGSGLGSSAASAAAAAKAVDALFGSRLARDDLVLAGLESEKAVSGFHADNIAPAILGGFVLVRSYDPFHLVPLCSPPALRLHFVLVTPDFEAPTSKMRAALPKQVDVHQHVRNSSQAAALVAAVLQGDAGLIGSAMSSDSIVEPTRAPLIPGMAAVKAAALQAGALGCTISGAGPTAVAVIEGEEKGEEVARRMVDAFWSAGKLKATATVAQLDTLGARVIATSSLD

SEQ ID NO: 3816 - protein, 378 aa, Oryza sativa
MAAAAAAAAAPSPAPCFPSTRHTLPGLVSVRVSRRVKVAVAIADPAPAFNSVTAFAPATVANLGPGFDFLGCAVADASLSLGDTVTATLDPSLPPGTVAIASVTSPSRPTLADRLSRDPLRNCAGVAAIAALRALDVKSHAVSIHLTKGLPLGSGLGSSAASAAAAAKAVDALFGSLLHQDDLVLAGLESEKAVSGFHADNIAPAILGGFVLVRSYDPFHLIPLSSPPALRLHFVLVTPDFEAPTSKMRAALPKQVAVHQHVRNSSQAAALVAAVLQGDATLIGSAMSSDGIVEPTRAPLIPGMAAVKAAALEAGALGCTISGAGPTAVAVIDGEEKGEEVGRRMVEAFANAGNLKATATVAQLDRVGARVISTSTLE

SEQ ID NO: 3817 - protein, 351 aa, Panicum virgatum
  misc_feature (190)..(190): Xaa can be any naturally occurring amino acid
  misc_feature (198)..(198): Xaa can be any naturally occurring amino acid
LVSLRSGALLRVRAAAEPAPAFQSVTAFAPATVANLGPGFDFLGCAVADASLSLGDTVTVTLDPTLPPGTVSIASVTSPSRPHLAARLSKDPLRNCAGVAAIAALRALGVRSHAVSIQLTKGLPLGSGLGSSAASAAAAAKAVDALFGSRLGRDDLVLAGLESEKAVSGFHADNIAPAILGGFVLVRSYXPFHLVPLXSPPGLRLHLVLVTPDFEAPTSKMRAALPKEVGVQQHVRNSSQAAALVAGVLQGDAGLIGSAMSSDGIVEPSRAPLIPGMVAVKAAALQAGALGCTISGAGPTAVAVIDGEEKGEEVGGRMVDAFWSAGKLKATATVAQLDRHGARVIATTALG

SEQ ID NO: 3818 - protein, 380 aa, Brachypodium distachyon
MAAAAATVPSPATSFPSTTRKATVLSLRVSRRFKVAASAAASPGPDPSPAFKSVTAFAPATVANLGPGFDFLGCAVADASLSLGDTVTATLDPSLPPGTVAIAGITSPSRPHLADRLSRDPLRNCAGIAAAAALQALGVRSHAVSLRLAKGLPLGSGLGSSAASAAAAAKAVDALFGSLLYRDDLVLAGLESEKAVSGFHADNIAPAILGGFVLVRSYEPFHLMPLPCPPALRLHFVLVTPDFEAPTSKMRAALPKHVAIKHHVRNSSQAAALVAAVLQGDAGVIGSAMSSDGIVEPTRAPLIPGMVAVKAAALEAGALGCTISGAGPTAVAVIEGAEKGEEIARRMVDAFLSVGKLKATATIAQLDRAGARVISTSSLE

SEQ ID NO: 3819 - DNA, 32 bp, Artificial Sequence
  Single strand DNA oligonucleotide
aaaggatcccgaggactctaggagagtgaagc

SEQ ID NO: 3820 - DNA, 32 bp, Artificial Sequence
  Single strand DNA oligonucleotide
aaagtcgacgggaatccagggtctattatgtc

SEQ ID NO: 3821 - DNA, 29 bp, Artificial Sequence
  Single strand DNA oligonucleotide
aaaggatccagccacctctttcccagttc

SEQ ID NO: 3822 - DNA, 31 bp, Artificial Sequence
  Single strand DNA oligonucleotide
aaagtcgacggtaacagcagaagaatgctcc

SEQ ID NO: 3823 - DNA, 31 bp, Artificial Sequence
  Single strand DNA oligonucleotide
aaaggatcccattcaccaccacttcactacg

SEQ ID NO: 3824 - DNA, 29 bp, Artificial Sequence
  Single strand DNA oligonucleotide
aaagtcgacagttgcgcagcaataactcc

SEQ ID NO: 3825 - DNA, 277 bp, Artificial Sequence
  NOS terminator
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 3826 - DNA, 2322 bp, Artificial Sequence
  AT 6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 3827 - DNA, 666 bp, Artificial Sequence
  35S pqfnc Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 3828 - DNA, 1127 bp, Artificial Sequence
  NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 3829 - DNA, 2318 bp, Artificial Sequence
  AT 6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 3830 - DNA, 1096 bp, Artificial Sequence
  RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 3831 - DNA, 1321 bp, Artificial Sequence
  rbcS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 3832 - DNA, 1358 bp, Artificial Sequence
  Ubi 1 Promoter
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 3833 - DNA, 781 bp, Artificial Sequence
  35S pJJ Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 3834 - DNA, 877 bp, Artificial Sequence
  35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 3835 - DNA, 27 bp, Artificial Sequence
  Single strand DNA oligonucleotide
tttgtcgacgaaatcgaatcgggtccg

SEQ ID NO: 3836 - DNA, 30 bp, Artificial Sequence
  Single strand DNA oligonucleotide
aaagtcgacagaaagcaggagcaccaattc

SEQ ID NO: 3837 - DNA, 36 bp, Artificial Sequence
  Single strand DNA oligonucleotide
aaaggatcccagtaaacttcgcttcatttagttcag

SEQ ID NO: 3838 - DNA, 28 bp, Artificial Sequence
  Single strand DNA oligonucleotide
aaaggatccctcggcttcttcctccttg

SEQ ID NO: 3839 - DNA, 30 bp, Artificial Sequence
  Single strand DNA oligonucleotide
aaagtcgacaacgaaatgccactgctacag

SEQ ID NO: 3840 - DNA, 31 bp, Artificial Sequence
  Single strand DNA oligonucleotide
aaagtcgacgaatttgtaagatcgggtggtg

SEQ ID NO: 3841 - DNA, 27 bp, Artificial Sequence
  Single strand DNA oligonucleotide
aaagtcgacaccagcccaccatctacg

SEQ ID NO: 3842 - DNA, 31 bp, Artificial Sequence
  Single strand DNA oligonucleotide
aaaggatccacacatgtccattaacgtctgg

SEQ ID NO: 3843 - DNA, 31 bp, Artificial Sequence
  Single strand DNA oligonucleotide
aaaggatcccaaacgcggcactaagaaatac

SEQ ID NO: 3844 - DNA, 29 bp, Artificial Sequence
  Single strand DNA oligonucleotide
aaaggatcccgcatgctctttgtgaattg

SEQ ID NO: 3845 - DNA, 31 bp, Artificial Sequence
  Single strand DNA oligonucleotide
aaagtcgactctcagaccagtatcgttgacc

SEQ ID NO: 3846 - DNA, 30 bp, Artificial Sequence
  Single strand DNA oligonucleotide
aaagtcgacttgctaccagcacctaagctc

SEQ ID NO: 3847 - DNA, 27 bp, Artificial Sequence
  Single strand DNA oligonucleotide
aaaggatcccgtagatggatcgccacc

SEQ ID NO: 3848 - DNA, 31 bp, Artificial Sequence
  Single strand DNA oligonucleotide
aaactcgaggttctggttcagcatcagtgac

SEQ ID NO: 3849 - DNA, 28 bp, Artificial Sequence
  Single strand DNA oligonucleotide
aaaggatcccgctctagtcgctccttcc

SEQ ID NO: 3850 - DNA, 30 bp, Artificial Sequence
  Single strand DNA oligonucleotide
aaactcgagcgtgcatcttctcatctcctc

SEQ ID NO: 3851 - DNA, 31 bp, Artificial Sequence
  Single strand DNA oligonucleotide
aaaggatccctccaatctacttcaacaatgg

SEQ ID NO: 3852 - DNA, 28 bp, Artificial Sequence
  Single strand DNA oligonucleotide
aaagtcgaccatctccattgaccgaacg

SEQ ID NO: 3853 - DNA, 34 bp, Artificial Sequence
  Single strand DNA oligonucleotide
aaagtcgactcgtttaagcctgttacaccataac

SEQ ID NO: 3854 - DNA, 26 bp, Artificial Sequence
  Single strand DNA oligonucleotide
aaagtcgaccctgccatgtgggcctc

SEQ ID NO: 3855 - DNA, 31 bp, Artificial Sequence
  Single strand DNA oligonucleotide
aaagtcgacagatctgattcactaccggagc

SEQ ID NO: 3856 - DNA, 32 bp, Artificial Sequence
  Single strand DNA oligonucleotide
aaagtcgaccagtgtcatttaatagccgttcc

SEQ ID NO: 3857 - DNA, 34 bp, Artificial Sequence
  Single strand DNA oligonucleotide
aaaggatccgacaggaatgttatagtccatttgc

SEQ ID NO: 3858 - DNA, 31 bp, Artificial Sequence
  Single strand DNA oligonucleotide
aaagtcgacctccaattgcaatacggaaaag

SEQ ID NO: 3859 - DNA, 26 bp, Artificial Sequence
  Single strand DNA oligonucleotide
aaaggatcccacccgcagccaaatgg

SEQ ID NO: 3860 - DNA, 31 bp, Artificial Sequence
  Single strand DNA oligonucleotide
aaaggatccgacggtgaaatgaatcagaacc

SEQ ID NO: 3861 - DNA, 31 bp, Artificial Sequence
  Single strand DNA oligonucleotide
aaagtcgacgggaagtgggttctattccatc

SEQ ID NO: 3862 - DNA, 29 bp, Artificial Sequence
  Single strand DNA oligonucleotide
aaaggatccgatggcaagtggagtgagtg

SEQ ID NO: 3863 - DNA, 31 bp, Artificial Sequence
  Single strand DNA oligonucleotide
aaaggatccttccttatcaccatcactcagg

SEQ ID NO: 3864 - DNA, 32 bp, Artificial Sequence
  Single strand DNA oligonucleotide
aaaggatccaacttgcacacgatcttcatttc

SEQ ID NO: 3865 - DNA, 29 bp, Artificial Sequence
  Single strand DNA oligonucleotide
aaaggatccctccattgccttgctttctc

SEQ ID NO: 3866 - DNA, 31 bp, Artificial Sequence
  Single strand DNA oligonucleotide
aaaggatcccccatctcttctcacttgttcc

SEQ ID NO: 3867 - DNA, 31 bp, Artificial Sequence
  Single strand DNA oligonucleotide
aaaggatccgaggtaatagctgcaggctcac

SEQ ID NO: 3868 - DNA, 27 bp, Artificial Sequence
  Single strand DNA oligonucleotide
aaaggatccctccgtcgcattcaacac

SEQ ID NO: 3869 - DNA, 32 bp, Artificial Sequence
  Single strand DNA oligonucleotide
aaaggatcccttggactcagttcagtttcacg

SEQ ID NO: 3870 - DNA, 31 bp, Artificial Sequence
  Single strand DNA oligonucleotide
aaaggatccccggactactgtcgttgttacc

SEQ ID NO: 3871 - DNA, 29 bp, Artificial Sequence
  Single strand DNA oligonucleotide
aaagtcgaccgcttctctcgtgacacatc

SEQ ID NO: 3872 - DNA, 31 bp, Artificial Sequence
  Single strand DNA oligonucleotide
aaaggatccgctatctctgagccgaggagac

SEQ ID NO: 3873 - DNA, 29 bp, Artificial Sequence
  Single strand DNA oligonucleotide
aaaggatccgttcgctttctccgatcctc

SEQ ID NO: 3874 - DNA, 31 bp, Artificial Sequence
  Single strand DNA oligonucleotide
aaaggatccaccagagtgtcaccactcacag

SEQ ID NO: 3875 - DNA, 31 bp, Artificial Sequence
  Single strand DNA oligonucleotide
aaaggatcccccaatgcatatcaacttctcc

SEQ ID NO: 3876 - DNA, 32 bp, Artificial Sequence
  Single strand DNA oligonucleotide
aaagtcgacaaatcctcttctcagttctgctg

SEQ ID NO: 3877 - DNA, 31 bp, Artificial Sequence
  Single strand DNA oligonucleotide
aaaggatccgcaagatgtttgtttccattcc

SEQ ID NO: 3878 - DNA, 31 bp, Artificial Sequence
  Single strand DNA oligonucleotide
aaaggatccctcgatccagtgttcaaggttc

SEQ ID NO: 3879 - DNA, 31 bp, Artificial Sequence
  Single strand DNA oligonucleotide
aaaggatccatataagcaggcgactcctgtg

SEQ ID NO: 3880 - DNA, 28 bp, Artificial Sequence
  Single strand DNA oligonucleotide
aaaggatccccaaccaaatcccttctcc

SEQ ID NO: 3881 - DNA, 28 bp, Artificial Sequence
  Single strand DNA oligonucleotide
aaaggatcctcactcccactgaagcagc

SEQ ID NO: 3882 - DNA, 29 bp, Artificial Sequence
  Single strand DNA oligonucleotide
aaagtcgaccaggtgtctctctctgggct

SEQ ID NO: 3883 - DNA, 32 bp, Artificial Sequence
  Single strand DNA oligonucleotide
aaagtcgacaacaaatatctttggccatcctc

SEQ ID NO: 3884 - DNA, 29 bp, Artificial Sequence
  Single strand DNA oligonucleotide
aaaggatcccgcacagaatcaaacaatgg

SEQ ID NO: 3885 - DNA, 33 bp, Artificial Sequence
  Single strand DNA oligonucleotide
aaaggatcctctcatcttgttgtttctgagctg

SEQ ID NO: 3886 - DNA, 31 bp, Artificial Sequence
  Single strand DNA oligonucleotide
aaaggatccccaaccaaagaaagaaaagctc

SEQ ID NO: 3887 - DNA, 31 bp, Artificial Sequence
  Single strand DNA oligonucleotide
aaactcgagctcatacacactctccctcgtg

SEQ ID NO: 3888 - DNA, 31 bp, Artificial Sequence
  Single strand DNA oligonucleotide
aaaggatcctaatcgctccagtcaaatctcc

SEQ ID NO: 3889 - DNA, 27 bp, Artificial Sequence
  Single strand DNA oligonucleotide
aaagtcgacatcagatcgatccgcacc

SEQ ID NO: 3890 - DNA, 31 bp, Artificial Sequence
  Single strand DNA oligonucleotide
aaaggatccaacccatgagatccagaaacag

SEQ ID NO: 3891 - DNA, 28 bp, Artificial Sequence
  Single strand DNA oligonucleotide
aaagtcgacatcggtagcaaaggcaacg

SEQ ID NO: 3892 - DNA, 28 bp, Artificial Sequence
  Single strand DNA oligonucleotide
aaaggatccggcaagtgatcgagtcagg

SEQ ID NO: 3893 - DNA, 27 bp, Artificial Sequence
  Single strand DNA oligonucleotide
aaagtcgacatctcaccgatcgcatcc

SEQ ID NO: 3894 - DNA, 31 bp, Artificial Sequence
  Single strand DNA oligonucleotide
aaagtcgacccacaggcatgaacacttattc

SEQ ID NO: 3895 - DNA, 32 bp, Artificial Sequence
  Single strand DNA oligonucleotide
aaaggatccaaccaaccattgaattccaagaa

SEQ ID NO: 3896 - DNA, 34 bp, Artificial Sequence
  Single strand DNA oligonucleotide
aaaggatcctctctctgttttcgatttctagagc

SEQ ID NO: 3897 - DNA, 29 bp, Artificial Sequence
  Single strand DNA oligonucleotide
aaaggatccaaacgaccacctcacctcac

SEQ ID NO: 3898 - DNA, 29 bp, Artificial Sequence
  Single strand DNA oligonucleotide
aaaggatccgctagcccgctactacccag

SEQ ID NO: 3899 - DNA, 33 bp, Artificial Sequence
  Single strand DNA oligonucleotide
aaagtcgacgctttcaaagttgaagcaagagag

SEQ ID NO: 3900 - DNA, 31 bp, Artificial Sequence
  Single strand DNA oligonucleotide
aaaggatccccagaaccctaatctgagatcg

SEQ ID NO: 3901 - DNA, 31 bp, Artificial Sequence
  Single strand DNA oligonucleotide
aaaggatccattggttattagtgggagcgtg

SEQ ID NO: 3902 - DNA, 34 bp, Artificial Sequence
  Single strand DNA oligonucleotide
aaaggatcctgacctgaggaagaggataaagaac

SEQ ID NO: 3903 - DNA, 31 bp, Artificial Sequence
  Single strand DNA oligonucleotide
aaaggatcccacacatcactcattcagttgc

SEQ ID NO: 3904 - DNA, 28 bp, Artificial Sequence
  Single strand DNA oligonucleotide
aaaggatccgtccacaagccacaccaac

SEQ ID NO: 3905 - DNA, 30 bp, Artificial Sequence
  Single strand DNA oligonucleotide
aaaggatccatctcgcggtatcagatctcc

SEQ ID NO: 3906 - DNA, 26 bp, Artificial Sequence
  Single strand DNA oligonucleotide
aaaggatcctccccacactgccactg

SEQ ID NO: 3907 - DNA, 33 bp, Artificial Sequence
  Single strand DNA oligonucleotide
aaactcgagaccattgttgtttcttcctccttc

SEQ ID NO: 3908 - DNA, 27 bp, Artificial Sequence
  Single strand DNA oligonucleotide
aaaggatccaaatcctgcgaagcgagc

SEQ ID NO: 3909 - DNA, 36 bp, Artificial Sequence
  Single strand DNA oligonucleotide
aaagtcgacccttcttcactctaaattatcacaacc

SEQ ID NO: 3910 - DNA, 31 bp, Artificial Sequence
  Single strand DNA oligonucleotide
aaaggatccgagctgatgagaaagcttggac

SEQ ID NO: 3911 - DNA, 29 bp, Artificial Sequence
  Single strand DNA oligonucleotide
aaaggatcccgctagggtttaagcagcag

SEQ ID NO: 3912 - DNA, 29 bp, Artificial Sequence
  Single strand DNA oligonucleotide
aaaggatcccacgctcaacattgcaactc

SEQ ID NO: 3913 - DNA, 36 bp, Artificial Sequence
  Single strand DNA oligonucleotide
aaaggatccgtttcacttcaaatgagaacaataatg

SEQ ID NO: 3914 - DNA, 31 bp, Artificial Sequence
  Single strand DNA oligonucleotide
aaaggatcccgcattctccatttattggttc

SEQ ID NO: 3915 - DNA, 27 bp, Artificial Sequence
  Single strand DNA oligonucleotide
aaaggatccgccccaacaacagagacg

SEQ ID NO: 3916 - DNA, 33 bp, Artificial Sequence
  Single strand DNA oligonucleotide
aaaggatcctcgtctgtatctctctgaccactc

SEQ ID NO: 3917 - DNA, 34 bp, Artificial Sequence
  Single strand DNA oligonucleotide
aaaggatccgcaaatacataaattcgaacattgc

SEQ ID NO: 3918 - DNA, 31 bp, Artificial Sequence
  Single strand DNA oligonucleotide
aaaggatccaagccatcaatcttgtcctttg

SEQ ID NO: 3919 - DNA, 29 bp, Artificial Sequence
  Single strand DNA oligonucleotide
aaagtcgaccttcggtctcccactcactg

SEQ ID NO: 3920 - DNA, 27 bp, Artificial Sequence
  Single strand DNA oligonucleotide
aaactcgaggagggtttagccggttgg

SEQ ID NO: 3921 - DNA, 29 bp, Artificial Sequence
  Single strand DNA oligonucleotide
aaagtcgacggtccgttcccatactctcc

SEQ ID NO: 3922 - DNA, 31 bp, Artificial Sequence
  Single strand DNA oligonucleotide
aaactcgagaccgtcctacaactagccactg

SEQ ID NO: 3923 - DNA, 30 bp, Artificial Sequence
  Single strand DNA oligonucleotide
aaaggatcccatgtcccaagtggatagacg

SEQ ID NO: 3924 - DNA, 31 bp, Artificial Sequence
  Single strand DNA oligonucleotide
aaaggatccgtaaaggtgaggtgtgccaatc

SEQ ID NO: 3925 - DNA, 31 bp, Artificial Sequence
  Single strand DNA oligonucleotide
aaaggatccactctggcacactttcacattg

SEQ ID NO: 3926 - DNA, 33 bp, Artificial Sequence
  Single strand DNA oligonucleotide
tttctcgaggcacacagctagctagctagaccc

SEQ ID NO: 3927 - DNA, 29 bp, Artificial Sequence
  Single strand DNA oligonucleotide
aaagtcgacgcctcctcgtcttctcacac

SEQ ID NO: 3928 - DNA, 33 bp, Artificial Sequence
  Single strand DNA oligonucleotide
aaagtcgacaacgtggaagctcaatataccaac

SEQ ID NO: 3929 - DNA, 32 bp, Artificial Sequence
  Single strand DNA oligonucleotide
aaaggatcccttaattccaatgctgccttagc

SEQ ID NO: 3930 - DNA, 26 bp, Artificial Sequence
  Single strand DNA oligonucleotide
aaaggatccccgacatggcgatcacc

SEQ ID NO: 3931 - DNA, 29 bp, Artificial Sequence
  Single strand DNA oligonucleotide
aaaggatcctgcatcgcagatagaacagg

SEQ ID NO: 3932 - DNA, 36 bp, Artificial Sequence
  Single strand DNA oligonucleotide
aaaggatccgagagtttgttaagtttcttcacttgg

SEQ ID NO: 3933 - DNA, 28 bp, Artificial Sequence
  Single strand DNA oligonucleotide
aaaggatcccgaggatttccggactagc

SEQ ID NO: 3934 - DNA, 31 bp, Artificial Sequence
  Single strand DNA oligonucleotide
aaaggatccacaaccatccatctcagctttc

SEQ ID NO: 3935 - DNA, 33 bp, Artificial Sequence
  Single strand DNA oligonucleotide
aaaggatcctcacaattaacaaatcctcgaaac

SEQ ID NO: 3936 - DNA, 28 bp, Artificial Sequence
  Single strand DNA oligonucleotide
aaaggatccaccacgatcgagagcagag

SEQ ID NO: 3937 - DNA, 32 bp, Artificial Sequence
  Single strand DNA oligonucleotide
aaaggatcctgtatgtactacgctcggttctg

SEQ ID NO: 3938 - DNA, 30 bp, Artificial Sequence
  Single strand DNA oligonucleotide
aaaggatccgtcaaacaaacagccagaagc

SEQ ID NO: 3939 - DNA, 33 bp, Artificial Sequence
  Single strand DNA oligonucleotide
aaagtcgacaatccgtgtttccgatttacattc

SEQ ID NO: 3940 - DNA, 32 bp, Artificial Sequence
  Single strand DNA oligonucleotide
aaaggatccacttgttcccacactcactcatc

SEQ ID NO: 3941 - DNA, 34 bp, Artificial Sequence
  Single strand DNA oligonucleotide
aaagtcgaccattaagataagacgacgacaatcg

SEQ ID NO: 3942 - DNA, 31 bp, Artificial Sequence
  Single strand DNA oligonucleotide
aaagtcgacttcccaatcaagttcaagatgg

SEQ ID NO: 3943 - DNA, 32 bp, Artificial Sequence
  Single strand DNA oligonucleotide
aaaggatccttctcttgagtcttgacctctgc

SEQ ID NO: 3944 - DNA, 33 bp, Artificial Sequence
  Single strand DNA oligonucleotide
aaagtcgacgaaaggaaatggaaaacgtgattc

SEQ ID NO: 3945 - DNA, 31 bp, Artificial Sequence
  Single strand DNA oligonucleotide
aaaggatccaatctcccaaattaagccatcc

SEQ ID NO: 3946 - DNA, 26 bp, Artificial Sequence
  Single strand DNA oligonucleotide
aaaggatccccacctcctctgcgctc

SEQ ID NO: 3947 - DNA, 31 bp, Artificial Sequence
  Single strand DNA oligonucleotide
aaaggatccccacgaaagtttggtttcagac

SEQ ID NO: 3948 - DNA, 35 bp, Artificial Sequence
  Single strand DNA oligonucleotide
aaaggatccgaattgtatcaaacaacaagatctgc

SEQ ID NO: 3949 - DNA, 32 bp, Artificial Sequence
  Single strand DNA oligonucleotide
aaaggatcccgaagaacagatgaagaagaacg

SEQ ID NO: 3950 - DNA, 26 bp, Artificial Sequence
  Single strand DNA oligonucleotide
aaaggatccaccctgcaagcgtcatg

SEQ ID NO: 3951 - DNA, 27 bp, Artificial Sequence
  Single strand DNA oligonucleotide
aaagtcgaccgaatcgacctccgtctc

SEQ ID NO: 3952 - DNA, 32 bp, Artificial Sequence
  Single strand DNA oligonucleotide
aaagtcgacctccataccaatttcacagttcc

SEQ ID NO: 3953 - DNA, 31 bp, Artificial Sequence
  Single strand DNA oligonucleotide
aaaggatccactggatgtctggatggcatag

SEQ ID NO: 3954 - DNA, 29 bp, Artificial Sequence
  Single strand DNA oligonucleotide
aaaggatccatcaccgctctcgttgtctc

SEQ ID NO: 3955 - DNA, 33 bp, Artificial Sequence
  Single strand DNA oligonucleotide
aaaggatccctacagtcctttgtctctgccttc

SEQ ID NO: 3956 - DNA, 29 bp, Artificial Sequence
  Single strand DNA oligonucleotide
aaagtcgacgtgaacagggtaaggcgatg

SEQ ID NO: 3957 - DNA, 31 bp, Artificial Sequence
  Single strand DNA oligonucleotide
aaagtcgacttaacctcaccctctttaccca

SEQ ID NO: 3958 - DNA, 29 bp, Artificial Sequence
  Single strand DNA oligonucleotide
aaaggatcccacactcgagagccatctcc

SEQ ID NO: 3959 - DNA, 31 bp, Artificial Sequence
  Single strand DNA oligonucleotide
aaagtcgacggtgctctctttcttcccattc

SEQ ID NO: 3960 - DNA, 29 bp, Artificial Sequence
  Single strand DNA oligonucleotide
aaaggatccaaccaaaccctccagagtcc

SEQ ID NO: 3961 - DNA, 31 bp, Artificial Sequence
  Single strand DNA oligonucleotide
aaagaattctgtctctcgagtgtcaaccaac

SEQ ID NO: 3962 - DNA, 33 bp, Artificial Sequence
  Single strand DNA oligonucleotide
aaaggatccttgtttgtatcttctgatcggttc

SEQ ID NO: 3963 - DNA, 29 bp, Artificial Sequence
  Single strand DNA oligonucleotide
aaaggatccaggtgcgtttcctatcgctc

SEQ ID NO: 3964 - DNA, 31 bp, Artificial Sequence
  Single strand DNA oligonucleotide
aaaggatcccttagctcagctcaaccacatc

SEQ ID NO: 3965 - DNA, 31 bp, Artificial Sequence
  Single strand DNA oligonucleotide
aaaggatccggaatgttcctctgaacctctg

SEQ ID NO: 3966 - DNA, 31 bp, Artificial Sequence
  Single strand DNA oligonucleotide
aaaggatcccttcaagctcacattggtcctc

SEQ ID NO: 3967 - DNA, 29 bp, Artificial Sequence
  Single strand DNA oligonucleotide
aaagtcgacgttgctgattccctcactgc

SEQ ID NO: 3968 - DNA, 29 bp, Artificial Sequence
  Single strand DNA oligonucleotide
aaaggatccactggcagttggggaggtag

SEQ ID NO: 3969 - DNA, 26 bp, Artificial Sequence
  Single strand DNA oligonucleotide
aaaggatccgcatcgccatggctctc

SEQ ID NO: 3970 - DNA, 29 bp, Artificial Sequence
  Single strand DNA oligonucleotide
aaaggatcccttcgtgggatcggagtatc

SEQ ID NO: 3971 - DNA, 33 bp, Artificial Sequence
  Single strand DNA oligonucleotide
aaagtcgacaaatcttctgtagcgacttgatcc

SEQ ID NO: 3972 - DNA, 31 bp, Artificial Sequence
  Single strand DNA oligonucleotide
aaaggatccaaggaagaatccgatcctgaac

SEQ ID NO: 3973 - DNA, 31 bp, Artificial Sequence
  Single strand DNA oligonucleotide
aaaggatccggaagagcgagagcttactgtc

SEQ ID NO: 3974 - DNA, 33 bp, Artificial Sequence
  Single strand DNA oligonucleotide
aaactcgagcctattaatctgtgcaaacccttg

SEQ ID NO: 3975 - DNA, 27 bp, Artificial Sequence
  Single strand DNA oligonucleotide
aaaggatccggtgatcttgggggttcc

SEQ ID NO: 3976 - DNA, 27 bp, Artificial Sequence
  Single strand DNA oligonucleotide
aaaggatcccgtcgctagccatcttcc

SEQ ID NO: 3977 - DNA, 29 bp, Artificial Sequence
  Single strand DNA oligonucleotide
aaaggatccctctactcgcgaagccaaag

SEQ ID NO: 3978 - DNA, 32 bp, Artificial Sequence
  Single strand DNA oligonucleotide
aaaggatcctctcaacctttatctgatcgcac

SEQ ID NO: 3979 - DNA, 28 bp, Artificial Sequence
  Single strand DNA oligonucleotide
aaactcgaggcagagcaccacagggtag

SEQ ID NO: 3980 - DNA, 32 bp, Artificial Sequence
  Single strand DNA oligonucleotide
aaaggatccttggtagagagattcttgcgttg

SEQ ID NO: 3981 - DNA, 30 bp, Artificial Sequence
  Single strand DNA oligonucleotide
aaaggatccagtgaccaactgaccacttcc

SEQ ID NO: 3982 - DNA, 31 bp, Artificial Sequence
  Single strand DNA oligonucleotide
aaaggatcccgcctactgatcacaaattcac

SEQ ID NO: 3983 - DNA, 33 bp, Artificial Sequence
  Single strand DNA oligonucleotide
aaagtcgacatagaacaccatggaaaggaaaag

SEQ ID NO: 3984 - DNA, 36 bp, Artificial Sequence
  Single strand DNA oligonucleotide
aaactcgagtcttcaattacaaaattgtcttgatcc

SEQ ID NO: 3985 - DNA, 29 bp, Artificial Sequence
  Single strand DNA oligonucleotide
aaagtcgacagggagtttggcagttgctc

SEQ ID NO: 3986 - DNA, 32 bp, Artificial Sequence
  Single strand DNA oligonucleotide
aaaggatccttggaaagtgcaaattaaagtgg

SEQ ID NO: 3987 - DNA, 31 bp, Artificial Sequence
  Single strand DNA oligonucleotide
aaaggatccgtttcttcttggcaattcgttg

SEQ ID NO: 3988 - DNA, 30 bp, Artificial Sequence
  Single strand DNA oligonucleotide
aaaggatccgaaccaggtcaagtggagatg

SEQ ID NO: 3989 - DNA, 31 bp, Artificial Sequence
  Single strand DNA oligonucleotide
aaactcgaggctgctacctttaacacgatcc

SEQ ID NO: 3990 - DNA, 28 bp, Artificial Sequence
  Single strand DNA oligonucleotide
tttgtcgactttcgccatgtgcttgtgt

SEQ ID NO: 3991 - DNA, 33 bp, Artificial Sequence
  Single strand DNA oligonucleotide
aaaggtacctgagatagcccgctactacaaatc

SEQ ID NO: 3992 - DNA, 31 bp, Artificial Sequence
  Single strand DNA oligonucleotide
aaagaattcttatgtaggagagatggccgag

SEQ ID NO: 3993 - DNA, 28 bp, Artificial Sequence
  Single strand DNA oligonucleotide
aaaggtacccccacgatcagcagaacac

SEQ ID NO: 3994 - DNA, 41 bp, Artificial Sequence
  Single strand DNA oligonucleotide
tttgaattcctactaattatcttttgaagcaagtgtagctt

SEQ ID NO: 3995 - DNA, 31 bp, Artificial Sequence
  Single strand DNA oligonucleotide
aaaggtacctcaaccacttgatttccatcag

SEQ ID NO: 3996 - DNA, 31 bp, Artificial Sequence
  Single strand DNA oligonucleotide
aaagaattccgctagaaacaagagagcacag

SEQ ID NO: 3997 - DNA, 28 bp, Artificial Sequence
  Single strand DNA oligonucleotide
tttgaattcacttggttgacgccgctac

SEQ ID NO: 3998 - DNA, 31 bp, Artificial Sequence
  Single strand DNA oligonucleotide
aaagaattcagctgaactgacgagaaattcg

SEQ ID NO: 3999 - DNA, 31 bp, Artificial Sequence
  Single strand DNA oligonucleotide
aaaggtaccaccgttctttgctttgactttg

SEQ ID NO: 4000 - DNA, 31 bp, Artificial Sequence
  Single strand DNA oligonucleotide
aaaggtaccatttcgtccaactggcagatac

SEQ ID NO: 4001 - DNA, 30 bp, Artificial Sequence
  Single strand DNA oligonucleotide
tttgaattctcagtggcaactggatcgatg

SEQ ID NO: 4002 - DNA, 31 bp, Artificial Sequence
  Single strand DNA oligonucleotide
aaagatatcttcacaaacagaagcaaagctg

SEQ ID NO: 4003 - DNA, 31 bp, Artificial Sequence
  Single strand DNA oligonucleotide
aaacccgggactcctcgtgctcatccataac

SEQ ID NO: 4004 - DNA, 35 bp, Artificial Sequence
  Single strand DNA oligonucleotide
aaaggtaccctatgtccaccaatggatcataactc

SEQ ID NO: 4005 - DNA, 30 bp, Artificial Sequence
  Single strand DNA oligonucleotide
aaaggtaccccaccgtgtacactccagttc

SEQ ID NO: 4006 - DNA, 29 bp, Artificial Sequence
  Single strand DNA oligonucleotide
aaaggtaccggcacagaaggctagaccag

SEQ ID NO: 4007 - DNA, 31 bp, Artificial Sequence
  Single strand DNA oligonucleotide
aaaggatccacagtggaacacaagtctgctg

SEQ ID NO: 4008 - DNA, 31 bp, Artificial Sequence
  Single strand DNA oligonucleotide
aaaggatccaaagggtagctagcacaactgg

SEQ ID NO: 4009 - DNA, 30 bp, Artificial Sequence
  Single strand DNA oligonucleotide
tttggtaccggtatcaggttcgccttcttg

SEQ ID NO: 4010 - DNA, 31 bp, Artificial Sequence
  Single strand DNA oligonucleotide
aaagaattcgatcgttgcgtttgtatcttcc

SEQ ID NO: 4011 - DNA, 31 bp, Artificial Sequence
  Single strand DNA oligonucleotide
aaaggtacctactagacaggcgttgcatcag

SEQ ID NO: 4012 - DNA, 31 bp, Artificial Sequence
  Single strand DNA oligonucleotide
aaagaattccattcagttccacatccacaac

SEQ ID NO: 4013 - DNA, 27 bp, Artificial Sequence
  Single strand DNA oligonucleotide
aaaggtaccagacacacatgcacgcac

SEQ ID NO: 4014 - DNA, 31 bp, Artificial Sequence
  Single strand DNA oligonucleotide
aaaggatccactgctacccaaatcaagcaac

SEQ ID NO: 4015 - DNA, 30 bp, Artificial Sequence
  Single strand DNA oligonucleotide
aaagaattcggcttaacacaagtggcaatg

SEQ ID NO: 4016 - DNA, 29 bp, Artificial Sequence
  Single strand DNA oligonucleotide
tttgaattcagggatcctccgtatgccac

SEQ ID NO: 4017 - DNA, 30 bp, Artificial Sequence
  Single strand DNA oligonucleotide
aaaaggcctaagaaagtcgaatctcgggtg

SEQ ID NO: 4018 - DNA, 35 bp, Artificial Sequence
  Single strand DNA oligonucleotide
aaaggatccctaaatttcatctttcagtgccttgc

SEQ ID NO: 4019 - DNA, 31 bp, Artificial Sequence
  Single strand DNA oligonucleotide
aaaggtaccgggtcttcaatgttactcctgc

SEQ ID NO: 4020 - DNA, 36 bp, Artificial Sequence
  Single strand DNA oligonucleotide
aaaggatccttagacatctatctacatggattgcac

SEQ ID NO: 4021 - DNA, 39 bp, Artificial Sequence
  Single strand DNA oligonucleotide
tttgaattctcattgatgaggcatgcaggtagtaagaag

SEQ ID NO: 4022 - DNA, 31 bp, Artificial Sequence
  Single strand DNA oligonucleotide
aaaggtaccatagcaaatgcctcttccacac

SEQ ID NO: 4023 - DNA, 31 bp, Artificial Sequence
  Single strand DNA oligonucleotide
aaagatatcaatctagatgacattgggcagg

SEQ ID NO: 4024 - DNA, 31 bp, Artificial Sequence
  Single strand DNA oligonucleotide
aaaggtaccaccgacaagagctccataagag

SEQ ID NO: 4025 - DNA, 31 bp, Artificial Sequence
  Single strand DNA oligonucleotide
aaaggtacctagaatttcatgcccggtgtag

SEQ ID NO: 4026 - DNA, 31 bp, Artificial Sequence
  Single strand DNA oligonucleotide
aaaggtaccaatctgcgaggtttcttgaatg

SEQ ID NO: 4027 - DNA, 34 bp, Artificial Sequence
  Single strand DNA oligonucleotide
aaaggtaccctacgcgagtttaattaccaaggac

SEQ ID NO: 4028 - DNA, 32 bp, Artificial Sequence
  Single strand DNA oligonucleotide
aaaggtaccctaacttatcaagcgtggcaatg

SEQ ID NO: 4029 - DNA, 31 bp, Artificial Sequence
  Single strand DNA oligonucleotide
aaaggtaccgctgatgaaggacagagaggag

SEQ ID NO: 4030 - DNA, 34 bp, Artificial Sequence
  Single strand DNA oligonucleotide
aaaggtaccctacatgaatgaagctagcagcaac

SEQ ID NO: 4031 - DNA, 31 bp, Artificial Sequence
  Single strand DNA oligonucleotide
aaaggtaccgaccatgagcatgatagagctg

SEQ ID NO: 4032 - DNA, 30 bp, Artificial Sequence
  Single strand DNA oligonucleotide
aaagaattcccttcacttcacaggaagcac

SEQ ID NO: 4033 - DNA, 34 bp, Artificial Sequence
  Single strand DNA oligonucleotide
aaagaattctcaatgtattctcaattgtttgctg

SEQ ID NO: 4034 - DNA, 31 bp, Artificial Sequence
  Single strand DNA oligonucleotide
aaagaattcacctcgtctgcatttgctgtag

SEQ ID NO: 4035 - DNA, 32 bp, Artificial Sequence
  Single strand DNA oligonucleotide
aaaggtacccatggcacagtacatcctgtaag

SEQ ID NO: 4036 - DNA, 32 bp, Artificial Sequence
  Single strand DNA oligonucleotide
aaaggtacctcatcaagttacaagcacacgag

SEQ ID NO: 4037 - DNA, 34 bp, Artificial Sequence
  Single strand DNA oligonucleotide
aaaggtaccgacaatttcagagttgctttctagc

SEQ ID NO: 4038 - DNA, 34 bp, Artificial Sequence
  Single strand DNA oligonucleotide
aaaaggcctcaatatggaactcaaactcaaccag

SEQ ID NO: 4039 - DNA, 31 bp, Artificial Sequence
  Single strand DNA oligonucleotide
aaaggtacccatgacaaacaggaagatgctg

SEQ ID NO: 4040 - DNA, 31 bp, Artificial Sequence
  Single strand DNA oligonucleotide
aaaggtacccatgacctttgcgattaagatg

SEQ ID NO: 4041 - DNA, 30 bp, Artificial Sequence
  Single strand DNA oligonucleotide
aaaggtacccggatggccagatatcactac

SEQ ID NO: 4042 - DNA, 31 bp, Artificial Sequence
  Single strand DNA oligonucleotide
aaaggtaccaattcccaattcaactcattcg

SEQ ID NO: 4043 - DNA, 32 bp, Artificial Sequence
  Single strand DNA oligonucleotide
aaaggtacctatattccattcaatgcgacagg

SEQ ID NO: 4044 - DNA, 31 bp, Artificial Sequence
  Single strand DNA oligonucleotide
aaagaattcaggtacaatgccgtttcacaat

SEQ ID NO: 4045 - DNA, 31 bp, Artificial Sequence
  Single strand DNA oligonucleotide
aaaggatccgaaaccgaaatgccattacaag

SEQ ID NO: 4046 - DNA, 33 bp, Artificial Sequence
  Single strand DNA oligonucleotide
aaaggtaccctaccattttgaaccacaaacagc

SEQ ID NO: 4047 - DNA, 31 bp, Artificial Sequence
  Single strand DNA oligonucleotide
aaagaattcctattgcatcatggttgtgtcc

SEQ ID NO: 4048 - DNA, 31 bp, Artificial Sequence
  Single strand DNA oligonucleotide
aaagaattctatggcgatctggtaggttagg

SEQ ID NO: 4049 - DNA, 33 bp, Artificial Sequence
  Single strand DNA oligonucleotide
aaagaattccagagggtatcacataaacggaag

SEQ ID NO: 4050 - DNA, 31 bp, Artificial Sequence
  Single strand DNA oligonucleotide
aaaggtaccacctacacaagtccaggagcac

SEQ ID NO: 4051 - DNA, 31 bp, Artificial Sequence
  Single strand DNA oligonucleotide
aaagaattcggtgagctttgcatacatcaag

SEQ ID NO: 4052 - DNA, 28 bp, Artificial Sequence
  Single strand DNA oligonucleotide
aaaggtacctcccatgcgcaacattaac

SEQ ID NO: 4053 - DNA, 31 bp, Artificial Sequence
  Single strand DNA oligonucleotide
aaagaattcagtccaaacaggtgtccatagg

SEQ ID NO: 4054 - DNA, 30 bp, Artificial Sequence
  Single strand DNA oligonucleotide
aaaggtacctcatcgtcacaactcacaagc

SEQ ID NO: 4055 - DNA, 31 bp, Artificial Sequence
  Single strand DNA oligonucleotide
aaaggatccccaattacaatccagaacgacc

SEQ ID NO: 4056 - DNA, 39 bp, Artificial Sequence
  Single strand DNA oligonucleotide
tttgaattctcatcatttaatgtaagcaactgtacatcc

SEQ ID NO: 4057 - DNA, 36 bp, Artificial Sequence
  Single strand DNA oligonucleotide
aaaggtacctcactcaaatcaaataatcaacaagag

SEQ ID NO: 4058 - DNA, 35 bp, Artificial Sequence
  Single strand DNA oligonucleotide
aaaggtacccacaagccttcaaaactagtcaattc

SEQ ID NO: 4059 - DNA, 31 bp, Artificial Sequence
  Single strand DNA oligonucleotide
aaaggtaccacagtccaaattgacagaatgg

SEQ ID NO: 4060 - DNA, 31 bp, Artificial Sequence
  Single strand DNA oligonucleotide
aaaggtacctcggcaatatcattcacagaac

SEQ ID NO: 4061 - DNA, 31 bp, Artificial Sequence
  Single strand DNA oligonucleotide
aaagatatcattgcacaacatgaatctcctc

SEQ ID NO: 4062 - DNA, 31 bp, Artificial Sequence
  Single strand DNA oligonucleotide
aaaggtaccgcatgctacggaaagtcctaac

SEQ ID NO: 4063 - DNA, 30 bp, Artificial Sequence
  Single strand DNA oligonucleotide
aaaggtacctccaatttgaagctgacaagg

SEQ ID NO: 4064 - DNA, 32 bp, Artificial Sequence
  Single strand DNA oligonucleotide
aaaggtaccacaagaccaaattgcttgatacg

SEQ ID NO: 4065 - DNA, 29 bp, Artificial Sequence
  Single strand DNA oligonucleotide
aaaggtaccagcaattactgtgccgaagc

SEQ ID NO: 4066 - DNA, 29 bp, Artificial Sequence
  Single strand DNA oligonucleotide
aaaggtaccgatccttgcacagcacaatg

SEQ ID NO: 4067 - DNA, 34 bp, Artificial Sequence
  Single strand DNA oligonucleotide
aaaggtaccctatcgacatggaagaagaaatgag

SEQ ID NO: 4068 - DNA, 32 bp, Artificial Sequence
  Single strand DNA oligonucleotide
aaaggtacctgagatggcaaaccatataaagc

SEQ ID NO: 4069 - DNA, 31 bp, Artificial Sequence
  Single strand DNA oligonucleotide
aaagaattcagttaggaggcaagcggtagtg

SEQ ID NO: 4070 - DNA, 31 bp, Artificial Sequence
  Single strand DNA oligonucleotide
aaaggtaccaaatgacgatggaataagctgc

SEQ ID NO: 4071 - DNA, 29 bp, Artificial Sequence
  Single strand DNA oligonucleotide
aaaggatccgaccatccatccacatgaag

SEQ ID NO: 4072 - DNA, 31 bp, Artificial Sequence
  Single strand DNA oligonucleotide
aaaggtaccaaagcatgccaaattacaggac

SEQ ID NO: 4073 - DNA, 31 bp, Artificial Sequence
  Single strand DNA oligonucleotide
aaaggtacccttcaaagcctgatcctgagag

SEQ ID NO: 4074 - DNA, 33 bp, Artificial Sequence
  Single strand DNA oligonucleotide
aaaggtaccggctattagagatccgttaggtgg

SEQ ID NO: 4075 - DNA, 32 bp, Artificial Sequence
  Single strand DNA oligonucleotide
tttggtaccttagagagcacaagttgaccagg

SEQ ID NO: 4076 - DNA, 31 bp, Artificial Sequence
  Single strand DNA oligonucleotide
aaaggtaccaagtcaagctgattctccaacg

SEQ ID NO: 4077 - DNA, 31 bp, Artificial Sequence
  Single strand DNA oligonucleotide
aaaggtaccaaaccctctcttcctcttcagc

SEQ ID NO: 4078 - DNA, 31 bp, Artificial Sequence
  Single strand DNA oligonucleotide
aaaggtaccagatgcaggtttaccaaactcg

SEQ ID NO: 4079 - DNA, 31 bp, Artificial Sequence
  Single strand DNA oligonucleotide
aaaggtacctgcaaacgagaaacacacatag

SEQ ID NO: 4080 - DNA, 31 bp, Artificial Sequence
  Single strand DNA oligonucleotide
aaaggtaccgtaaactgcctcaagcagcaac

SEQ ID NO: 4081 - DNA, 31 bp, Artificial Sequence
  Single strand DNA oligonucleotide
aaagaattcttgactgctgaaccacgattac

SEQ ID NO: 4082 - DNA, 31 bp, Artificial Sequence
  Single strand DNA oligonucleotide
aaaaggcctagggtagcatttcaaactcacg

SEQ ID NO: 4083 - DNA, 32 bp, Artificial Sequence
  Single strand DNA oligonucleotide
aaaggatccgggttggctataagattgatgtg

SEQ ID NO: 4084 - DNA, 30 bp, Artificial Sequence
  Single strand DNA oligonucleotide
aaagaattccatctcttgtttgggacatgc

SEQ ID NO: 4085 - DNA, 31 bp, Artificial Sequence
  Single strand DNA oligonucleotide
aaaggtaccgacaacattccaacatcagtcg

SEQ ID NO: 4086 - DNA, 36 bp, Artificial Sequence
  Single strand DNA oligonucleotide
aaaggtaccctatcttttgaaagcccaataatgaag

SEQ ID NO: 4087 - DNA, 31 bp, Artificial Sequence
  Single strand DNA oligonucleotide
aaaggtacctcaagagcagtaggtgacatgg

SEQ ID NO: 4088 - DNA, 34 bp, Artificial Sequence
  Single strand DNA oligonucleotide
tttgaattcttaggggtatgtaggccattacacg

SEQ ID NO: 4089 - DNA, 31 bp, Artificial Sequence
  Single strand DNA oligonucleotide
aaaggatccttcagcaaaggttagcacacag

SEQ ID NO: 4090 - DNA, 31 bp, Artificial Sequence
  Single strand DNA oligonucleotide
aaaggatcctaatttcttgaaacggaggcac

SEQ ID NO: 4091 - DNA, 31 bp, Artificial Sequence
  Single strand DNA oligonucleotide
aaaaggccttgatctattggtctgcaaatgg

SEQ ID NO: 4092 - DNA, 32 bp, Artificial Sequence
  Single strand DNA oligonucleotide
tttgaattcagcaccatgtatgatatcgcaag

SEQ ID NO: 4093 - DNA, 31 bp, Artificial Sequence
  Single strand DNA oligonucleotide
aaaggtacccgacagctctccacatagtcag

SEQ ID NO: 4094 - DNA, 33 bp, Artificial Sequence
  Single strand DNA oligonucleotide
aaaggtaccgaagatgcacaatcatcattcaag

SEQ ID NO: 4095 - DNA, 29 bp, Artificial Sequence
  Single strand DNA oligonucleotide
aaaggtaccaccaaacagcttccaagacg

SEQ ID NO: 4096 - DNA, 34 bp, Artificial Sequence
  Single strand DNA oligonucleotide
aaaggtaccctagaacaaagtcagtcttcgcatc

SEQ ID NO: 4097 - DNA, 31 bp, Artificial Sequence
  Single strand DNA oligonucleotide
aaaggtaccatatttcccttcaacggagagg

SEQ ID NO: 4098 - DNA, 31 bp, Artificial Sequence
  Single strand DNA oligonucleotide
aaaggtaccgtacttgggagtaccgaggttg

SEQ ID NO: 4099 - DNA, 31 bp, Artificial Sequence
  Single strand DNA oligonucleotide
aaaggtacccatgccaaatcctttggtaatc

SEQ ID NO: 4100 - DNA, 31 bp, Artificial Sequence
  Single strand DNA oligonucleotide
aaaggtaccatcgctaaagtttgccactcac

SEQ ID NO: 4101 - DNA, 31 bp, Artificial Sequence
  Single strand DNA oligonucleotide
aaaggatccctgcttatcgcaaagtcgtttc

SEQ ID NO: 4102 - DNA, 31 bp, Artificial Sequence
  Single strand DNA oligonucleotide
aaaggtacctcatgaaccaccaaacaaagtg

SEQ ID NO: 4103 - DNA, 31 bp, Artificial Sequence
  Single strand DNA oligonucleotide
aaaggatcctacaaatttacaccgtgcatcc

SEQ ID NO: 4104 - DNA, 35 bp, Artificial Sequence
  Single strand DNA oligonucleotide
aaaaggcctctaaaaggtctccataggccaaatac

SEQ ID NO: 4105 - DNA, 29 bp, Artificial Sequence
  Single strand DNA oligonucleotide
aaagaattcgtccgcagacatttgatgtg

SEQ ID NO: 4106 - DNA, 29 bp, Artificial Sequence
  Single strand DNA oligonucleotide
tttgaattcaggtggcaactgacaagagg

SEQ ID NO: 4107 - DNA, 31 bp, Artificial Sequence
  Single strand DNA oligonucleotide
aaaggtacccaaatacgggaaaccatcagac

SEQ ID NO: 4108 - DNA, 33 bp, Artificial Sequence
  Single strand DNA oligonucleotide
tttggtaccccattcaacctaccaatggtacac

SEQ ID NO: 4109 - DNA, 31 bp, Artificial Sequence
  Single strand DNA oligonucleotide
aaaggtaccttggataagcaaactgcagaag

SEQ ID NO: 4110 - DNA, 31 bp, Artificial Sequence
  Single strand DNA oligonucleotide
aaaggtaccaactttcattcatcctgcttgg

SEQ ID NO: 4111 - DNA, 31 bp, Artificial Sequence
  Single strand DNA oligonucleotide
aaaggtaccaaacctgaaactcaacaccagc

SEQ ID NO: 4112 - DNA, 33 bp, Artificial Sequence
  Single strand DNA oligonucleotide
aaaggtaccctgatcaaacggaagctatgctac

SEQ ID NO: 4113 - DNA, 31 bp, Artificial Sequence
  Single strand DNA oligonucleotide
aaagaattcagccaatgactggtagcatagc

SEQ ID NO: 4114 - DNA, 31 bp, Artificial Sequence
  Single strand DNA oligonucleotide
aaaggatccggtatcaaatgacaggtgggtc

SEQ ID NO: 4115 - DNA, 31 bp, Artificial Sequence
  Single strand DNA oligonucleotide
aaaggtacccaagcacgatcgatattacagg

SEQ ID NO: 4116 - DNA, 31 bp, Artificial Sequence
  Single strand DNA oligonucleotide
aaaggtaccctttccgacagcactagctacc

SEQ ID NO: 4117 - DNA, 32 bp, Artificial Sequence
  Single strand DNA oligonucleotide
aaaggtaccagtgaggaacgtaaacaacatgc

SEQ ID NO: 4118 - DNA, 31 bp, Artificial Sequence
  Single strand DNA oligonucleotide
aaagaattccatcacaaccaaggtgaacaac

SEQ ID NO: 4119 - DNA, 36 bp, Artificial Sequence
  Single strand DNA oligonucleotide
aaaaggccttggcagtaataattcattcatttcata

SEQ ID NO: 4120 - DNA, 31 bp, Artificial Sequence
  Single strand DNA oligonucleotide
aaaggtaccatcggatcgagaccagatacac

SEQ ID NO: 4121 - DNA, 31 bp, Artificial Sequence
  Single strand DNA oligonucleotide
aaaaggccttccatcaaagtgccctattgtc

SEQ ID NO: 4122 - DNA, 31 bp, Artificial Sequence
  Single strand DNA oligonucleotide
aaaggtaccgggtgaaccacagtacacaatg

SEQ ID NO: 4123 - DNA, 31 bp, Artificial Sequence
  Single strand DNA oligonucleotide
aaaaggcctagtttcccatggagtaggtgtc

SEQ ID NO: 4124 - DNA, 34 bp, Artificial Sequence
  Single strand DNA oligonucleotide
aaaggtaccaaggatcattaaataacacgacagc

SEQ ID NO: 4125 - DNA, 34 bp, Artificial Sequence
  Single strand DNA oligonucleotide
aaaggtaccctacacacagcagctataatcgtgg

SEQ ID NO: 4126 - DNA, 31 bp, Artificial Sequence
  Single strand DNA oligonucleotide
aaaggtaccttaaggccaaacaaatcacctg

SEQ ID NO: 4127 - DNA, 32 bp, Artificial Sequence
  Single strand DNA oligonucleotide
aaaggtaccttaaacgcagatcttattgctgc

SEQ ID NO: 4128 - DNA, 31 bp, Artificial Sequence
  Single strand DNA oligonucleotide
aaaggtaccgtgccacctcttatttctgctc

SEQ ID NO: 4129 - DNA, 32 bp, Artificial Sequence
  Single strand DNA oligonucleotide
aaaggatccgataaattattccacatgccgac

SEQ ID NO: 4130 - DNA, 32 bp, Artificial Sequence
  Single strand DNA oligonucleotide
aaaggtaccaagacgtcgtgttattgtggaag

SEQ ID NO: 4131 - DNA, 31 bp, Artificial Sequence
  Single strand DNA oligonucleotide
tttggtaccgcttaagccatccatcattcag

SEQ ID NO: 4132 - DNA, 29 bp, Artificial Sequence
  Single strand DNA oligonucleotide
aaaggtaccttgccgtgaactacatgagc

SEQ ID NO: 4133 - DNA, 31 bp, Artificial Sequence
  Single strand DNA oligonucleotide
aaagaattcaatgaagggtccacatagcaac

SEQ ID NO: 4134 - DNA, 31 bp, Artificial Sequence
  Single strand DNA oligonucleotide
aaaggtacccattgtacagcacatagcaacg

SEQ ID NO: 4135 - DNA, 31 bp, Artificial Sequence
  Single strand DNA oligonucleotide
aaaggtacccagactctctgcactcacatgc

SEQ ID NO: 4136 - DNA, 31 bp, Artificial Sequence
  Single strand DNA oligonucleotide
tttgaattctcaacactgacaggaaccaaac

SEQ ID NO: 4137 - DNA, 31 bp, Artificial Sequence
  Single strand DNA oligonucleotide
tttggtaccctggctgatctttgagaacagg

SEQ ID NO: 4138 - DNA, 31 bp, Artificial Sequence
  Single strand DNA oligonucleotide
aaaggtacctcaacccacaagagtctacctg

SEQ ID NO: 4139 - DNA, 31 bp, Artificial Sequence
  Single strand DNA oligonucleotide
aaaggtaccacagccagccaaagtagttctc

SEQ ID NO: 4140 - DNA, 32 bp, Artificial Sequence
  Single strand DNA oligonucleotide
aaaggtacctaataaactgcctttgctggaac

SEQ ID NO: 4141 - DNA, 31 bp, Artificial Sequence
  Single strand DNA oligonucleotide
aaagaattctatcaagagagcatggagcttg

SEQ ID NO: 4142 - DNA, 31 bp, Artificial Sequence
  Single strand DNA oligonucleotide
aaaggtacccagatttcatgcaccttctcag

SEQ ID NO: 4143 - DNA, 31 bp, Artificial Sequence
  Single strand DNA oligonucleotide
aaaggtacctggttgcaaattgctgactatc

SEQ ID NO: 4144 - DNA, 30 bp, Artificial Sequence
  Single strand DNA oligonucleotide
aaaggtaccaaactagatcaatgcggcctg

SEQ ID NO: 4145 - DNA, 31 bp, Artificial Sequence
  Single strand DNA oligonucleotide
aaagaattccagccagccataaataaattgg

SEQ ID NO: 4146 - DNA, 33 bp, Artificial Sequence
  Single strand DNA oligonucleotide
aaaaggcctaaacggacaggattacataaccac

SEQ ID NO: 4147 - DNA, 31 bp, Artificial Sequence
  Single strand DNA oligonucleotide
aaaaggcctacaaagtggattctgatcctcg

SEQ ID NO: 4148 - DNA, 31 bp, Artificial Sequence
  Single strand DNA oligonucleotide
aaaggtaccaatttccaggctactcagctcc

SEQ ID NO: 4149 - DNA, 31 bp, Artificial Sequence
  Single strand DNA oligonucleotide
aaaggtaccaagattgccattgtttcattcc

SEQ ID NO: 4150 - DNA, 31 bp, Artificial Sequence
  Single strand DNA oligonucleotide
aaaggtaccatggcatgataaagaaaccagc

SEQ ID NO: 4151 - DNA, 31 bp, Artificial Sequence
  Single strand DNA oligonucleotide
aaagaattctgctacatacaatttccggtcc

SEQ ID NO: 4152 - DNA, 28 bp, Artificial Sequence
  Single strand DNA oligonucleotide
tttgaattctttgacgagaggaggaccc

SEQ ID NO: 4153 - DNA, 32 bp, Artificial Sequence
  Single strand DNA oligonucleotide
aaagtcgactgtttgaatttcgctgtattctg

SEQ ID NO: 4154 - DNA, 29 bp, Artificial Sequence
  Single strand DNA oligonucleotide
aaaggatccctttcccagttcacacggac

SEQ ID NO: 4155 - DNA, 29 bp, Artificial Sequence
  Single strand DNA oligonucleotide
tttggatccggaagatggagcctgatcag

SEQ ID NO: 4156 - DNA, 30 bp, Artificial Sequence
  Single strand DNA oligonucleotide
aaagtcgacgaagaatgctccgttcaactc

SEQ ID NO: 4157 - DNA, 31 bp, Artificial Sequence
  Single strand DNA oligonucleotide
aaaggatcccagctaagcgttgacagttgag

SEQ ID NO: 4158 - DNA, 27 bp, Artificial Sequence
  Single strand DNA oligonucleotide
aaagtcgacagcaataactcccgctgc

SEQ ID NO: 4159 - DNA, 26 bp, Artificial Sequence
  Single strand DNA oligonucleotide
tttgtcgacagtccccacacactgcg

SEQ ID NO: 4160 - DNA, 36 bp, Artificial Sequence
  Single strand DNA oligonucleotide
aaaggatccaacttcgcttcatttagttcagtttag

SEQ ID NO: 4161 - DNA, 27 bp, Artificial Sequence
  Single strand DNA oligonucleotide
aaagtcgaccgagagaagatgcgctgc

SEQ ID NO: 4162 - DNA, 27 bp, Artificial Sequence
  Single strand DNA oligonucleotide
aaaggatccgcagcctcgattctcgac

SEQ ID NO: 4163 - DNA, 31 bp, Artificial Sequence
  Single strand DNA oligonucleotide
aaaggatccgtccattaacgtctggatttcg

SEQ ID NO: 4164 - DNA, 31 bp, Artificial Sequence
  Single strand DNA oligonucleotide
aaaggatcccgcggcactaagaaatactctc

SEQ ID NO: 4165 - DNA, 30 bp, Artificial Sequence
  Single strand DNA oligonucleotide
aaaggatccgtgaattgtgggtgagagagc

SEQ ID NO: 4166 - DNA, 31 bp, Artificial Sequence
  Single strand DNA oligonucleotide
aaagtcgacactggtgaagacactgaagcag

SEQ ID NO: 4167 - DNA, 31 bp, Artificial Sequence
  Single strand DNA oligonucleotide
aaactcgagttagcttcacaggaaccaggac

SEQ ID NO: 4168 - DNA, 31 bp, Artificial Sequence
  Single strand DNA oligonucleotide
aaactcgagctcctcacaaatatctcgctgc

SEQ ID NO: 4169 - DNA, 30 bp, Artificial Sequence
  Single strand DNA oligonucleotide
aaagtcgacgtaaattacccggacagcgac

SEQ ID NO: 4170 - DNA, 31 bp, Artificial Sequence
  Single strand DNA oligonucleotide
aaagtcgacgcgataccattgttcattcatc

SEQ ID NO: 4171 - DNA, 31 bp, Artificial Sequence
  Single strand DNA oligonucleotide
aaagtcgacttgaatttcggtaattgggttc

SEQ ID NO: 4172 - DNA, 31 bp, Artificial Sequence
  Single strand DNA oligonucleotide
aaagtcgacaatagccgttccacctaacatc

SEQ ID NO: 4173 - DNA, 34 bp, Artificial Sequence
  Single strand DNA oligonucleotide
aaaggatccgaatgttatagtccatttgcagagc

SEQ ID NO: 4174 - DNA, 31 bp, Artificial Sequence
  Single strand DNA oligonucleotide
aaagtcgacaaagtagcggtaccggaaaatg

SEQ ID NO: 4175 - DNA, 26 bp, Artificial Sequence
  Single strand DNA oligonucleotide
aaaggatccggcatcgacgatgaacg

SEQ ID NO: 4176 - DNA, 31 bp, Artificial Sequence
  Single strand DNA oligonucleotide
aaaggatcctgggcactgtgaaactaatctg

SEQ ID NO: 4177 - DNA, 31 bp, Artificial Sequence
  Single strand DNA oligonucleotide
aaagatatcaataggcaaatgcatcttcagc

SEQ ID NO: 4178 - DNA, 31 bp, Artificial Sequence
  Single strand DNA oligonucleotide
aaaggatccagtgagtgattgcgaatgtgac

SEQ ID NO: 4179 - DNA, 31 bp, Artificial Sequence
  Single strand DNA oligonucleotide
aaaggatccttcaattcgcattgctactctc

SEQ ID NO: 4180 - DNA, 29 bp, Artificial Sequence
  Single strand DNA oligonucleotide
aaaggatccgctcctgcacctcccttatc

SEQ ID NO: 4181 - DNA, 28 bp, Artificial Sequence
  Single strand DNA oligonucleotide
aaaggatccacttgttccagccagccag

SEQ ID NO: 4182 - DNA, 27 bp, Artificial Sequence
  Single strand DNA oligonucleotide
aaagtcgacaagcttccagtgcctcgc

SEQ ID NO: 4183 - DNA, 31 bp, Artificial Sequence
  Single strand DNA oligonucleotide
aaaggatccaaagaaacgggcaatcagaaag

SEQ ID NO: 4184 - DNA, 27 bp, Artificial Sequence
  Single strand DNA oligonucleotide
aaagtcgactgacacatcggcacttgg

SEQ ID NO: 4185 - DNA, 29 bp, Artificial Sequence
  Single strand DNA oligonucleotide
aaaggatccttctccgatcctcacgaaac

SEQ ID NO: 4186 - DNA, 31 bp, Artificial Sequence
  Single strand DNA oligonucleotide
aaaggatccagctgaaagcaatagcaccaag

SEQ ID NO: 4187 - DNA, 27 bp, Artificial Sequence
  Single strand DNA oligonucleotide
tttgatatcgtacgagcgctgaaggca

SEQ ID NO: 4188 - DNA, 34 bp, Artificial Sequence
  Single strand DNA oligonucleotide
aaaggatcctccctttgagctcatttattatcac

SEQ ID NO: 4189 - DNA, 31 bp, Artificial Sequence
  Single strand DNA oligonucleotide
aaaggatccgatgtttgtttccattccatcg

SEQ ID NO: 4190 - DNA, 29 bp, Artificial Sequence
  Single strand DNA oligonucleotide
tttgaattctggatctctcccgaggctcc

SEQ ID NO: 4191 - DNA, 30 bp, Artificial Sequence
  Single strand DNA oligonucleotide
aaaggatccgttcaaggttcagccgagttc

SEQ ID NO: 4192 - DNA, 31 bp, Artificial Sequence
  Single strand DNA oligonucleotide
aaaggatccactgcagcgagagatcagtagg

SEQ ID NO: 4193 - DNA, 28 bp, Artificial Sequence
  Single strand DNA oligonucleotide
aaaggatccatcccttctccatggcatc

SEQ ID NO: 4194 - DNA, 31 bp, Artificial Sequence
  Single strand DNA oligonucleotide
aaaggatccgaggttcacgagtacagtgacg

SEQ ID NO: 4195 - DNA, 32 bp, Artificial Sequence
  Single strand DNA oligonucleotide
aaaggatcccctgcccatttaaatacccatac

SEQ ID NO: 4196 - DNA, 31 bp, Artificial Sequence
  Single strand DNA oligonucleotide
aaagtcgacctttcacaagttgttggcattg

SEQ ID NO: 4197 - DNA, 29 bp, Artificial Sequence
  Single strand DNA oligonucleotide
aaaggatccaaacggaatcccagatccac

SEQ ID NO: 4198 - DNA, 29 bp, Artificial Sequence
  Single strand DNA oligonucleotide
aaaggatcctgtttctgagctgctccaag

SEQ ID NO: 4199 - DNA, 32 bp, Artificial Sequence
  Single strand DNA oligonucleotide
aaaggatccccaaagaaagaaaagctcgactc

SEQ ID NO: 4200 - DNA, 31 bp, Artificial Sequence
  Single strand DNA oligonucleotide
aaactcgagccctcgtgtactgtcctctttc

SEQ ID NO: 4201 - DNA, 31 bp, Artificial Sequence
  Single strand DNA oligonucleotide
aaaggatccgtgatagtcttcagcccagctc

SEQ ID NO: 4202 - DNA, 31 bp, Artificial Sequence
  Single strand DNA oligonucleotide
aaaggatccaccaaggctagacacaagcaac

SEQ ID NO: 4203 - DNA, 30 bp, Artificial Sequence
  Single strand DNA oligonucleotide
aaagtcgaccaggcatgaacacttattccc

SEQ ID NO: 4204 - DNA, 34 bp, Artificial Sequence
  Single strand DNA oligonucleotide
aaaggatccaaccattgaattccaagaatgtaga

SEQ ID NO: 4205 - DNA, 35 bp, Artificial Sequence
  Single strand DNA oligonucleotide
aaaggatcctgttaagggttgttatcaagatttgg

SEQ ID NO: 4206 - DNA, 29 bp, Artificial Sequence
  Single strand DNA oligonucleotide
aaaggatccaccacctcacctcacgaaac

SEQ ID NO: 4207 - DNA, 31 bp, Artificial Sequence
  Single strand DNA oligonucleotide
aaagaattccagcgtagcactattccattcc

SEQ ID NO: 4208 - DNA, 28 bp, Artificial Sequence
  Single strand DNA oligonucleotide
aaaggatccgagatcgcgaaccatcctc

SEQ ID NO: 4209 - DNA, 31 bp, Artificial Sequence
  Single strand DNA oligonucleotide
aaaggatccacgatctcccgtaccttctctc

SEQ ID NO: 4210 - DNA, 27 bp, Artificial Sequence
  Single strand DNA oligonucleotide
aaaggatccattcatcgacgggacgac

SEQ ID NO: 4211 - DNA, 31 bp, Artificial Sequence
  Single strand DNA oligonucleotide
aaaggatcctatcataagcacaatcgcaagc

SEQ ID NO: 4212 - DNA, 30 bp, Artificial Sequence
  Single strand DNA oligonucleotide
aaaggatcctcagatctcccagagaaggtg

SEQ ID NO: 4213 - DNA, 26 bp, Artificial Sequence
  Single strand DNA oligonucleotide
aaaggatccactgccactgccagcct

SEQ ID NO: 4214 - DNA, 33 bp, Artificial Sequence
  Single strand DNA oligonucleotide
aaaggatccgagttgaaatctattggcttccag

SEQ ID NO: 4215 - DNA, 27 bp, Artificial Sequence
  Single strand DNA oligonucleotide
aaagatatccgagttcatcgcctcctc

SEQ ID NO: 4216 - DNA, 31 bp, Artificial Sequence
  Single strand DNA oligonucleotide
aaaggatcccaagcaagaaactcctctttcg

SEQ ID NO: 4217 - DNA, 27 bp, Artificial Sequence
  Single strand DNA oligonucleotide
aaagtcgaccgctgcattgagcaaatg

SEQ ID NO: 4218 - DNA, 30 bp, Artificial Sequence
  Single strand DNA oligonucleotide
aaaggatcccacctgtcgttcttccttcag

SEQ ID NO: 4219 - DNA, 31 bp, Artificial Sequence
  Single strand DNA oligonucleotide
aaaggatcctgtcctttgcctaactccaaag

SEQ ID NO: 4220 - DNA, 32 bp, Artificial Sequence
  Single strand DNA oligonucleotide
aaagtcgacctagagacgtacgtgacagcgag

SEQ ID NO: 4221 - DNA, 31 bp, Artificial Sequence
  Single strand DNA oligonucleotide
aaaggatcctgtcttccgctctcaccttatc

SEQ ID NO: 4222 - DNA, 29 bp, Artificial Sequence
  Single strand DNA oligonucleotide
aaagtcgacatacgtggacatcgaggtgg

SEQ ID NO: 4223 - DNA, 33 bp, Artificial Sequence
  Single strand DNA oligonucleotide
aaagtcgacctctcctttaatggcttctgagag

SEQ ID NO: 4224 - DNA, 31 bp, Artificial Sequence
  Single strand DNA oligonucleotide
aaactcgagactgtcctatatcttggcgtcg

SEQ ID NO: 4225 - DNA, 31 bp, Artificial Sequence
  Single strand DNA oligonucleotide
aaaggatccatagacggtcctgatcttctgc

SEQ ID NO: 4226 - DNA, 31 bp, Artificial Sequence
  Single strand DNA oligonucleotide
aaaggatccagcaaacaactagctagccacc

SEQ ID NO: 4227 - DNA, 30 bp, Artificial Sequence
  Single strand DNA oligonucleotide
aaaggatcctcggaccctagtttcttcacc

SEQ ID NO: 4228 - DNA, 31 bp, Artificial Sequence
  Single strand DNA oligonucleotide
aaaggatccataatccacaaacacggacagg

SEQ ID NO: 4229 - DNA, 27 bp, Artificial Sequence
  Single strand DNA oligonucleotide
tttctcgagctcagcctccagccatcc

SEQ ID NO: 4230 - DNA, 32 bp, Artificial Sequence
  Single strand DNA oligonucleotide
aaagtcgacttctcacacaaaccctaatctcc

SEQ ID NO: 4231 - DNA, 31 bp, Artificial Sequence
  Single strand DNA oligonucleotide
aaaggatcctgctgccttagctctagcaatc

SEQ ID NO: 4232 - DNA, 31 bp, Artificial Sequence
  Single strand DNA oligonucleotide
aaaggatcccacagagtgttctcctagcacg

SEQ ID NO: 4233 - DNA, 35 bp, Artificial Sequence
  Single strand DNA oligonucleotide
aaaggatcctcaaagaaattgctactctgtactgc

SEQ ID NO: 4234 - DNA, 29 bp, Artificial Sequence
  Single strand DNA oligonucleotide
aaaggatccgttctgaaaccacgacccac

SEQ ID NO: 4235 - DNA, 34 bp, Artificial Sequence
  Single strand DNA oligonucleotide
aaagtcgaccgtgtttccgatttacattcaatac

SEQ ID NO: 4236 - DNA, 32 bp, Artificial Sequence
  Single strand DNA oligonucleotide
aaaggatccgttcccacactcactcatctttg

SEQ ID NO: 4237 - DNA, 31 bp, Artificial Sequence
  Single strand DNA oligonucleotide
aaaggatcccaaccagcactcactcactagc

SEQ ID NO: 4238 - DNA, 32 bp, Artificial Sequence
  Single strand DNA oligonucleotide
aaaggatcctcaggattgcttgattattggag

SEQ ID NO: 4239 - DNA, 34 bp, Artificial Sequence
  Single strand DNA oligonucleotide
aaaggatcctctgcaagtagcttaaatttgcttc

SEQ ID NO: 4240 - DNA, 27 bp, Artificial Sequence
  Single strand DNA oligonucleotide
aaagtcgaccaccatcgctccttgtcc

SEQ ID NO: 4241 - DNA, 31 bp, Artificial Sequence
  Single strand DNA oligonucleotide
aaagtcgactctctgcttccatggctttaac

SEQ ID NO: 4242 - DNA, 28 bp, Artificial Sequence
  Single strand DNA oligonucleotide
aaaggatccttgtctcgtacctgccagc

SEQ ID NO: 4243 - DNA, 31 bp, Artificial Sequence
  Single strand DNA oligonucleotide
aaaggatccgtctctgccttcgtctctcaac

SEQ ID NO: 4244 - DNA, 30 bp, Artificial Sequence
  Single strand DNA oligonucleotide
aaagtcgacacagggtaaggcgatgttctc

SEQ ID NO: 4245 - DNA, 31 bp, Artificial Sequence
  Single strand DNA oligonucleotide
aaagtcgacttacccacaccctctctctctc

SEQ ID NO: 4246 - DNA, 31 bp, Artificial Sequence
  Single strand DNA oligonucleotide
aaagtcgaccgcagacctagcactaccagag

SEQ ID NO: 4247 - DNA, 31 bp, Artificial Sequence
  Single strand DNA oligonucleotide
aaagaattctgccaagagtacagtttgatgc

SEQ ID NO: 4248 - DNA, 34 bp, Artificial Sequence
  Single strand DNA oligonucleotide
aaaggatcctgtatcttctgatcggttcaatttc

SEQ ID NO: 4249 - DNA, 27 bp, Artificial Sequence
  Single strand DNA oligonucleotide
tttggatcccggagatggcggtggagt

SEQ ID NO: 4250 - DNA, 28 bp, Artificial Sequence
  Single strand DNA oligonucleotide
aaaggatccaatagcaagcggaagctgg

SEQ ID NO: 4251 - DNA, 33 bp, Artificial Sequence
  Single strand DNA oligonucleotide
aaaggatcccacgaggactgataagagctgatc

SEQ ID NO: 4252 - DNA, 31 bp, Artificial Sequence
  Single strand DNA oligonucleotide
aaaggatccctccggttcttggtgtttattg

SEQ ID NO: 4253 - DNA, 31 bp, Artificial Sequence
  Single strand DNA oligonucleotide
aaaggatccagctcacattggtcctcttacc

SEQ ID NO: 4254 - DNA, 34 bp, Artificial Sequence
  Single strand DNA oligonucleotide
aaaggatccggtttgtattgtagctcgagaattg

SEQ ID NO: 4255 - DNA, 29 bp, Artificial Sequence
  Single strand DNA oligonucleotide
aaagtcgaccgacttgatccgatctccag

SEQ ID NO: 4256 - DNA, 29 bp, Artificial Sequence
  Single strand DNA oligonucleotide
aaaggatccaatccgatcctgaaccattc

SEQ ID NO: 4257 - DNA, 32 bp, Artificial Sequence
  Single strand DNA oligonucleotide
aaaggatccttacctgcgtcttgttcttcttg

SEQ ID NO: 4258 - DNA, 31 bp, Artificial Sequence
  Single strand DNA oligonucleotide
aaaggatccagctgacaagaggaggtacgtg

SEQ ID NO: 4259 - DNA, 29 bp, Artificial Sequence
  Single strand DNA oligonucleotide
aaagtcgacgaatccccaaaaccctagcc

SEQ ID NO: 4260 - DNA, 32 bp, Artificial Sequence
  Single strand DNA oligonucleotide
aaagtcgactggaaaggaaaagagacacacac

SEQ ID NO: 4261 - DNA, 31 bp, Artificial Sequence
  Single strand DNA oligonucleotide
aaaggatccaaagtggttcacgaaccttagc

SEQ ID NO: 4262 - DNA, 30 bp, Artificial Sequence
  Single strand DNA oligonucleotide
aaaggatccgatggagagagtcctggtgtg

SEQ ID NO: 4263 - DNA, 33 bp, Artificial Sequence
  Single strand DNA oligonucleotide
tacggatccaccaattgtttaatttgccttatg

SEQ ID NO: 4264 - DNA, 30 bp, Artificial Sequence
  Single strand DNA oligonucleotide
aaagaattcggttcgaatccctctctttcc

SEQ ID NO: 4265 - DNA, 31 bp, Artificial Sequence
  Single strand DNA oligonucleotide
aaaggtaccctaatctccactcggaaggacg

SEQ ID NO: 4266 - DNA, 34 bp, Artificial Sequence
  Single strand DNA oligonucleotide
tttggtacctcagggacttggtgagcataatcag

SEQ ID NO: 4267 - DNA, 31 bp, Artificial Sequence
  Single strand DNA oligonucleotide
aaaggtacctcagagaaatgcaaattgttcc

SEQ ID NO: 4268 - DNA, 31 bp, Artificial Sequence
  Single strand DNA oligonucleotide
aaagaattcctacgatttaaccacgcaacag

SEQ ID NO: 4269 - DNA, 31 bp, Artificial Sequence
  Single strand DNA oligonucleotide
aaagaattcgagcactagccaaggcataatg

SEQ ID NO: 4270 - DNA, 31 bp, Artificial Sequence
  Single strand DNA oligonucleotide
aaagaattcgagggacttgtttaggcctctc

SEQ ID NO: 4271 - DNA, 31 bp, Artificial Sequence
  Single strand DNA oligonucleotide
aaaggtaccttatgtaggagagatggccgag

SEQ ID NO: 4272 - DNA, 34 bp, Artificial Sequence
  Single strand DNA oligonucleotide
aaagaattcgtgagcagctaccctaacaaacatc

SEQ ID NO: 4273 - DNA, 31 bp, Artificial Sequence
  Single strand DNA oligonucleotide
aaaggtacctctcagaacatttggagcaatg

SEQ ID NO: 4274 - DNA, 36 bp, Artificial Sequence
  Single strand DNA oligonucleotide
aaaggtaccctaccaccaatggatcataactctcac

SEQ ID NO: 4275 - DNA, 30 bp, Artificial Sequence
  Single strand DNA oligonucleotide
aaaggtaccgttacttcacggccagacatc

SEQ ID NO: 4276 - DNA, 31 bp, Artificial Sequence
  Single strand DNA oligonucleotide
aaaggatcctgatgattacgaagaagggagg

SEQ ID NO: 4277 - DNA, 30 bp, Artificial Sequence
  Single strand DNA oligonucleotide
tttggtacctcatcattcccacaaggggct

SEQ ID NO: 4278 - DNA, 31 bp, Artificial Sequence
  Single strand DNA oligonucleotide
aaagaattccatgctcgaccacagcttatag

SEQ ID NO: 4279 - DNA, 31 bp, Artificial Sequence
  Single strand DNA oligonucleotide
aaagaattcgaatcccaataacaaatggctg

SEQ ID NO: 4280 - DNA, 27 bp, Artificial Sequence
  Single strand DNA oligonucleotide
aaaggtaccgcatgcatcagactgtcc

SEQ ID NO: 4281 - DNA, 32 bp, Artificial Sequence
  Single strand DNA oligonucleotide
aaaggatccctaagccaacccttctaccttgg

SEQ ID NO: 4282 - DNA, 29 bp, Artificial Sequence
  Single strand DNA oligonucleotide
aaagaattcgcaatgaagcctagccacac

SEQ ID NO: 4283 - DNA, 26 bp, Artificial Sequence
  Single strand DNA oligonucleotide
tttgaattcagtggcgcgtcgtcatg

SEQ ID NO: 4284 - DNA, 30 bp, Artificial Sequence
  Single strand DNA oligonucleotide
aaaaggcctgtgacacggaggagacaaatg

SEQ ID NO: 4285 - DNA, 33 bp, Artificial Sequence
  Single strand DNA oligonucleotide
aaaggatccctacggagcaacaacaacaatgag

SEQ ID NO: 4286 - DNA, 35 bp, Artificial Sequence
  Single strand DNA oligonucleotide
aaaggtacctcaatgttactcctgcaaatactagg

SEQ ID NO: 4287 - DNA, 33 bp, Artificial Sequence
  Single strand DNA oligonucleotide
aaaggatcctctatctacatggattgcaccaac

SEQ ID NO: 4288 - DNA, 35 bp, Artificial Sequence
  Single strand DNA oligonucleotide
aaaggtaccctaaggcaacagatggaactacaacc

SEQ ID NO: 4289 - DNA, 31 bp, Artificial Sequence
  Single strand DNA oligonucleotide
aaaggtaccctacaccaacacctatgggtcc

SEQ ID NO: 4290 - DNA, 31 bp, Artificial Sequence
  Single strand DNA oligonucleotide
aaaggtaccaaagtacacatcacatcggtgc

SEQ ID NO: 4291 - DNA, 31 bp, Artificial Sequence
  Single strand DNA oligonucleotide
aaaggtacctcttcactgttggcatctcatc

SEQ ID NO: 4292 - DNA, 32 bp, Artificial Sequence
  Single strand DNA oligonucleotide
aaaggtaccgcaaggaaacgtacatctaatgg

SEQ ID NO: 4293 - DNA, 30 bp, Artificial Sequence
  Single strand DNA oligonucleotide
aaaggtacctaagggacacattccttggag

SEQ ID NO: 4294 - DNA, 34 bp, Artificial Sequence
  Single strand DNA oligonucleotide
aaaggtaccctagcgtggcaatgttacatacttg

SEQ ID NO: 4295 - DNA, 32 bp, Artificial Sequence
  Single strand DNA oligonucleotide
tttggatccttattactgctgcttgcactcgg

SEQ ID NO: 4296 - DNA, 34 bp, Artificial Sequence
  Single strand DNA oligonucleotide
aaagaattcctagagtagggtgctcaaccaagtg

SEQ ID NO: 4297 - DNA, 31 bp, Artificial Sequence
  Single strand DNA oligonucleotide
aaagaattctgtttgctgactccttctcctc

SEQ ID NO: 4298 - DNA, 31 bp, Artificial Sequence
  Single strand DNA oligonucleotide
aaagaattcatgaacttaatagctggcgacc

SEQ ID NO: 4299 - DNA, 33 bp, Artificial Sequence
  Single strand DNA oligonucleotide
aaaggtaccggcacagtacatcctgtaagcaac

SEQ ID NO: 4300 - DNA, 31 bp, Artificial Sequence
  Single strand DNA oligonucleotide
aaaggtacctatcagaaaccacacggatgtc

SEQ ID NO: 4301 - DNA, 30 bp, Artificial Sequence
  Single strand DNA oligonucleotide
tttgaattcctctacataccagcagcagcg

SEQ ID NO: 4302 - DNA, 33 bp, Artificial Sequence
  Single strand DNA oligonucleotide
aaaggtaccgctagctattcagaaaccgagttg

SEQ ID NO: 4303 - DNA, 35 bp, Artificial Sequence
  Single strand DNA oligonucleotide
aaaaggcctcacaaataatgcaatttacaaaccag

SEQ ID NO: 4304 - DNA, 34 bp, Artificial Sequence
  Single strand DNA oligonucleotide
aaaggtaccctaagaacagtgaggaggttgatcg

SEQ ID NO: 4305 - DNA, 32 bp, Artificial Sequence
  Single strand DNA oligonucleotide
aaaaggcctaatcacaccacgctgttgtagtc

SEQ ID NO: 4306 - DNA, 31 bp, Artificial Sequence
  Single strand DNA oligonucleotide
aaaggtacctacagtcacacacatggctacg

SEQ ID NO: 4307 - DNA, 32 bp, Artificial Sequence
  Single strand DNA oligonucleotide
aaaggtacctgctctagcaacttacgacaagg

SEQ ID NO: 4308 - DNA, 31 bp, Artificial Sequence
  Single strand DNA oligonucleotide
aaaggtacctgtaccaaccttccgtaactcc

SEQ ID NO: 4309 - DNA, 29 bp, Artificial Sequence
  Single strand DNA oligonucleotide
aaaggtaccagggagtagcatgcaacagg

SEQ ID NO: 4310 - DNA, 32 bp, Artificial Sequence
  Single strand DNA oligonucleotide
aaaggtaccaatctgcatttcctccatttctc

SEQ ID NO: 4311 - DNA, 31 bp, Artificial Sequence
  Single strand DNA oligonucleotide
aaacccggggcaggctaattataccgtgtgc

SEQ ID NO: 4312 - DNA, 30 bp, Artificial Sequence
  Single strand DNA oligonucleotide
aaaggtaccatagatcgaagctagcccacg

SEQ ID NO: 4313 - DNA, 33 bp, Artificial Sequence
  Single strand DNA oligonucleotide
aaaggatccaaatgatatgcatgaacaaggctc

SEQ ID NO: 4314 - DNA, 31 bp, Artificial Sequence
  Single strand DNA oligonucleotide
aaaggtaccagggatttgcatacagctcttc

SEQ ID NO: 4315 - DNA, 36 bp, Artificial Sequence
  Single strand DNA oligonucleotide
aaaggtaccctaatcactgactggagtaaacgaagg

SEQ ID NO: 4316 - DNA, 31 bp, Artificial Sequence
  Single strand DNA oligonucleotide
aaagaattctgcaggtgactctgatatttgg

SEQ ID NO: 4317 - DNA, 31 bp, Artificial Sequence
  Single strand DNA oligonucleotide
aaagaattcgctatcgcacaaataggaggag

SEQ ID NO: 4318 - DNA, 31 bp, Artificial Sequence
  Single strand DNA oligonucleotide
aaagaattcctatgcctcttggacgtggtag

SEQ ID NO: 4319 - DNA, 31 bp, Artificial Sequence
  Single strand DNA oligonucleotide
aaaggtacctactcctgtactgtggcaatcg

SEQ ID NO: 4320 - DNA, 32 bp, Artificial Sequence
  Single strand DNA oligonucleotide
aaagaattcgcatacatcaagatcaagggaag

SEQ ID NO: 4321 - DNA, 31 bp, Artificial Sequence
  Single strand DNA oligonucleotide
aaagaattcgggaaagcatttatcaaggagg

SEQ ID NO: 4322 - DNA, 33 bp, Artificial Sequence
  Single strand DNA oligonucleotide
aaaggatccaccaaataaactacctccgattcc

SEQ ID NO: 4323 - DNA, 36 bp, Artificial Sequence
  Single strand DNA oligonucleotide
aaaggtacctcaaatcaaataatcaacaagagaaca

SEQ ID NO: 4324 - DNA, 31 bp, Artificial Sequence
  Single strand DNA oligonucleotide
aaaggtaccttgaagatggttgctacaccag

SEQ ID NO: 4325 - DNA, 30 bp, Artificial Sequence
  Single strand DNA oligonucleotide
aaaggtaccccaaattgacagaatgggagc

SEQ ID NO: 4326 - DNA, 32 bp, Artificial Sequence
  Single strand DNA oligonucleotide
aaaaggccttgtttctactaccgaccaccaag

SEQ ID NO: 4327 - DNA, 34 bp, Artificial Sequence
  Single strand DNA oligonucleotide
aaagatatcctaatcgactaggcaatgcaacatc

SEQ ID NO: 4328 - DNA, 31 bp, Artificial Sequence
  Single strand DNA oligonucleotide
aaaggtacctattccacaaggctaaacggtc

SEQ ID NO: 4329 - DNA, 31 bp, Artificial Sequence
  Single strand DNA oligonucleotide
aaaggtaccaaacatttccgagatatgcagg

SEQ ID NO: 4330 - DNA, 30 bp, Artificial Sequence
  Single strand DNA oligonucleotide
aaaggtacccctctagaagtgtgcgtgacc

SEQ ID NO: 4331 - DNA, 30 bp, Artificial Sequence
  Single strand DNA oligonucleotide
aaaggtaccagacctaaatcaagcggatcg

SEQ ID NO: 4332 - DNA, 31 bp, Artificial Sequence
  Single strand DNA oligonucleotide
aaagaattccttcagtgaccatcacgaacac

SEQ ID NO: 4333 - DNA, 34 bp, Artificial Sequence
  Single strand DNA oligonucleotide
aaaggtaccctaagcgatcacaaatacacaatgc

SEQ ID NO: 4334 - DNA, 30 bp, Artificial Sequence
  Single strand DNA oligonucleotide
aaaggtaccaaatgttcctccaagcctcac

SEQ ID NO: 4335 - DNA, 31 bp, Artificial Sequence
  Single strand DNA oligonucleotide
aaagaattcagtgatcggaaagtgtttctgc

SEQ ID NO: 4336 - DNA, 30 bp, Artificial Sequence
  Single strand DNA oligonucleotide
aaaggatccccacatgaagtgaatggaagc

SEQ ID NO: 4337 - DNA, 31 bp, Artificial Sequence
  Single strand DNA oligonucleotide
aaaggtaccgcccatcagatactcattcagg

SEQ ID NO: 4338 - DNA, 31 bp, Artificial Sequence
  Single strand DNA oligonucleotide
aaaggtacccgttaggtggcctcactacaac

SEQ ID NO: 4339 - DNA, 31 bp, Artificial Sequence
  Single strand DNA oligonucleotide
aaagaattcgtggtgttagcctgtctttgtg

SEQ ID NO: 4340 - DNA, 39 bp, Artificial Sequence
  Single strand DNA oligonucleotide
tttggtaccttacacagtttaaaccctaagcaagtaaag

SEQ ID NO: 4341 - DNA, 31 bp, Artificial Sequence
  Single strand DNA oligonucleotide
aaaggtaccaatttacactccctcccaaacc

SEQ ID NO: 4342 - DNA, 33 bp, Artificial Sequence
  Single strand DNA oligonucleotide
aaaggatcctcatcaaaccctgctacttcctcg

SEQ ID NO: 4343 - DNA, 31 bp, Artificial Sequence
  Single strand DNA oligonucleotide
aaaggtaccattgtcaccatggatttggttc

SEQ ID NO: 4344 - DNA, 32 bp, Artificial Sequence
  Single strand DNA oligonucleotide
aaaggtacccaatgtgtcatctaactgcttgc

SEQ ID NO: 4345 - DNA, 34 bp, Artificial Sequence
  Single strand DNA oligonucleotide
aaagaattcctaattctgatggtggaaagcactc

SEQ ID NO: 4346 - DNA, 31 bp, Artificial Sequence
  Single strand DNA oligonucleotide
aaaaggccttagaccgttggctagttcatgg

SEQ ID NO: 4347 - DNA, 31 bp, Artificial Sequence
  Single strand DNA oligonucleotide
aaaggtaccaaagtgacagaattaggcgtgc

SEQ ID NO: 4348 - DNA, 31 bp, Artificial Sequence
  Single strand DNA oligonucleotide
aaagaattcaccggctggttacagtacagag

SEQ ID NO: 4349 - DNA, 32 bp, Artificial Sequence
  Single strand DNA oligonucleotide
aaaggatccttcacctcaatgaatagctctgg

SEQ ID NO: 4350 - DNA, 30 bp, Artificial Sequence
  Single strand DNA oligonucleotide
aaagaattcatcataatcgcgcaaacacag

SEQ ID NO: 4351 - DNA, 31 bp, Artificial Sequence
  Single strand DNA oligonucleotide
aaaggtaccagcaccaagtatttgtcacacg

SEQ ID NO: 4352 - DNA, 34 bp, Artificial Sequence
  Single strand DNA oligonucleotide
aaaggtaccctaaaggaaccatgatccacctatg

SEQ ID NO: 4353 - DNA, 31 bp, Artificial Sequence
  Single strand DNA oligonucleotide
aaaggtaccggtagaactcatcatcgcagtg

SEQ ID NO: 4354 - DNA, 35 bp, Artificial Sequence
  Single strand DNA oligonucleotide
aaagaattcttattacacgagaaaattagggaggc

SEQ ID NO: 4355 - DNA, 34 bp, Artificial Sequence
  Single strand DNA oligonucleotide
aaaggatccctatgccgacagagtactcatcaag

SEQ ID NO: 4356 - DNA, 31 bp, Artificial Sequence
  Single strand DNA oligonucleotide
aaaaggcctccatggcttagaatagcattgg

SEQ ID NO: 4357 - DNA, 39 bp, Artificial Sequence
  Single strand DNA oligonucleotide
tttgaattctcagctatatcagtcgatcttcacagaagc

SEQ ID NO: 4358 - DNA, 31 bp, Artificial Sequence
  Single strand DNA oligonucleotide
aaaggtaccagttcatcacaaacagcacagg

SEQ ID NO: 4359 - DNA, 35 bp, Artificial Sequence
  Single strand DNA oligonucleotide
aaaggtacctcattcaagaagaattagaggcaatc

SEQ ID NO: 4360 - DNA, 31 bp, Artificial Sequence
  Single strand DNA oligonucleotide
aaaggtaccataaacaagatcacgggctcac

SEQ ID NO: 4361 - DNA, 31 bp, Artificial Sequence
  Single strand DNA oligonucleotide
aaaggtaccccctctgataaagcaaccactg

SEQ ID NO: 4362 - DNA, 31 bp, Artificial Sequence
  Single strand DNA oligonucleotide
aaaggtaccctcgcaaatcagagattcagag

SEQ ID NO: 4363 - DNA, 31 bp, Artificial Sequence
  Single strand DNA oligonucleotide
aaaggtaccttcatacaacgaggcatctgag

SEQ ID NO: 4364 - DNA, 31 bp, Artificial Sequence
  Single strand DNA oligonucleotide
aaaggatccgcaaagtcgtttcaaggagaag

SEQ ID NO: 4365 - DNA, 35 bp, Artificial Sequence
  Single strand DNA oligonucleotide
aaaggtaccctaattcagggaatcggaattaaatg

SEQ ID NO: 4366 - DNA, 34 bp, Artificial Sequence
  Single strand DNA oligonucleotide
aaaaggcctctaaggccaaatacaataagccaac

SEQ ID NO: 4367 - DNA, 31 bp, Artificial Sequence
  Single strand DNA oligonucleotide
aaagaattcgaagtacgaatcatcccgtttg

SEQ ID NO: 4368 - DNA, 36 bp, Artificial Sequence
  Single strand DNA oligonucleotide
tttgaattcctactcttgctacgctgaagtacttgg

SEQ ID NO: 4369 - DNA, 31 bp, Artificial Sequence
  Single strand DNA oligonucleotide
aaaggtacctatacagcacacgcagaaggtc

SEQ ID NO: 4370 - DNA, 38 bp, Artificial Sequence
  Single strand DNA oligonucleotide
tttggtaccctacagagtcgactagtttccatagacag

SEQ ID NO: 4371 - DNA, 31 bp, Artificial Sequence
  Single strand DNA oligonucleotide
aaaggtacctgttacaacgacgaaactgcac

SEQ ID NO: 4372 - DNA, 34 bp, Artificial Sequence
  Single strand DNA oligonucleotide
aaaggtaccctagcatactgtagcgggtttgatg

SEQ ID NO: 4373 - DNA, 36 bp, Artificial Sequence
  Single strand DNA oligonucleotide
tttggtacctcatatatacaccactacacggacctg

SEQ ID NO: 4374 - DNA, 31 bp, Artificial Sequence
  Single strand DNA oligonucleotide
aaagaattctgagccaggtacgaagacctac

SEQ ID NO: 4375 - DNA, 31 bp, Artificial Sequence
  Single strand DNA oligonucleotide
aaaggatccgtgggtcacaaaccatcatttc

SEQ ID NO: 4376 - DNA, 31 bp, Artificial Sequence
  Single strand DNA oligonucleotide
aaaggtaccgccgaccaggatgtaataactg

SEQ ID NO: 4377 - DNA, 31 bp, Artificial Sequence
  Single strand DNA oligonucleotide
aaaggtacctgcttacacggcatctactctg

SEQ ID NO: 4378 - DNA, 34 bp, Artificial Sequence
  Single strand DNA oligonucleotide
aaaggtaccgcctacaattgcagactatgctaag

SEQ ID NO: 4379 - DNA, 30 bp, Artificial Sequence
  Single strand DNA oligonucleotide
aaagaattcaacaacggtgggtaattcgag

SEQ ID NO: 4380 - DNA, 31 bp, Artificial Sequence
  Single strand DNA oligonucleotide
aaaggtaccacactccaccagacagtacacg

SEQ ID NO: 4381 - DNA, 31 bp, Artificial Sequence
  Single strand DNA oligonucleotide
aaaaggcctgtgtggagaggacctaatgacc

SEQ ID NO: 4382 - DNA, 31 bp, Artificial Sequence
  Single strand DNA oligonucleotide
aaaggtaccaagaagcaactgagcaatcacc

SEQ ID NO: 4383 - DNA, 31 bp, Artificial Sequence
  Single strand DNA oligonucleotide
aaaaggcctagtaggtgtcttgctgtcctcc

SEQ ID NO: 4384 - DNA, 31 bp, Artificial Sequence
  Single strand DNA oligonucleotide
aaaggtacctaaataacacgacagccacacc

SEQ ID NO: 4385 - DNA, 29 bp, Artificial Sequence
  Single strand DNA oligonucleotide
tttggtaccctactaggtgacggcgcacg

SEQ ID NO: 4386 - DNA, 35 bp, Artificial Sequence
  Single strand DNA oligonucleotide
aaaggtaccctaaacctgtataaagctcgttgctg

SEQ ID NO: 4387 - DNA, 36 bp, Artificial Sequence
  Single strand DNA oligonucleotide
tttggtaccgcatttgtgtgaagactattatatgcc

SEQ ID NO: 4388 - DNA, 34 bp, Artificial Sequence
  Single strand DNA oligonucleotide
aaaggtaccctaaagtggaaacactcggaatgac

SEQ ID NO: 4389 - DNA, 34 bp, Artificial Sequence
  Single strand DNA oligonucleotide
aaaggtaccctagttcccggcgatacatatacac

SEQ ID NO: 4390 - DNA, 29 bp, Artificial Sequence
  Single strand DNA oligonucleotide
tttggtacccgaacctgtgcttgcatttc

SEQ ID NO: 4391 - DNA, 36 bp, Artificial Sequence
  Single strand DNA oligonucleotide
aaaggtacctgaactacatgagcttggtttctattg

SEQ ID NO: 4392 - DNA, 31 bp, Artificial Sequence
  Single strand DNA oligonucleotide
aaagaattcccctattgtaaacccaaggtcc

SEQ ID NO: 4393 - DNA, 31 bp, Artificial Sequence
  Single strand DNA oligonucleotide
aaaggtaccatcctacggatctagggacacc

SEQ ID NO: 4394 - DNA, 31 bp, Artificial Sequence
  Single strand DNA oligonucleotide
aaaggtaccgccttgattacatcagttgcac

SEQ ID NO: 4395 - DNA, 27 bp, Artificial Sequence
  Single strand DNA oligonucleotide
tttggtacccaagcaacgagggctcac

SEQ ID NO: 4396 - DNA, 31 bp, Artificial Sequence
  Single strand DNA oligonucleotide
aaaggtaccccaagtactcatcagccatcac

SEQ ID NO: 4397 - DNA, 34 bp, Artificial Sequence
  Single strand DNA oligonucleotide
aaaggtaccctagctgtatttgtgattgcaggtc

SEQ ID NO: 4398 - DNA, 31 bp, Artificial Sequence
  Single strand DNA oligonucleotide
aaaggtacccaagcacgctttcacaactatc

SEQ ID NO: 4399 - DNA, 34 bp, Artificial Sequence
  Single strand DNA oligonucleotide
tttgaattcctagttaggaagctaagcgtttgcg

SEQ ID NO: 4400 - DNA, 31 bp, Artificial Sequence
  Single strand DNA oligonucleotide
aaagaattcgaaccactcacacaaccatgag

SEQ ID NO: 4401 - DNA, 31 bp, Artificial Sequence
  Single strand DNA oligonucleotide
aaaaggcctccactgaccaaatatcatcgac

SEQ ID NO: 4402 - DNA, 31 bp, Artificial Sequence
  Single strand DNA oligonucleotide
aaaaggcctgatcctcgtctcacaattctcc

SEQ ID NO: 4403 - DNA, 31 bp, Artificial Sequence
  Single strand DNA oligonucleotide
aaaggtaccaaatctccaggctgttcagttc

SEQ ID NO: 4404 - DNA, 31 bp, Artificial Sequence
  Single strand DNA oligonucleotide
aaaggtaccccaaattgaaattacagcccac

SEQ ID NO: 4405 - DNA, 34 bp, Artificial Sequence
  Single strand DNA oligonucleotide
aaaggtacccgtcataggctcataaactctactg

SEQ ID NO: 4406 - DNA, 29 bp, Artificial Sequence
  Single strand DNA oligonucleotide
tttgaattccgagaggaggaccccatttc
